United States Patent 10,233,495 (METHODS AND COMPOSITIONS FOR SCREENING AND TREATING DEVELOPMENTAL DISORDERS) - sequence listing, part 168

SEQ ID NO: 1003 - DNA, 1402428 bp, Homo sapiens
ataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggtaggatctggtttttccctctgcttctgcacatgtgtcttcattcatctacctaacacatgggcattgatatatcggggtactgacagtggacatacctacttgatttgagtttgaattgaaggttgagtcacaataaagcatttggctctgcatgtgtgtgtagactggaaagaatagtttccactgaacacttctttcatcttcatgactttttttttttttactgagaatctatcagaggtatatttccagaagaaagttttgtgagtgtctagaagagtttccagtccatgccaattttcttgatagaactggggaagaatttgcaaactgctagaaataaatagcatcaaattgactacaaatctgataacaggatttcattgtcatatgaattttggatctcttatccttttttaaaaaaagctcatccttcattgtgagcattgaactggtggttatactaaagtgattatagtgagagaggatgaaagactagagagagagtataaaatcacatgtctttatttatatcaccatgtaactcaaaaccagtgagatgattggagacactcttcaatgcaggtgttgtttaaaatttgaggcttttctgacagcacatggttaaaggtaaagaacaaactcacaatttcactcttctgttttagtttcaagtcatgcttataccattctctttgtttttattcgggatgctcttatttccaagaaggcttataaacgaccagacttccaatcaaagtttactatattttgccatttacttgaattgtattattatctatgtggatattttgcatcttgagggaaagtgatggattcgtctgaaactcttttatgaaaaaaaaaaaaaaactaaaacaaaaaacgtgatatcctgacagggcatctttagttactgcaatctctcattaacatacaagtgcataccttttgctactattcctgataagcctgactttttatgatttatattatgttttggtttatgtctcaggcctttaataatattgcatagactgtaattacaaaaggaatataattttcaacaatgtctcttcttcatgaatttacctaccgtttgccagagtgtttcagtgatagataaaccataaactaaacatgttcctctatttattagcagtgacttttaaaagcaatggggtttccagggtatattaaatgatgcataattagattcccatcatacataaacatagggagttaactgaaatcatgcagaactcatattcagataatttacaccacctctaataacagatatgagaatctttttcagcattagattttctgtgctgtatctaagtttagaaataaaaaatgttgagcttttggtatagttttcctctgtgtatcagtttcccacatacatcaattatctaagcatatcactgaacaaagccaaaatagtaaatacatgacactctacattgggatatataagctctagtgggaaatatgtattgaagcctaaagtgggatagagttacaaactggctgcctactgctaagtatgtctagaatgctataacaaaaccagtggctttctgtttaagagtctgaggtcacaggaatcaagcatttattttcccttttctttattgagtaagcataaatgactactactttcagagacttcaaatcacttcctttattagtgctctggcattggctgcccacaaacaaactgtggaacagaaaaaaaaatgtttctagtgtagaggttttacatcatcttgctgatcttgcagatgctgttttttccttctaactgcagccattgagttgaaatgaaaagtatcataaaaattggacaacccaccacttaacaatgtattatattaatggcttaatgaaggaatcttgaatcaaagctctgggtaatttggttaattgtacaagttaaattcttttgtgcaccccattcccaatattgctctggggagcaaaaaaatgcttgtgatgttcataaaatatatatagtcgcaagcactgaactattaagggagtaattacttgagtattttgcaatttgcaatagtgaaaagggatgagtggaaaatctctcttagttcaaattatgtgctcaattatgaaacatttatggctttttgaatttatactaaaaatggctatctatatttaggtaatgcattagcctatgaacaaaatgcaataacaatctaaagaaaaactctaagatgagagggttttgggaagctgtgggacattggagctcaaaatactctttgaactattagaattttagtttcaagcatggttgtttaaagttaattttattcctcactcttaaatttactatcaatttactatcagataattttaagtaaccctccctcatggaatctggttggcctgcaggtaatgataacccactttgaggatctggaaataaataacttgcatattgctccattttagaaattcaaaaacctctagagacttttctcccaaagctcagtgtaataacctctagagaacttttcccccatcagtatagtaaatgctgactgtttcttctctcaacagttaaactacggctaaaaagaatgcaatgggaatgaacaaaagtgaaatgcattgctaaaatagctgtaaaggccaaaagtgtgcaggaggaggaaaaacagctctgtgtgtgtgtgtgtgtgtgtgtgtgtgtgtgtgtgtgtgtgtgtgttctcctccacttgaagttcaagaagtgatgaagtctatagtgggtaaaattcagcaattgttgccagtgaaggctgtttgtggccatgatgtgtcagagttggaaaagaggaaattgggagaagttataatggaacaagatgatcaagagtattcaggttgcttgacacttgctttggtcgttctggccattctttagctcagacagttactgacacacttttcctggcatactttggcaggtatgttcctatcgtcaaaaccagtaagggagagaaaagggagtcaaataggggtgccaagtgtgttctcagatcactttgggtgaaatgctgaatgcaattcactctgaaaactttcctccatttcagagcttgtaagggaagaaagcttttcctgatgtgattacaaatcttcctgtgaaggtagcaacattcttttaaaaaaaatcttttactctgagatgtttaatggaaagttttaggaagtatctgggaatgctaaatagagatcagatctttgcgttattataaacgtgatttctgaagaatgtcccccaccatgggtagcaaacttgagtttttccttcaccattatggcttctcttggctgcactgaaagtaaattaaacctttcagctaaatctctgatcttggtttacttcttttgctagtggaattgcaaacttagaattttgcctctaaaatgtgcagatttttttcttatttctttcacatttgaatatcagtctagtatcctcgtgtgtctaaaatgagtagagaaaatccttcatcctttttgaagttataaattgtgagtaacttatctggggtggtgattcctggatcaagaattatatgtattatactttatatggtaactctgaaatacagtacacaatatttctttacccttcccatgtagtgaccggtcttcctctttctctttcctttttacaagacctgcctgatttattttaatactgccttcacacccaggttttcacttccatttagaaaagagtctcaaggtctaaaagttctagttacttcctacatagccctgctgcaagtttttacaaactatacttaaacgaatctttaagattttcattgtcttcggagtacatcttgagctggcaaactttttcatggtgatttttactgccttttatattgtaatattgatgagtcattgtgctaataaagacttttcccccttgctacttctaatccatagcctcagccaaatgaggcataggaaacagaagacaaggggttaaaagaggatgaaaatcttatcacaagtatgtattgttaaatacgtaggcttggaacatggtggttaggaaataatttcgttagcaaattggtattttggagtgtgacattgccatgaattggcatgatgagatggcttggaactacagcattgcaatctcactggttgttaaattttttttttttttttttgagacggagtctcagctcactgcaacctccgcctcccagtttcaagtgattctcctgcctcagcctcccgagtagctgggactacaggcacctgccaccacgcctggctaatttttgtatttttagtagagacggggtttcaccacattggccagcatggtctcgatctcttgacctcattatccacccctctcagcctcccaaagtgctgggattacaggcatgagccaccgcgcccggcccacttgttgttaattctatacccctaacctaaatgctggacactgacaaacctgcgtttcacatagtacttgaacttgaattgtaagttattcttaaagggtatttcataattaaatatataaattatatccacaaaaatttagaaatgcaaggaatgtttaataacaaaaaatctacctctgtgtgtcattgcaatatgcaaaatggaagattctccaatgtcattattacagtatatgaaattctaagtggaaagattgttacatacttctacattgtaccttatcttagagagtcttcctattcctaatcctaagaactttactcataagaatacataaaaagaaactttataaaattatcgactcaacatagattcatacacactaaagaaagagttaccactggtaactctacagcaactgatttcaccagtgagttctacacttccatttagcaaggtacagatttttcttcagcattaggatgagtcattctaagcggtgatagctaaggaaatcaaaagaaaaaacttacaaaaattagaaataaggatattttatgtgtgtgagagaaaacttttttctcttagcaatggtctacatatttttaattactctgacacagcttccttatatgcttaaggcaaaatcacagcctgtgataaacaagaataggaccatctgctaatgacaaatttatcaccacttacaatttccatttatggccaagtatttaaatcttaaataattatagcacaatttatttcaaattactataaattcagctgtttttaaaatgaagcattatagttttttttctttttaataaagagtgactataataattggccagctttacattttatagcttagatcttcataaaatcaaaagtttctttttcctttgacatttatagtgtttgaatgtcaacttttactttgaagaagtattcttgtataatataatttcaaggtaaatttaaacagttttatgaagtatttagtatttattttattcttgagaaagtaatgtgttaatacttttctagaaattcatgttttggtcagttagtgaagacattcttgatggtaaatttgtgatgacaaattactaactctcactgaaaagacattatgggtctacaaatgaagcatggacgtagtaagctaagatagtggttatcaaagtgctgtccctagaccagcagtatcagcatctcctgtgaactcattaaaaatgcaaattcttggactctacttagacctactaagtcagaaactcttggggtagggcccagcaatctttggtgggtgattctgatccatattgatgttttggaaccactgagctaaagaattacaaaataagacacatctgtgctattgtcagcctgtaagaattgtctgagtaccacagaagaggtctaaacagcttcagaatgatacttagggttattaagtaacatgaattctgtgacagccaaaatctcatcattaggtttatctcttttattcctcacagggattacttgatactatgcctttcacccagtagacattaaatatatatttgttggttattaatgactgttaaggtcatttagtagagataatgctctaagaggacctaaatgatattgtaaggtgttactcaacatgtaagcaggttagaggccttgctttttgttttaaattcatagaaaatttctcaaagaagtatactgacattttggcttttgatggttttgttctctgatcttggtttggggccatctggtaatcaacacattttggtaactagggggatttagaatcatactaattttttgtccagaaattgtgctggagaaatgtctcccttcttgccagctgtatctgaaaattggcaaacaatggtagggaggaatatcatcacattagcctttctccttgcctttatgaatgttctttggcccgtagatatgtgccaggttggtagggcataactggaagtagcacacaactggaacaacatgaataattgtgaacaaagctggccttccacggacagacacagcataatattacattagcagaacaagatttaagctgggggataagctgtgaaataaggaaattacctccaaacaggcttatttcttggaaattcttcatagcactctgatgtttttctttttttttttttttatagttaccactgggaagaaaagtaaaatgcatacagcctgccctactacctgcaaacggatataaggcagatcggatggctttttctttagaggggcatccttaagtggagttctcactctccctttaccacatgaaccatgtggtcttgcggaaggcaattaaccctgttaaggatttctcccccactaacagaagggcaataaacttaaattatctgcccaaacaaaaatgctatgtaagtgctttgtattatgatttgttctagtagcaatttttaaggatacgacattttcataaggagttgtatagtgagaatcaatttttatgacataaaagctgagaattttatttgcaattattattaactataatgatgataaaaattcattttgaagtcacccgggggatgaaaattatcttctaatattgtagtaacatctgcaagatttcatcatgaacctttaccagggaggtaggggaagaagattggattcaaatgtcattgaaagaactgattaattcagtaaaaaaatgcagttagtcatcccagtgctgtgctaccaaaatggaaaatacctgggtagctgcattgatggtacatatggttgcattgaggaggaattgtatcatggaataaatataggcttcatatgatctctgtgcttctagacttgatacttcctttgcctcacataccttccccatcccccaaaccccaaaaatggttcttttagcaaactcctattcttactttaaatcttatgcagaattttctcagtgagaattttctcacaatctcctagtcagactgttatgttcttacctaatcgccgatgttctcatatagtcttctgtacctctttaataacaattaatcttttgagttataattatttgtttccatgtgagtctctctacgagctattaaagtgctctgatttttttttttacttttgttaatctcagtacctatcctaatatctgccacatagcaggagctcaattaatattgtttaaataaaagaacaaaaagaacaaagaaagctataaattcatttgccttcccaagaaatgtagtttgacttttgagttcagaaatatattggtctttgttgagctaagcagaactaaacctgttactttgaaatatgcaaacaacatttgaaggaaataacaaggttcctcagggattgtgagaacaatgtgctatttctcttgaggataagtggcttctgtaagtaaaaaaaaaaaaaaaggttttgcattatgagcgtttttctacattaaggaagtcctgtgaccaaacagagacaacccctgttgttcttctttggagcttgcattagtatagcagacacaggttactgctgatttcaataggtagggcttttcagggggactgtttgttctggcactctagtgaggctttttataatcagaaaccttaatttccaagatgaatcattgctgacggactgaaaaacaccacttctcccaactctggtttccagaattttgccctaagaaaaatgagttccacttcattttaatggaaagtaaatagcataaaattacttattgtatttaaagatcggccctttatttgatttttttttttgattcagtgaaagaattaggacagagagacaatgcaaggcaggcatttttgatcaaggatggacagctatggcaaattttttcctttaggtgtatcctctgaaggaaataaaatagaatgaaagaacaaactcagaacagttgttggatgaccagtgagcacagcatggtgtgaggaatagagcactggactcgttctctcattgttacagtcattcaatatttcatgaaagagaattcaaatgtttggagggtgatagcttttgtttttgaagagcatggctatgatataaattaatatgattacaatgtaaagtgatgagtattaagagggataaatacttaggtttgtcgttggtgggaagggaggcattcacaaaacccaagccagaactctacataggagttagattgataaagaaagggaaagaaaatagttcagaaacagagaaaatgtgcaaagatgaagaaaaaaggcaatgcaactgtcatgaaagtatttaatagttgagaccaactagattacagagggcaaatgattaggaggggtgagaaacaaggctgcaaatgcatacatggagctggactttgtgttgtttttcaggatttggctgtactctgacggcaaagcttaaatgcaatacagcagggacaagatcttgggatctaaattcaggacacagttctatgaccctgggaatcattcctgaggtttgtgtcttcaagtaaaatataaagatggtaacacgttcctggtctgtctttcaggataatccaaatataagatgttagtattagccagacaggttttacagaaggtaaatcttaacaagaacaaaaggtttgttcattagcttcatttagaaaggtaccagctactttcttgaaggttattaataacttattaatatatggtctttaaatactaatttagtggtagccttataatctaaaagtatcttttttgactaatgccaatcatttagctgtaccaaaattttcctctttaatatttgaaaataatatactgaccatcattctcttgcatatttattgctgattcattatttcaacaatgcctagtaatacatgaatggcttctgttaatagcattgtgtataatctcgaagaatacctggaaatttcaggtgtagagatgtgacaattattttcttcctcattctctgattacatatcctatatgttgtctttaataaagataccttgtgttttttgaaagatcagttccaagtggtcgggggtgatctctcttgatggctcacaccattttccagaagatacaggaaaaattaaagtgcatttgatgtgctgtgtttctataatcataaaactttaaatatttcttagagatttcctagtctagactctcattttgcagacaagaaagccaaggattagaaaggaaaaataggcaaacgtgagcattgtccattcgctcctttaaacaggaaccacacttatgatcatggtcttttgagatctggggtaagttaaagaacatgtaaattttattaattgagatgcttttcattgaaagcatcagaaaataacagaaaaatttaaataaattggctaaaagattaagaaattataatttcccaaactgaaaaagtcccttagtagaacacctccagggtcagttaaattgatgcccaaatatcatggcctagaacccagcctctttgtgtctttctgctttgtttttctcaaactaacttctgccatggtgattacatggtttcttcagttccataattggcctgcagacatgacaactgacaatgtccagtagacagagtggtttctttctttgagtttctttttaagaaaaagtaccccacaactcttgttggttagaactaaatcttgcaccaattccttatctaattgcttgatgatacacagggttgagtggagaaaatagaaaagtaggtgacacaagtaaatattggatcctgttgaaaaccatcagggagattggatggtttgaaggtagaaaaccaaaaatacataccacagagatcagcaaaatagattttagaatctgacagacatataagttgcaccacactgtgaaaaataggcaatgccatgatccaagcacattttcaacaaacgtgtattaatttaaaatataacattgtccccgattgcttcctttatagcagaggcttctttgatcacgtttgagcaaaagggcaggtagaaagaagtctcgtctcctttcatattaaatgactcagtttccaatcaattttcattgtgttttctttccttcatttcttttttctttgttaacatgtcattggactttcttctatttggggagcatgaaacaaaataatggtgatatccctcatcaaataattagggttctcagggtctatcacaattatgtcttctctgctacatctagggatttgaagttcttataccttcaggagcgttgttctcaaaccttcattgtaacacctgaatgccctcatggttaacaggagtaacatgaggattgtggttagatatgcaacagttgacactgtgatgactgggatgagcaagcactcacctaaagacataccagagcaaaacccattccccctccaaagaaataccttgatctttgacttttgtttgctatattcacaatcaaaaactgtatactaaatggcttcattttataaaagagccttttaaattgtgtgttctgatattttgtctatccatatgttaattcaacaaatgttagttggatatacaatagatattaagttgcacacatgaggagaccaaatgggatagcacacagagcctgtctttaaaaagcttacagtccgacatcttttctcttctctccttgcttgggatgaaggagaaaagcaaggaaaagtaagtcattgatgaccatagcgtatgaaaagtgtcatgacaatggcaagaaaaatgtgctctgagacagcatagaaggggctcctcaccccaactcgcagatgagtttggatctttgaactgaaacttgatgggcaagcaatagcagcttggtgaagaatcgggagagaaaagaatactccaaatggtgctatatgtgaaagtactcagataagggagggtaccaccactaccatccttgctgtcatcatcattattatttcatcactaccattgttaagtgcccaaaccatgatgcttttctaggtacttttatgagatatctctagttcctacagtgacttagtagtaattattgttcttattttatagatgaaaacattaacttgcccaatgtcacccagactgtaagaggtggagatcatacatgagttcagataagcttactacaaaactgagctgactgctcatgctttctgcctcctatttgagtgtctcctaactctcaggtttccgccagctctaaggaactagtttttgttacccaaggtcccctgctattttaagcctctcaattgaagtttcctgttttctctcatgagaatgcttcctgttccttattatctggctggtagttactgctcctcattcgggctgaattcacagggaatttgtctcatcttggaagatttctcaaccctttttttttccagcctcaggaagacgacttgctttgtccttccctccccctgcaaacaacatcacatttatgtctatgtatctttgttatcctatcccttcaccctctttcctaccctgtctaccttccactatatattgaatccaccgctagactgcaagctcctggaagccaaggcagcctctcatttgtcattgtgacttcagtgtctagcattattcttgacacggaatgaaggctcaaaaagaacttgctaaataaatgagtgagtgaaggccatccaatgtggggaatgctatgttactgctccagaatattctttcatagtattaatgtttcattttatttgatatataatcacatggcttttattccagaagacgatatcactatgagaaaggaagctaaatactttgttggttttttcaagggattttctttctattgtgtgtgtgtgtgtgtgtgtgtgtgtgtgtttgggggtggtggcatatgtatttaagacaataagttagaagagataagaggtgggttttaaaaacgtaaatacaggccaggtccaatggctcacgcctgtaatcccagcacttagggaggccaaggtggacgggttacctgatgtcaggagttccagacccacctggccaacatagtgaaaccctgtctctactaaaaatacaaaaattagccaggcgtggtgtctcacgcctgtagtcccagctacatgggaggctgaggcaggagaatcgcctgaacctgggatgcggaggtggcagtgagcagagatcatgccactgcacaccagcctgggtgacagttcaagactctgtctcaaaaaaaaaaaaaaatgtaaatacagctgtagttggcttattgctaacttatttcattggagtttggctgaaaaggtttaaagtgatttcaagtttggagaagttacttttttccataataagaagaaaatatcttctaggcacctactctgtgccagaaagtctcatacccacaaattcatttgtttttttttttttttaccattttcatgctcagtaaagtagtaaaaatcaacagctaaccagctgaccttcatctagccctctgtattcagtatttcttctaatatttccagataggcattattctcattttaccaaaaaattttaagggcttaattttttgaatgcaaaagaggtagaactgggcctactactcagtcgtgctttgactccttatgtcatggaggcaagcccgttgcatcacaccacatggcaatactgcttatgaaaatatctaacttaagggtacttccttctaaaatatacaggcacttgactatcccatcattatatgctgacaggtgggtcttttcaaagtctcacgttttcatggtcatcaccccgctcaagtccttatcatgtattactaatggagactgtaaggggaggcccacctggaaacatcagaactgggaactcagacctcagtgaggcaggagaaacaatagagaatccagaaagcgcatctaatgggaatactaagcaggacataacaccataaactaatttcaaaggatagcttagggtctgggagagatggactattgaggagtaaggacaagtttgcacaaatctggatgaccagtgattttaagtccatttggactagtgacttcttaacattagaggcccaggcagaggcatctgtagcaatcttggtctagccaggatcagggtaagaatattaacaatagcaaccatgtcagaaatatatatgggattcaagtatttgcaaaacattttagattttttttgtgttgaatgtcaaccacagtcctataagacacacatacttattatcaacaggatatgataacatgaagaaggaaatgtatgttgttgaataaaaatagcagtatataatgaagtatatatacactgtatagttttataaattgcaacacattttggaaaggcaactgcttaagagagtggttgtgattacacgtacaaaatatttcaggcatttaaagtactgggctgaatttttcccagtaattaaaatagggcataagaggcagcatatgttctagagatcactagagtacaataagccaagggcagatatgaagccagcataaagtggggaaatataggaacaaatatcctattacagtgtgtgtggtctattcctggacactgtggttatagagtccaagttctgctgccaatgccacaataagaaagccatggacaaatgtagaaaacagttaataaaagtgatgctatctatgcctgatctaactccatctagtgagaagtttcgagaaagagtttgagttgagtttgtggaatagattaagagtaagatcaaggaggatagacttggatatataaataaaaactgagttcattcttaatgttcaggagagaacagatcctgcgtctgttgtatcttacgcagactctgttggtcaatacaaataaactatatccatttggtttcacttgctctaacttgggatttctcaacctcagtgctattgacatgttgggccagaccactctttgctgtgggtctgtcactggcatcgtaggatgtctggcagcatccctggcctctaccagtcagtagccccttccccagctgtgacaatgaaaggcctccagacattgctagtgtcctctcgggagcagaattaaccactggcttacatggtagctgttgttgcaggtgaggaaactccgggactaggagtaggtctgggtcattctggtctcatggcttctgtgaattgggagccactgtagcagtctatttttgggcctttctgaaactgaggatggttgagccacccaaagaacactcagaggatgcagcatttgtcaatcaggatttacagatggaggaatctgggcggagagttagtagtctgcccccaaatcacatggaagaactgatatttatacccctgggataacattctataccctgtctcttttctctataacaagtgatttttattttatgctttgcaaagccccaacacttaggtattgagtgagaggcaaagcaggaaggacgctcctgcatttctgctcctatccctgctcctgtcttggccaaagtagcacagctatcaccattccatgctgaggatggttagtgttccttttaaaatagtaacaaataatgttctctgaattattcctctatgcctgcttggaacagaagacagaccagtgttaacccagaaagcaacacaacaatattccttatgtgctgtcggaactctcttttcaagggtaaggcaggctgaggctgcagggtaaatctgaaaatcaacaaggtagaaagatacagagactgactcaaaaagaccatttcatcatccattcctggtctctttccagaacagtcatcttcttgcctccatatttcagtcttccaggctatcctgtgctattctgccagagtttctttcctggcaaagccttaacaaatagtaccccgttcttgagaatctgaattctcatcctgatagcatcttgcttggcaatcttcaaattctatattaatctaggaacttctcactctaccctttttcataaaataggaaatcatctcagggtgggagaatcacaacttgaccactcatctctcccctatttgcctgtcatgaaatctaagattctgcattttgagactgatttttttttaaataaagaggttgactgctctagttattttcttaaaagcagatgaacttgaaaattttgacatatgtatattttgtcagccaaaggcataccatctatttcaggaggcaatattatatccttgctaacaatgtgcgctttggaatcgaactgcctcaattcatattccagcttgccgcttttagcaatattatctgaggcaagttttcaaaatcatctgaaccttcttttctcatctgttagataggataataatgttctctatgttacagttatagcaattaaatgacatgatacatgcaaagtatttttaaaaataataaataatagccatcttcattattattactactttttttgaggagtcattgataaaagcaaatgcactattgaagagatcattaataaaagtcaatacaatgttgaaggtcatcttgtccagtttcacaatcatctctgagttattgggaaatgtgttataatgaatagatcaacaaaaatataactacagtaaggcaaaataatatgaaatgaattacaaagactaaatcactctgataagattgattgtcttctgactgatattttactatattcctaacatgggtctgagaaagaggagaataatataggcaaattgctacaatcatcaattaagtaaatttctaaaaatgttaaggaatgtataacacaaaacgagctaaagaattgtttgcagaatgagtgttgaagatattgggtttgtcatggttgccgttccctatatcatgctgttcttaccgttgctgtgaccttcttctcttgttcagcaggacattgacatgcagcatgtaacatgtactactagaagatgtaaccagtgatctggctcttatgccaggacagattttgttctagggtcctaaattggtactaccttcatcactgattatatcagtcagtggtccatgctattaatacaagcagcatgacaatcttaggggtaagaaacatgttacagtttagaaagatctgtacaaggtctacttacagagactggtgtcaaaaatttttatgagacttgggaaaatcatatatattttttcctttcctcttccctgggttttccttattccttaatacatgcaaagctgatggggtcagtttgggatctcgaagggaattatcccctctgtattacaagaggcctcatggtgagctatgctttgttcaaaaaggatgaaagcaatttaaattaaataacaatggataatcatctagtttattgtaaggtattgccacttgaatactacagttttactatggaatctttgtttcaatagttgttttttattttatatgtgacttactacaagaacttactctgttattttaatgtagctatgtttttaatatttcttgagtagtagtaaagagggttatgtcctgttatcatggtgacttacccctgccatccattcctggggaacttgcttggctgctatggtccgtgtggtgacaggttattccttggtagacatgaagtgcagagggtacagtgacattaaagaccttttcattacctgaaatcttcttacaaaccatctaccaaggtatgttagaccaagaaaaatgtcttctattttcttctacagattataaccagcaatacgctgagatgataatggggctggatatgaaaataaatagagtactttactttctgaaaatcattccatagcaaccgaatgcatttgggatgatatctatctatctatctatctatctatctatctatctatctatctatctatctattctaagagcatatgtttgtgttcaaatgtctgcttttctaaaaaagtatttttggaaactgacatataaaatgatcagtactagtaatgctcaatcctttcttgtgttttggtatagtactgactttttataatctatagacattttgcatataatttcagattagctgatatagctagggtttaattacaattacttcctagagaaaaagctcctttgtctgaacggtgataattctgagtatatgatttagatgtgcctattataactgggtgattgaaaaaaactactgagtaaattcacaatttaaacaggatgacacaaggtgtacatttaacttatttatgacacaaattttttcaagcctccattttatggaaaatatagaatactgtgtgttacttttatttattcattataggactattttcttttgggtccttctttacctactgtaagctttgtagcttagtttgcgttactttctgtatataaactaataaagaggcatatttttcaatagacatgagcctttcactaattcagaatgcctatttctttcattaggacaaattagagattatgtttttctctgaacaaaatgcatttttatgtcaattaaatgagagtttttgatgaaatgtttcctaacagagagtaagtaattgtgatataattgtttgtagatgaaaaataactgccacattcatggcaaatgtgagtttaatgcagatgattttcatgactatgatgtgttttatgcggctttttatacccactgttttggaagcattcatagtaccagttaaggcaaaaccagcttaatgtttgttttagtgcttggcaacaaatacagtctataaaatatgtagtagttaatattaaaagcacatgccagattgtaacataaagagtttattcaatctctttaaagtcatcaatttgaagcttcatctgaatgagttagcatttgagttccatatgattttcagcaggtgagatcttgtgaagttaggaattggctacccctgcgagcccccattggcacagcccccagtttcttaatgagcttgcctcattgctgagtgagcaaaacactcttaacaatgttccttttgagccatctttgttgcagggggaaataaagagaggcgccaagcctgcaaattctttcctgatcccattggttcaccaggagagaacaattttgttttccatggttgcggtctttcaaggttgcctttacttaggatttgattacctgtctccctcaaccaattagcctctcccacacactctcttgcctccaataatgatcaacctccttttctaagaccagcctcctctttatcatattgcattaaacacttgatgaaagaagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtaattttctttattaaaaaatacacattaaagtcttagaatagtttgatatttaccgacaagttgcgaagattttacagagccgtatataccaccctattgctaatattttacactactatagtacatttgtcacaatgaggaataaacgttgtggcacattactattaactaaactccatactttatttaactttattacttttcccctaacctcctgttccaggatcccctctaacacatgacatttagtcattatttctccttagccttctctgaactgtgacaatttttcagactttcttttcgacaaccttggcagttttgagaagtactggtccctgattttgtaggatgtgactcaagtcgattttgtctgatgtttttctcataattagactggggttatgggctttggggaggaaaacttcagaagggatatactattcaattcatatcctaacaagggtctatgctatcaacgtgacttatcactgatgctgttaacctagctcacttggctaagacagtgtttcaggtgtctccactataaaacgctcttccccctgcttcgcacaccatactctctggcagcaatagttggcaccgcctacccttacgtggtggggaattattctctatctccttgagacagggcaagtatcaacataaattatttaaaattcttctattcggatatctgtctcttcctcttctcccaccccctgttgactttattcaatcacatatttattcaatcacttagctcctgcatacttttagcctacacctatcatttttgttttgtaagcatttccttactttctgataccatcataagctccaggatgatcttgtatattccctgccttggccctagaatcagcaatttccccgaggactctggtttctttcattggagaatggtttttgaaaccaagatcttggtgctgggtgtgctggtcactacaggggattcatcgcttctaggccctctcagtggacagagctaggaaatctatatgtgcatactaacccatgtatgtatacatatctataattatttcaatagccatccatctgtgtccatattaaatatttaagcatgagttcacaatgatgtttcctactctagtactgtaccacatggatcattctagtcttcctcctttgcttgtctgtaacctcccatttgaaaactgagaaaattggatctaactcttattggttcatttacttactttttccatccaggtatacatacatgaagagtggcttcaggactggtaagttatgttcctttgaaaaatagctttaccaactagaggacagtgctcatgtgcagttcctttgcccttttatcttctactttccaataatttccaaagttacttaggtcaacagtctttaacccaccctcttcagtgaagttatgttatatacttagcatacagttacatctttttgtcgaagtgtgcatttcatcccaggatctcttaatctactagttattttaaatttgcctatgttaaatttattctctgctctgtaaagttctatgaattttgacaaatacacagtgtcatatattcatcactatggtactgtgtggaatactctcgccaccctaaaagaatctcctgtgcttcacctagtcaactgtctccctccccaaaccccttcaaatctctgatcagttttctgtccatgtatttctgccttttccagaatgtcgtgtgaataagatcatagattatgttgccttttcagataggctttttttcatttagtaatatgcatttaagattcatccacattgtagcatggattaatagctcattctactttattgctaagtaatattatctgtggatgtgtccgtttgtttatccattcaccttctggagaactcggttgctttcagttttgggtgattataaataaaacttctagaaacattcaggtgcaggtttttgtgtggacataaattcaagtcaattgggtaaatacctaaaattgcaacttatgggggatatggtaagtctaaactgtctttcgaagtggctataccattttgcattctgaccagcagtgtgcttcaccagcagtatggatattgtctttttatttttttaagatttcagtcattctaataggcacgtaatggtatcttcttgttttaatttgcagttctctaatgacaaataatgctgagtatctctttatatacttatttgctacctgtatatcttctttggtggggagtctgttcagttattttgcccatttttaactgggttatttattttcttattgttgatttgtaagaggttttctaaagaaatatttcagatacatatcgtttattagatatggttgttgaaaatattttctcctagtctgtggcttatcttttcattttcttaacagtgtccttcacagaacaaaggtttttaattttttattgtatttctatcctctttttgtccatggttatatcctctactatacagagctgttccacttactgttagagcaaatcgtattaatttctgttgccctaaataattgtccattggccgagagctgtggctcatgcctgtagtcccagctacttgtgagtctgaggcgggagaatcgcttgaacccaggaggcagagattgacgtgagccgagatcgtgccactgcactccaccctggatgacagagtgagactccatctcaaaaaaataataaataataaataaataattatccattatattgtattgaaaagagctgctatatatggcatgataccactcattatgttagttttccccgttctccataaaatgaccactgtgtctgtcagagttgtcacacagaagtctctaaccatcttaacacctgagcatgcccaggactggaggggaactattgcgttctgtatagagtacaacaatcatgggcgttggactcagagacctcggttcagattttgctcttaacatttcctggttgtgtgaacgtagaaaagtaacttaagttttctgaactttggccttctcacctataaaatgaagataatatcgtccacgtgtcttaggtgctattagaaggacacatacgaagtgtttagcacagggcctgacggagtgtagcactcagtaaatgttagtgcttacttgcttttcccccttgtgctccacattttctttcagcctcctgatttttcccagtggaactctttaccttgcatccatcatttctattgcaatgcatttctatgccttttcgaggagcttttctattccatctacactgaaaatggctcatcctattgatacaatttccctgctcccagccaatggctgctgcagcacttcctgatatctagatcacaaagtccctgaacaggttagggtagcacatgttaaaaaaacaatattcctgcaagttcacctttctcttacttctcatttccaacctaagatcttttcaatgagcttactctgattgaatataaaaacaatttttaaataattcaacctaaaataatagaagtattttttgcttttattatttgtaattaagttataataattgtacacatttatggagcacagtgtgatattctgatacatgtatgcaatgtgtaatgatcaaatcagagtaattagcgtctccatcacttcaaacatttgccatttctttgagttgggaacattcaaaatctgtttttctaggcatttgaaaacatacaagaaatgttgttaattatagtcacctacagtggtatagaatgttaaaatgtattcctttcatctagctgtgcgttgtgttgttaaccaacctttggctgtgcttccccccacccctacctgcctctggaatcactattccactctctacttctgtgagataaacttggaaagaaataatactattaggatgataatttcccacaaattcatctataaatttattgcaattctaattaaaaatcccatatgatttattatggacctgtcatactaaaacttgtttgggagagaatatgctggagaattgccaagaaatgtatcagaacattctataaagccacaataactaaggcaatctgatattgacaatgtgtattttatcaatggaaaataataacataaacatatatgtatttatgtggtttgttcatatatatgtattgtgtatgcatagttgtgtgtatatatagtatttatatgcatatatttaagcataacaattcaaatcatcatggaaaggatggaccatagcaaagggtctttattacacaatagttgtgagcactggccctggcaccagactgcttgctttgaatctcgactctgtttccgggatttgaatctgtcagagctatgtgaccttaggcaggttgtttaatttcttggagcatggcctcagctttcttttgtgctgaataagaaaataatagtacctaactccaaaagtacttagaagggttaaatgaattaatgtaggtaaggagcatagaataggtgctggcactaagcaccagcgaatgtgaaccattcttattattatcatccataatatagaacgtaagcaattgtctgttcgctttgaaaagtaacccttggcagggcgcgatggctcatgcctgtaatcccagcactttgggaggctgaggtgggtgggtcgcttgaggtcaagagttcaagaccaacatggccaacatgatgaaactgcatctctactaaaaatatagaaaactattagctgggcatggtggcagatgcctatagtcccagctactccggaagcacaaaaattgcttgaacccggaaggcggaagtcacagtgagcaagatagagccactgcctcccagggcgagagaggaagactccatatccaaaaaaaaaaaaaaaggaaacctttagtgactagtttagagccctacactgacaggtgcctatccagttgctgatttcttgtgatgtggatttatttttacttcataaaataaagaggcaaccttacactttgttattaaaatagtaagtggtaaggaaccctttaagggatatggttttaacatattattcaaaataggaattgcaaactcaattgcttagagaggtcagcaagtaaatcaatgtactagactgggtagagcgtgtggtgaaatgaaggccttctagacgcttaagaagacaaccagttttcaacaccacccaattattgccaggcagaaacatgcgtgcacattttttaagatttttattttcatgcaatattttctggcttctaaatgttgacaacaaattcaaagtttgaagcattgtgtggatcaaacaaaatagatgtctagagatcagagttggttcatattgtttgttgcaatctgagacttagaacctcctttaggttacactacccagtctttctcccaacctgtgtaccccaattgtaccttgcacagtgctgcccaggtgataaggaatcaatgcttgttttttgttgaattaacttgattttaattctgaatctttctgattccaatcaatgctttgaattaataatactagctcctggccaggcacggcggctcacgcttgtaatcccagcactttaggaggtttaggtgggtggatagcttgagcccagaatttgagaccagccttggcaacacagagagaccccatctctacaaaacaaaacaaaacaaaacaccacaaaaaaacattagccaggcatggtggtgaagtgctgtagtcccagctacttgagacgctgaggtgggagaatcacatgagcccgggaaggttgaggtagcagtgagctgtgattgcagccactgcacttcagttggtgccacagagtgatacaccatcttagtaataataataatggtaatagtaataaaagtgatagctccctctgttagccatttattttaaatatcaggtgctggtagggtctttacacatatccctctgatcattacaatactccgtaaaggttgcttttctcactttatagatgggaaaactaagaggttcagttacctttctaaggtccaaggctagtagaattagtgatatgacattgtctaggtctgcctttttgagggagtgagatgtcaaaagtagtagcaagaggtccagatccctctagggtgtagtgtttcctggcatcagctaactgggaatactgatcacgtcttgtcctggaaacacatttcattggatgaccttgtcaggcttacaatgcaaaaaaaaaaaaaaaaaaaaaaaattacaggataaaagatgaaagatgtcttccacttacaaatggcaagcgatagctatccaaaggttcatttgtaaatcagttgtttgaaactcggaattcattttcctgcagaaacagttacaaatggtggttatgtttcccctgaggctcatccacaaaagaccatttagccttaatgtatctgaaatagtgtacatttgctgtgaaaatgtgtagaaaatagaactcttgtaattctagtaattaaataaaagaaaaagtaaaattgaatgagaactttaaactgcatcttgaatgctgcttcgaaagaaaagcagatttacccagaagaggatgcagaactttgaaaataattttgtggggattttaaagggggcttctgaatactttcacagcacttgagaagttaatgaaatcatatcattgaaatatcgcatttcatttcgtgatttctagatttttaacataatctttccatgattaatgctatttctagtgttctctttagaacaagaagaagaagggaaaaaagggtggaaaaggaaaagacaaatgaaaatgggcttcctaatgatgcagaagttgacagagatagcatgtgaaagaaaattaaagatcatgtttgtttttcgataggcatgcaagaagcaaaattagccatgaattatgaacagtggaaggaggaaaacatagattctgatttcacttgagagagacaaaacaatgctggtggcagagatcttttctctgagaaattccagaaactgttactgttttattccatcatcttagggcatcatacttcatggcaaatgtaggatgggtacaggattgagatcaagagtgcaaaagttgctcaaatggactaaatgttgagaatactaagtacttattaaacaagagaggatttgttctcaaacaaaagtaattatcattttttattgtctaggttttatcattcatcttgtttaaccttcagccaggagaatgaaagacagaagtttttaaaaaatatatatatattgtgggcggggtgtggtggctcatgcctgtaatcccagcattttgggaggtggaggcaggcagataaccatacaggagtttcagaccaggttggccaacatggcaaaaccccgtgtctactaaaaatacaaaaattagctgggagtggtggtgcatgcctgtaatcctagctagtcaggaggctgaggcaggagaatgccttgaacccaggaggccaaggttgcagtgagctgagattgcaccactgcactccagcctgggtgacagagtgagactccatctcaaaaaaaacaaaaataccaaatatatgtatattgaatggccaaatggttgaacaggaaattgaggaagaatgaacaacctcccagacacttccacagtgagtttgcaaggagcctaaaagctagctgcacagagcagaggcccttcctgccaaatgtaaccttctttagaaatagagaagagaaagacagttgggggacaggggttattatggatacaggacaaaaacaaaccagggtaaagaaaccaaaaaccaacaaggccaaaccaatggacaccttgaggtgatgtgggcagacacagagtgtttccctttgttgttctttggagagtaagataggcttccaccacggaccctcttgtcaataaatcttcctgggttaagtggttagttagactaaattgctcttccaccaatttgagctgacagcagcacagaaccgtcaaaaccattgctgtgttgtctccatagccaaagagtgttgttgatttatttctgttagaggaaaattttaacttgcctacctttattttttttaatcatttgaatttaagacactagttcccagtaggattcactatgacaattttcagtgatgagaaaaagcatcaagggtttctggtctctgaagaattgtgttctttttggccaataaaattaaaatgaaatagatttaaattgtattaattcctaatttaaagctgaagtttcaagtcaccttccattactattgtataggatttctacataaacctattgggacctgagacaggctaagccttactaaatttcctggctacagggatatttcttttggggattggagatgagaaggggtaatatcgacaatctcattttctccttaatttttccttgattgaactggtgtccatttgcttaacttattcactgtgtgttatagaaatttacaagttactttgcaagtgtagctatattcatgtatgtgctatcttttctttcttcaattaaattgtgagctcttttaagtaaggaattatattttatcttctcccacaatgaccaaagccagagtatcttacttaagacacttgaaagtggaatacaaaaagtattttcatgcagtccatactgccttgtttgctaattgctgtacacatgcagacatcatctcaccaactatgccctaagcacctcattggtggagtcttgttttgaggtagtggttgtaacagtttgggtcttttattagtgcattgtagggacagagtagcctctcaacaaatagttgtttgttaaatagtcaagtttggagggcagtagatgagacaaagtagaaaatgagagcttttgcattaaactatgacaactaaaatctatatttaaagtttacaacctaactgtatgttctttttagtacataccacatcattaaaacttgataaataatgtttcctcaatactgttacttaataagtaataaaaatatgatgctggcaataaaagctgttatattgttactgccttacctcctggttggtgagcaaatgctagaaagaaaaaatgggaaatagtttaaatttgagagttttggatcattttcttggcaaagtcaagagaccatttgcttcttttaagcagtctaaaaggtgtcaaaggattagaagcaaaggaaatatcagcattgctgtgctgttagacagattcctagagaatcaaatagggatggtaacaagattgagcaacccatctccttagaattttgcttccctttacaccgacaacctccctattttatttttaattacccatagaaataaacaggaatgctaaaatattttttgaagataaattctataatcatttcaagtttgattgttgataaatatgatatggatgaatataaagagtagattttcaatatgaaaaaagagtctcctaaaatgacgtgggttgtaaattggagatgaatttcttattagttttagtgccttttgtgtctcctattgtcaacttaaatggtctcacacaacacatctgttgctaggctcatgagatggagcagagttcaacaggtacatttcaaggccaggaaggctgataaactgaaggttcagtaggtaagagaagcactagaaacataatgatcagtgaaatttagtactatcaagaggctagaaatccggttagaaaacaaaccacaggattggtaggatctgaaagttgtcacagcttcaacagtcagtattgccaaagaaaataaaatggggcactttttaaaagcagtaaacttcgatttcactcaggaataactattgcaatgtgggagagacctcagcataacagctcagtccaacgaaaggcaggagactgtttaaatgctggggtgtacccaaagaaaggcattaagggagagattggtccatgtgattaggctatctgggtttgctaactagtgttcacctagaggagcaaacttctcatatctttttgacagaaattagtggtgcaagttggagcaaggcatccactgaagttaggtccttactgtcctacagggactgggaatgagaactattgccttgaatgtttgtatttcaaggagatggctctcatgtccttgaggagccacttctggatggtaaaagatttatttcaatgggggcagagaaaggatttataattgcaagctttctaaaataagtgctttaagagggattcaagggcctattggcctatcaccaggttttggctggaacaaacagtaaattctcctggcagcattgagctttctcagaaagtcattttaaggggggttagtgcgagaaagactgaaaaagaagtagtcccagaactgttctcaccttcgatgcaggctgcgtctcagcctaatatttgtcctgatattattatctcaggggactcacagtcaggaagagttggtaaagaggttgtcagactttaatctcccccaacttctagtaacttaccagaagatgccacaaagtttagtggtgatggagacccctctagctagaagaaacttttggtatttgtttttattctatttgtgatgtgttctagcattgtgaaatgaggcaaaaagaaatgctgaagctggttcacagaagtaagttggtgtaaaatcctatgtggtccaggtttatctcaacaatacaatctcctcatgccgttctaccttagccaatctcctcccatcaccatagcaaccacatcttataatatgtgattccaacttagagtgcctcatcactgccctttgtacatgcagattgggaaagatggaagagactgttcttgggaatagcacacagcaatctgggccaaatctgggtggtgtgtgccccactatttgccaagcttattatcattttttttctcctttggccttattcaactagaagtcctctgcatctactagaattcactacatatatagccccaatcttctttcttttatctctggcagtgaacaatagaaggcatttaagagcatgaaaaaataaataataagtgcagtatgaggtgtatggtagccattgctattaaaattactcattcacttttctatgatgaatgaaactctagtgataaataataatggtgcccctgaaaaaattaggtttgcaattaggacaatttctgccttgtagacaaactgcctaatattatgcttcaagacagttatttaccatagttataacccaatgtgtcctgctgaaatggcttgtttttcctacaatgttaaagatttaattttttgaagatcagtttgtttgaaacagcagctgtacttttaggaacataacctgaagaaatgtagatgtagatgtaggttaaagtgagttcatcacaggcaatcgaagatgtagtttaaagatgtagaattgttgatagtagtaaaaattgtgaacagtcccagatattgaaccttagaggactcatgaagttacataaggtaaacacgtgcaatagatacaatgtaacctttaaattgatggtaactgtataatatttttgaaatggaaagatttttatgatacatttttagtgaaagaagtagcttgcaagtaatgtaaacactgacatttagttattaaaagatacatatacatatttgtatatatttatacttacatacatacatacatacatacacacacttatatacatttggctaaacaaaagcttaaaagaatgatttgtaattttgtgaatgcttttgttatttttcgttgttgtttttctgagatagagtctctctctgtcgcccaggctggagtgcagtggcacaatctcggctcactgcaacctccgcctcccaggttcaagctattctcccgcctcagcctcccgagtagctgggattacaggcgtgcaccaccaggcccggctaatattttatatcttcagtagagatagtttgcaccatgttagacagtctggtctcaaactccttacctagtgatccacccgccttggcctcccaaagtgctgggactgtaggcatgagccattgcgcccagccgcttttgctatttgataattattttcctaataaaatcctatactaatggtgtaacaaccaaaataaaaaagaatgaggaacgtaaaattgcagtttgcttttcttattcattatgtcaacaaaaccttagccaaccacactggcccttcttctttttcctggccaagtcaaccctattcctatgaatgataactggagaaaatgtgcccagtgtggggaacaaggatatgttggtgtatacctaccatggtatctttctcaggggactgagtaaatacagggctctgtgcaacacaggaagaattcttaaggggcacctcaaattccaaaattcagatcctttaaagagagagggaaaatcagtactgccctctgacttggagtgagaatataccctgctgtgaagggaagaaggtcatcctaaggtgggaaaaactaaaggtaagtactgtacatatgtctgggacacaactttgaccttgggggagaaacacacccattactgagtagctttgtcctccacttataaggcattggatagatgttcaaaatggggagctgtacctatgaaacttttgaaagtcatggtaggggctatattccagaagggctgcaaaccctaagagatgggtcatctgcattctgagccttgacagtgaactgaaagagtggtcaccctctgaggaacctggaggccttgccatgcatggcgcaggggcttctgtgcatcagctatttgttcttgaagcaatctggtcagcttgaagaatctgaatatcatagagggagaaaggcttctatagagcattaaagcttgtgacctgaattcccaatgtatgcatttgttggtttatcctgaagaagagaacttaaataagatcatccgcacggcacagtttacacacaagcatgttatttttctgttttctctgttgcactcccagatttttaaaaaacacttaccatgatatccttcaggactcacctttcctggcacagaggtttttataataaatagtaatggaatgaatgagtgagggtgctatataatatttaccgatatcctacttttatatatcaggcctcatattatggtgcagggcagcacaatttatacccagttgttattgccatttatattcaaaagtatcaagctttgtcattttgcaaaaatgcttttcagtcttggaatttttatttatttagactggttttctctctctctctgcccctctctctctgtctctgttcttctcttttctcccaggtctaatgtatcagaatcacctgggatgattgttaaaaatgcagaattcagggatccagtgcccagtcataatctctagggctgggatctgaatattaacattttttaaagactgcagctcattctcatggacactaaattttgagaaccatttgtagttaatctatttaaagaatcacagttttatacatcgtccgtctgaaaatgcaaggtatcacctagaaacttttaagacaacttttcctctcctaggaactgtaaaataacaaagtagacaagtggagagtaagggtgatagaggtgggtggatcaataggaactctctttcctgtgagggtaacttgatagtgactaggcggtgcagttggagtgaattgattttgttcaaacaagttttcctgtttctcagagttcacagtgaacatttttttgcaggcttcttgcagtgtgctgtttcacaaaccatcagaggcatttagaagggccagggtttttcttctaaggcttaagaactttaaatctcttgggtggaagtagttttcagtgacttgtttgttcttgtgatataagacatagtaccactaaccccttgaatctatcattcctacttattgctttaaagccaggatagtatcaagttcttgatgtactttactaatcatggctttcattttctaatgtgtatttaatggatatctattcatttatcattcttaagtacagaacactaaagaaagcatactgtaatcagagatgttatcaggctcaattattttagattaactgggtattgttatgacaatactctgtgatatccctatcttcaagtacaaagtaggcaaggaaaaaaatgcacatcaaataaaaagtagttggcaaaactaccttttgatccattttctctctattagaaatatgaatggctctcaaatgttttacaaagattgtacattggacaccaatgaagctgttcaacactaaggcccaaaaaagaaacaaaaaaatatggtggctctttttgagaaacaatgaatttcatgtctttctagtaaaacacactataaaatagttcttcttgtgtttacatttatataatcattgaatcatatgccacagtcctggaaagttcaaacaggaaatagtgcgtatgtgtgagtggggagctactctgtgggactggtgatggcttggtggatattatttttcttttttaatcaaagtttagcaatcatacagaaatatgtaggcaattaccaaactcagtgaaatgtacacagatacccatgcctgtatagtcagcacccagctaaagaaacagaacatgaaaagcaccccagaaaactatccttatgctccctttcaggaactaattcttaaaaccattgtcttgacttctgacatcatagattagtttgcccttaagttctttataaaaattgattctttttttttttgagtcagagtttcactctgttgcccaggctggagtgcagtggcatgatttcggctcactgcaccctctgcctccccagcttcaagcaattctactgcttcagcttcccaagtagctgggattataggtgcgcaccaccacactggctaatttttgtatttttagtagaggcatggtttcaccatgttggacaggcaggtcttgaactcctgacctcaaatgatccaaggccaaggactcccaaagtgctgggattacaggtgtgagccactgcacccagccaaaaatggattcttatatgcactcttttgtgactggcttctttgcaacatgtttgtgagatccatacgtacttttgggtgtacttgtggtttgtttattcccattgcagtatattattgaattttatgaaatactacatatatatttatacacacacatatatacacatatatgtatatatgaaatactgcatatatatttatgcacacatatacacatacatacacatatacatacgtatatacacatttatgtgtgtgtatatatgtatatatatatatgtatattggaggccttggccttggatcatttgaggtcaggagttcaagacctgcctggccaacatggtgaaaccatgcctctactaaaaatacaaaaattagccagtgtggtggtgcgcacctgtaatcccagatactcgggaggctgaggcagtagagtatgtgtgtgtgtatatatatatatacatatatacacatacatatatgtacataaacatgtatgggtatatttatacatacatatgtatatatgtatatgcacatatacatacatatgtgtgtatatatgtatgtacataaatatatgcatgtataaatatatgtatatatgtacatatatgtgtatatatgtacatatgtgtatatatgtacatatatgtgtatatatgtacatatgtgtatatatgtacatatatgtgtgtatatgtatatatgtgtatatatgtacatatatgtgtatatatgtatgtatttctattgatgatagattattgagtaacatctaaatttaggcagctaaaaatactgctgctactcaattcatttcatacagctaatattaccctgaaaacaaaaccacacagacagtataaaaaagctacggataaatacttcttatgacctaaattttcaacaatatgttagcaaattgaataaaaatgtataagaagaattatacagtgtgatcaagtgagatttattccaggtatgaaaagctggcttaacattcaaaaatcaatgcaattcctcttatcaacagggtagggtaggaaaaaatagaagattatatcagtttacctagaaaaataatttaacagaatctgatatttatttactgcaaacatgcaccacaagttaagaatagagagaaatttccttaacttgacaaaaagcatctacaaaaaacctaaaattaacatcttagatgatgaaagactcattattttcctcctaaggtttgtaataaagcaagaatgtattctcaccattcttattggatgcagcattggaagttctagccattgctacaaggaaaaaataaataaggaaggaaggaaggaatgaaggatgaaaggagaaggcatacaaattgtaaagaaaattatctccatttacaaatttcataattacatagaaaatctggagagatctacaaaaaaacttacataacaagtggatgagttcaaaaaatcataggatgcaagatcagcatgcaaaattttattttttataccaactgtgaacatacaacaatcaaaatttgaaataccatgcaagctaaaatttttccaaagaaattgcaatctatttgtgtatacttaataaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattccatgttcatggattgagaagctcaaaatagggaagatgtcaattattcccaagtttctgttttgttttgtttttacacatagacaagcttattctcaaatttatatagaaaggcataaatcttgaattagctaaaaccatcttgaaaaagaaaaatgaaatatgaggaatcattctacctgttttaaggcttactgtataactacaaaaataaaattattgtggtattgatagagagatacatagatcaatgaaaaaatgaaaaaaaaacagaactattcaaatatgccaaactgattgttgataaaggtgcaaatgtagttcaatgtagaaaagatagccttttcaacaaatggttttgcagagatatagaccaatggatcagaacagagccctcagaaataatgccgcatatctacaactatctgatctttgacacacctgacaaaaacaagcaatggggaaaggattccctatttaataaatggtgctgggaaaactggctagccatatatagaaagctgaaactgaaccccttccttacaccttatacaaaagttaattcaagatggttaaagacttaaatgttagacccaaaaccatcaaaaccctagaagaaaacctaggcaataccattcaggacataggcatgggcaaggacttcatgtctaaaacaccaaaagcaatggcaacaaaagccaaaattgacaaatgggatctaattaaactaaagagcttatgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaactccatcaaaaagtgggcgaaggatatgaacagacatttctcaagacatttatgcagccaaaacacaaatgaaagaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactgtaaactagttcaacccttgtggaagtcagtgtggtgattcctcagggatctagaactagaaataccatttgacccagccatcccgttactgggtatatacccaaaggattataaatcatgctactataaagacacatgcacacgtatgtttattgtggtagtattcacaatagcaaagacttggaaccgacccaaatgtccaacaatgatagactggattaagaaaatgtgacacacatacaccatggaatactatgcagccataaaaaaaggatgagttcatgtcctttgtaggaacatggatgaagctggaaaccatcattctcagcaaactatcgcaaggacaaaaaaccaaacaccacatgttctcactcataggtgggaattgagcaaagagaacacatggacacaggaaggggaacatcacacaccggggactgttgtggggtggggggaggggggagggatagcattgggagatatacctaatgttaaatgacgagttaatgggtgcagcacaccaacatggcacatgtatacatacgtaacaaaccttcacgttgtgcacatgtaccctagaacttaaagtataataataataataaaaagtacaccccccaaaaaacaaaaaaaacaaaaagttttgcagcaagtggacatctatagacaaaaaaggagcctctacttaaacttcttactgtttataaaaatcaacttaaaatgaataatgaacttacatataaaacatataaagcagttaggggaaaaaaaaacaggagaaaatcttcaagatttaccatgagacaaatggtttttagatttgacaccgaaagcatgatccaaaaaaggaacaaatgagaaatgtactacatcaaactaaaaaaaaagtagtagaagtatttgcaaactacgtattcaatgaaggactagtgtctagtatatacatagagctctctaacctcaaaggaaaaagaaaacttcaaatgaacagaagacataaagaaatatttcacccaggactatatacagataacaaataaataaatgaaaaaatctttaacatcattagctattagttaaatgcaaattaaaaccacaataaaatatcatgatacccctatcacaaagcctaaaataaaaatagagacaacaccaaatgctaacaagaatgttgagaaatggaatcattcatagattgataatcaaaatgttaagaggtacagccaccatataactagcaattgtactctttggcatttatcccagagaaatcaaaactcatgttcacacaaaaacctgtacacaatagctttacttaaataattgtggtataaacttatcatggaatactattcaacaatggaaagagatggacaagcaacaacttagatgagtcttcagagaattattctgagtgaaataagccaacccaaaaggttactgtattagtccgttttcacactgctataaagatactacctgagactgggtaatttatttaaaagaaggaggtccaattgattctcagttctgtatagctgagagacccctggaaacttataatcaggcagaaggcaaaggggaagcaagcatgttcttcacaaggagagagagagagagagaagaaggagaagagaggagaagggagaaggaggagaaggaagagaaagagaagaaggagaagagaggaggagaggagagagagagagaggagagaaagaaagagagagagagagaaagagaaagacaacctaggggaaactgccacttttaaaccaccagatctcatgagaactctagcatgagaacagcatggcatgatccagtcacctcccaccaggtcccttcctcaatatgtggagattacaatttgggatgatatttgggtgagaacacagaaccaaaccatattagttacagactgtataattccattaatataacatttaaaaaatgccaatgttttagaaatggagaacacattagagcttgctaggggttagctgtgggggacagagaaagtgaatgtggtgatagaagccttttattatatggaattgattgaatctatttttgcctatttattaaaacatcataaagatagaatgttttgagctatatgccttgtaaattccatcttaagtggaaataacaattatgagaatcaaacgtatcagttatctattgctaagtaaccaccttaaatcttggttgcttaaaacagacatcgtttattactttccgtaagcaaaagtcagtcgggtggttctgatctggaccaaagtcagcagattttggctgggttcatttacatctgcagtcatatttaaacagaggtagactgaagataaaagtatgtcaagaaaagaacacaaaacagccaacagtaattttagtcagattttcttttatggaaaagtcttgtttattgctatttcttttcttgttgacaagcttcagatagagactcttcagctttattttgtcagagattgcttattagccaatgcgtatcttgtactttatatgattactgataaatgtcttgttgagttgtatttgaagtcctggaaaaataaacctcttgctcagtcacctggatccacaataacttcagtcaccaagttcactccttgagtaagcaaagtctccacaacatctgcatatttgtggccacacaagattgattattttaatttagtctgacaacttagcaagtgtaaacaagttaatgaaacaaattattgtgcctatgggtcagttaaacaatgtttggactcgtttttccattttctcaagtagctgtttagtaaacgtgacccaggagttgaataaatgatgtaaatgatatcttaacagaattggttgaatattttgttgtcaccagagccagtcaaaaccccaaaataattaactggaaattagtaagaccctctgacagggccagtatcagtttacttttttttttctcaatattcttcagaatactgaacttggcaacggggtggaagatcaaggagaggtgagtttgtttctgtgaaaaagaagaaaacacagtgtacatctgttccactaggttttcttcctctaccatgtagacagtttgaaaatgttcaatggccatagcattcagcttccctgttaaaacaagtaccataaagtattcatgaataacaaaataatcgtattcttttttttttaatgtaagagaacaagatgctaaccaggaaccacatcgatcctgaaagcgctttttggacaaatcacaagcctgtgattaactacaaagagcttatagaaagccagaactttcaaaataaaaataaaaatgttgacaaagattatcaaagaatactgtgcaatatatatatttttgtcattaaaaaaggagtgctcacgctagctgatccttgaatttcattagaagccaggatggctgcctgtggaatgcagtcctttttctggggcttacaaactggaggacctcgctcaggccttgttaaccagcacatgctgtatattaaataagattcacatttttaaaaatcttgatttctacttcttctgaaaaatctgaatatctgcttctgtgcagtcaacaggcctgcatttgtgtatcgtagaatcatctggagctgagcggtggcactgtcattttgtcatactccccatcagtccctttgaacactggggacaactttactcatttacatgagcttccaagtcactgtagacttttgagtccgagccctttgtgtcactctgagactggaccttatttcttttgaccaaggcagataccactgagggtaatagtgtttgtggaactcaagggagtgactccaactttggagccgctgaactccaataatggcatgcagaggctgtgagcctgttcaatacctaagccaggttcatgtcctggatcgaacttgaggtatctccgacaactctgaatctcctgggatccactctagacttgcgagacttgcaattagatttaagagcacgttgcctttagaatcatggagctcaaagaatcagaatgtaagtggaaactgaggttgagagagcttgaggactttcctgaccttcttgacattaccgagttctgaatggggaattcatttaattaggtgagaagttttgtacctcattaatcagttcttactattattttaatttttgaggtcttaataacagcaagtaaaaacatactttgttttatctgccacgagttagcccacagtaacccagtactgtgctacccaatgtgttaactatgttgttttgtggttttttaatgtaatgttttgtattcattcactgtcctatgattgtatgtatgtcagggccaaggtctagcagcagtggcttcatctaggagtttgctagaaatacagcctctctcatcccacaccagaactcttcaacaggaatctcgaacaatatccctgggtgattcatatagtgttcattagactttgaaagacattgacatatatacaatcatataatacttaaatgaatatatagcataatataaaaggactacaaaataacatagttaacaattcaaatgtcttcaggtatagaggtttttgcagctacttccatgcttcagcacagaatggtatggtatttttctgtttatttcattgggctgcttctaagattttttttttttttgaagaacgggtttcaaaggttaaaaaatacaaaacaagttaaaaacaacctgttattttactagcacaaactgaggagagaaactagaggaataaggttgaattagctagacaaagctctgtggagtgggttggtaaatttgaatggcctttgttgatattgagaggcacaagctggccatgaggtctaattggaattataacttgaatcctaaagagcttgcattgttgtcgttgtcaaaagacaaaattacaacaaacttagttatagttctttcttactcacagttcatgaatcaggacagctgccgttctacaaaatagaatgagagctcccactgggcactggcagagcggtgggttttgtaaggtggggacaaagaaatgaagcaacagtaaaaagctgactggttaatgttaagttaatttttaaatgaaggttaaatcagagaggatccacttattacactgactcagggagcctgaaatctcctattttcaggaaaaactgttttttttttttttgcggggaggggatctatctgcttccttaatgtttcagtttgattatgtgtcattcagcatgagtcactccattttggtttgcactagtgttgtgcactagtgttgcactagtgttgtggcctaatgtaggaactcagtccaaagcaatagcctctcatgatctttgattaacaggtctttattgtgtctcttctggcgtgtctgggctcctctcttcttcagctatctcctcccctatctcctcctccttttcttttcccttgccttattcttctgtgttgtcctgccttgcattactaaactctcaatcctacgtgcctgaccaaagagctgatcatgttaacccacaattatctgaacttccaccaagggaaagcatatataccctaggattagagatgggaaacgtgcctgagatgaaaatatttaagtaaggaagaagggttggggctagggttctcctactttgttccgcactacccacacacatgtagttaaagttaaaaaggttgcttgtactctctgatacaatttgggagaacattgaacttactggaagattcgttagtgccacattcagtcaccaggttaggcatagaaggaacagggccttaatattaatacattgattatttcctatgttaagaaattctggaaattcaacgctgtagtactgccatcctgtgtagatcagactgactaggccgggatttccaaaagtatacttttatgagtgcgtgtgatgttgatacagcatggtattgtacactgcatttcaatttcttttcatatcatttggggacatccatatgggtcttgttgaaaaaaaaattacatttccttgtggccaaattacaagaaaaataaaatacaaagttttaggtaagatattaaatagatattaaatattgagtttatataaaacatccaaataattttttaataatattttaataagcttcattttatgagaatactgttttgtataaggttttcttgcttgaacagctacaagtaatttttgaagaaggcaatttaatggtgatcccttttaattctttattatcacaaatagcattggatataaggagtgtgtatattactgttttcttcatttgactgcttctttcttgctagcaaccagaatttagtttctataaattataggtcaaaggacttgtagttctgtaactctcatgattttgatttgttttttttcttttcagtgaaactataatgttgaaaatatttgtgataatgcatgcatatggatttatcagttttttatattgttttccaaaaataatgatgatgcttttcttcaattatagtcagatattgttcttctagtgttaaaaattttctttcagaattcaaataaaatgctggtttaacataaccaatcaaccatttcaatctccctttttaaagttgagtttttctgaatccataaatttggtcattaaatattaacataattttacatgttgcaatttacattttgcataattcacattcttgcaaatttcagctaagttcattccagtgctaaaaaaatgagaagtcgatttttgaaagcaaagttgaaaagtactttggatctagtgatagtgttgtgctttcataactagcctcttgaactccagctaatactgttgtaaataccttatagaaaatttttgttccatatcttgcccttgcacacatttaaagttcaaatatttcctgtacggatagttgcttttgacaaggtaccagtgtagtatgtgacaatttgtttaatacctttgcatgcaaataaataataagtttggaagaaaaaggaagtatcagggcccacaaatagacatttgagagaatcctcatgttgctctttagtcctgtcagcttctgtggtggattcttcatttgtgttataaatctggtgacttcaattttaatacactcttcctaattgtggtgggaaaataaatgtcaagtaaaaattaaatctgtttaagcataaagttctcaacagaaatgacaatctttacaaatttagcaaattaattttctgattattagactattaagtttcagttaattgaacaattaaaaatgtttaacctttataaaatgtgattttaaattttaaaggcctacagtgtctttaataaatcaatttaaatgaattaggctcaattatttttatgagaaataaaaatttgctgaaacaaacaataatcagtataaaattccctcaaacccactctggctaattttaaatatcagaagctgataaaaacataagtaaatccagaggttttagtctagaaaattaacaacacccgttatcttctaaatatcaatatctaaaaagaaaaatgagaaacagcaacagcaatcggaagtgatttctagatgagtaatcacaaagataagcacgttaaagggaaagaacaggaaataacttacatgcactaacaaacagaaaacgtttattgaaaagtaaatcacagagcagtggaggtgattgaacaggtagatgctgtgttttattccaataaagtcttcatctgctgaagtaataattgtcaaattcagaaagttacatacaaatagtgttcgaatgtaatttcaactatttaaattttggaataattgcaaaaatggctttaaattttatcacctcacacatttgacagctatcaatatgtcagggcccacctgtgcctcatttgttgcccctggctgagttactctggcctagtggggaagcaacgggacaggggtgtgggacttcctgggtttgaagctaggctccatggcttatttgttaggtgatctcaagtaagttactttgtgcctcagtttctttatctgtaacgtgatgataatagcctactacacttttggctggcatgaggattaagtgaggacacatatttcatccctgaacaatgtctaatgtagagtatgttctcaactagggtggctcattttgatccctactaccactagtaatagtaatccatgaaaatagggcctgtggtcaaatgataaatgttgaattagggcaaaagtaagcagctgttctaattacagaattatagtacttaatatccttctaatatgcattgtgaatctctgagcggtggcagagccatagtgtatagtgttttctaaatttacatagccgtacgataattattttggcccaaggatctcatgtggacactgctgtgcagaagacattttggaaaacaccagcctcgtggcatccccagactaaatgagcctctgcaacatccttttaataagaaggtcctttccaaagtccagtcccagccctggcccagatcctcctatttggaagcataggcttatgctctgtgtcaaggctgatttatcagatggtaaagcttgatagaactataataaacactcttcttgatcatgctaagtaattttaaatcatctaacactttaaatcagcctcagatttttcttgcttctttgaagacctctgccagagagaacatttggagcactggctccctcagacaccctttgggttgcatgtgaatatttccatcgtatttgaatctgttttcaaaataaagcctgattagaaactactttaaatgtctgaccagagtccaaacaccctcagaagtctttgtgaaatgtcatccatgcccggatcccttatgtatttataatattcctgctgtatctttttcccctgcactgttatgttttagatattcatccccttcttctctccaggaaggagtgtgcaactaatattaaacacagagacagccttcctgagcagctgccaacagatgcacagcccttgggccaagttcagctgtcaaacagccctggcccatgaaacaaagggcagaagcttcccaaccacatgcggatgagcagaaacagctgcatttgctgtagccaggggcccagcatccaattcctgtgattcttaataaaaaaataccaagcacatggaaagggaaaattaaatactattctgacaaataccataattgctaacatcatctcccaggaaggcagcatggcagataacccctattcatgagcctttgtcccattgcgacaatcagtgctcaacacactgcattttagctttttactcagtcaatggcctggcaagagaattgtctttttttccctggagcttgaaaatggagtatatgaatttgggagcatatgaagttggtaggactagctcctggaggtaaaagtacctcagattatacataacaagtgattatatttcaatcagcaacatctaccgtaaaatacataagcctaggggcacttaagaaagcatataaacctgggtttgaatatggtggtagcactcagctgtgtccttcagcaagtttgttaacccatcagagagttagttctctcaactgtgaactgggctgatgtgaagattgaaagaaataatacctgtaaaacccttaacaaatgtctgaatacagtgaaagctcaataggtgttatttttattatatatctatttgctggtccaataatttttataagaccagtatgacttctccaccagagactgaccaggaaagaatgccttctgaatgacctctcttgcagcaatagcacggtaggacctatgttttcctcgaagggttaatttctcattctctggctatgtctagcactaacagttccattagagaatctcttgccctcatgatcttgttctgcatctggtaagctccccacatttgttcccctcttcacatgtcttttgcaaaatgagctttctattggtggttggctctgccccacactttcttgcctttataactctgtgtaggcattttccattctacttcctacttccatcagctatagaaggcccaacacccatttcagctctactccactctagcacagtaattgtagcaggggttttcctaatttccttgagggaagaaggagagagaaagcagaggcaggtaaagggcccttgagagggctccctcacgagctccacacctgtaatcaatgccagaagactcaatgcacattcagaggccaccggtgtagactggaggcagccgagaaagactttgtggaggaggcaagatttgaagaattgatagaacttggcttatggagaagcaaagggggagaagagggagaaggtgaggagaaacaattcctgagtattagaaaaaggtctgaatttggagctttaagatctaggtttgtgatcttgggcaaggtacctaaaaactctgaattttagttaatccatgatgtatatatgggggcggggggtaatgtgaactcagaaaacttgtgtgagaaggtgcttaaaaattagttgaattgaattttatagaagagacactagtagacgtatttagttgtaagatttttattgtgatattaatgctgccacgctaatagggtttaaagatgtagttgaatcctgttataaaacaagcatcatgtcagatccataattagcattaaagtattcattgagtgcccattatgccctggcaagctcatacctcaaaattgtgttcttttacttacatatgatttatactagggtgttttatgactttcaaagaaatttgccttatcaaggaaaccaattatacctgatggactcctgcatactcatgtttttcaatttaaaattatctttgattctactgatgatcagaaaatttgtgaaaattttagaaagtccaaacttttaaagtttggaaaatacaatgaagaaataaaaaatcagaatgaactgtttcctactcaaattttcattcataacataatctttggaatattattaatggatttatattattccaaagtgtgggtatcttgtaatttatgaatatctcatctgttccaagcttttgctattgtaattaaacttgcaatggatatcctttgtataaaaatcagtctataattacttcctttctttgcatctccatgaagggaggagaatgtttcttcctcatttataggctcaacagcccaacttgaccctccagtttgtcacacacatcttttctgcaggataagaaatatcagtttccttgcacactagcagaagtggttcatttccactggaaacttaccagaggcattctccaccagatactgcatttccttaggaaaagttttacctattttgctgagaagattttactcactgaagcataaaaatacatgctctcaagatgaatacatgtcaggtaagttctagaaggattaattttcagttatttaattctggaatttaattagatcaccttggaaggcaaatttaaagaacattcttagacaaggtattcataattcgaaaaggattttcctaagaactgataagcatggtggtgtctttccctttagtgctttttcctgggggcatttagaattcatggaaaacagttgtcaaacctcaaaaaatggactaatgaatgaatataagctcaaaaaatggactaatgaatgaatataagcttttactcaagaattaggaaggattaacatccttttgctcattctgtgaccagatgtcttgtatagggttatatatatttcatttctgtttctctggttaagggcatcagttgaaagtgtttgttacagctgaattgacttgtgcattcatactctaaatattattttaaaatatctaattaatatattattcaccgagcgactcttttttagtagaagctatcacatcagaaactctttattctgacaaagtgacatattgtataattttattcccaaagctaatttttttattttaagacatttcatgagatgttaaaagcccctagtgaagactgttaaatgagccattaaggttaggttatcaatgatcaactaaccaaactatcttaattttcttttgattgaataatagtaacagcaacggtaggaacacacatatgtgcaactaaaaaataaataaaagtaaggacaaactaaaaaataagaattatgcaatgggcattatttaactttgaaaatgtcctataagatttcaagggaaaaagtaaataaaatgtatatgcacgtgcttacattttctggaaacttctgggagcaactattttgcatttcaatatatttttatttaatataaaactaaaaagttgtcttaaatagaagttaaaagcagtttgctttccatacgcaattcattatatcaaattggatagtgttcttggctcagtcagcagcagcagcagcaacattgagtgcccttgggtgtggctctgtattagggtacagctagtaaaattgtcatttgagatagagaaatagtgtcatctcttaagaaatatgctattttcatttaacaaatgtttgttgggcatctataagctgtccagatgccatgctaagcactggggacacaggtatgagcagcatatacatgatcctggctttccagcccttaggttctagtggacactaagacaagcacacaggtactatgagaaatagtagaaagctcctgtgctccaggaaattagaactgaaaacagtttgtagtgccaagtagacaggtggaaaatatgtgtttaataaggaattagcataaaatatagagatacactcagtgtgcattcctatacattcaaatacaggaatgcacagtggcagcaaagtgtggtggtgagcagatgaactctgggcacaaattgcccagtttcaatcccggctccactattcctataaggtaagtggagcaagttaccttttgctctggaagccaggacagggatggtgggcagagagagaaagggccagagagcgggaagtgaggactgctggagtataattaaagcaaagcaggtatagtggttccaagaagaaaaatttctttcaagaagaaaaatccagaagaatggcttgtgcagcaggtggcgtcacacagcatgtaagagagggacttactttaatgctggtaggaaccggtaagaggacatagaaacccagaaagataagggtacttgctcgaatctctcaaccaacaagttcagaaatctcatgtaggacgtggtgaggtttatcaaaatggggcatgggatgcaatgaagtagcagagacactcaataatttcgacttggaagactggaggattcattaccataaaaaaactgaacatgggaaatgaattataataaaaatataatgactgggtgtttagtttgaataaagaatagaacatcactgtgtaataatcgctgagaggtttacaggtcaaatggaagattgttctgcaagagaaaagaaaggtaaacactgcaagcaactacaggccatgaacgatggtaaaatcgatgtgggagacagagcactgaactgggagtcaggatacctggcctctactgaatttttagcaaataacagacttttcctgcaccctagtttcctcatctgtaggcattacataaacaaatattttcatttatgtttctgtgagctcaagaacattgcctggtatttcatattattaagtgcttaattttctattttagtgaaagtatgctgcaagaatttagagacagtggcaggtaaataaagacagcaataaggcaaaaaaaaaaaaaaaaaaaacccagcaaattgtcaataaaaacagtagttaaaagctgatttctggaggcagactgcctgagttcagatcctggctctctgcagtgtgatcttgggcaagttactcaacttcttctgcctcattttcctcatttataaaatgggaataataatattatcttcctcatagtatttgtggaaagattaaacaagttaatatctataaagctgcttagagcagagccttttacatagggagtgtgcaaaattgctattaagcttcactgaggagatgaaactcacttgagctggatattaaagagagaaaggtttggagagatatttcaggccagggaagcagcatgtgaaaaggaagaagcaagcatgagtttgacagttgtgcatggaagataatcgtgtcactttctaggggagaaagaaaccaggatgaataatggagagcatttatttctagtacagaggttcctgctacaaggattaggaaatccggtcatacctacattgtgcctatctctgtaaagagacaatgggacaatactggaggttttcaaaagggagtgacataccatggctttggagtagctgggtctgataggcacattctgattgagtatacattactgaggtcatttggccagggttttctgcaagagtaaggcaaaagataatgaatatttttagaaaatagtagtttcaacatactccaaaaggtttggtattagtgatagaatgggccagggtttaagccatgaaagaaaagccttctctttgggccttttcatctaaattacaggtggtattggggtccctggagagagttcattttgtagtgaaatgctatgttttgtgtggagaagttttctatcagcgcttttgtgaaatttggaggtctttaaaaaaatctgtctaagtaaatggtaactaggtaatttgggagaggaacaagtatagtaatctcactgaaaaagttacagttttatttgctaaggattatagaaatagtaaaaaaaatgtgaacgttttcatgggctattacatgtatgtctttgttataaaattttattgcttaaaagatgtcctcatccacagccatgtcacctgagcctgtgcagtgctagtatttgagcagatgctgagttttcattttgcttcaaagtccattaattcagaactctttaagagtgcctttaaaagttcaaccacatttaactcatcttatctacctttgcatttcccatcccagttgactaaagttttttatactataagtgatcacatgttaagtaagatctgtaaatactgctttagctctgggaaattgtttgaaagcactttaaaacatggagtctttctccattattgtatttctttctgtatttattgcctatcatcttaaaaaaatctgaaaactgaagctatgacaaaataatgaatttgaacatatcacaagttgataactaagataaagaatgttcttttataagacattgcaaagggaggttttatcctctgtaagtatgccaaaagaatctacttggtctcaggtgttgccattggatgtcaacagtgataggccatttaaagataaggccataaactgatatctagagaacttttgattaattagcagctggaggataaatgcaaagaagcttcttgagtgtctagatagactaaagtttgctggatgaggtagatagagacatccttctggtggtttctctattgtctgagaagcaaatgctaactgaatatatagatagacattacacacacacagaaatttttaccttctctcttttcacaaccttgctattgccctttggcaatttcttcttcctttatattggacaagactgatcctgatatcatttgtattagtcagtgtccagtcaggaaaatataaaccatatcagatattttaacagaggaaagttattagaggaaattggccaaacaagtactgaaggactagatttgagattttacagagctagttatgaaggaagcagctaccacttctaaagtggtggtggggtgggagtggggcagggagagaagatgtttggggttcttaggatgaagaaacctggaaaaggtgcctgtgaaactgaagtccagacctttggatggaggggctctgtttagctggtagcactatatcagaagctcagagaagggacactacagaattggggcctacacctctaatgagagtgttgcttatactattttggggatgctgcaacaaaataccttagactgggtatcttgtaaataaggaaattatttcttacagttctgaaggctgagaagtccaagatacaggtgtcagcagattcagtgtctggtgaagatctgactcctggtttgtagatgactgttttcttgtgtcctcataaggtagaagtgcaagaagtctctctcgggcctcttttatgagggcactaatcccattcataagggctccatcctcatgatctaatcacctcccaaaggccccacctcctgatatcttcaccttggagggttttgaacatatgaaacttaaactctggattttggagagacacaaatatttagaccatagcagggtactttgccaccacttcaactatctatgaggggtcacaatgaggctggtttgggaacactcaatgagacgcaggaaatggaaccaactgctattgccaggatgaaaggccattgttgaggtgacacctgcaggaatgtgagcaaaactggaagaaacaagtcctttgtttctcctccagcctctaataggttaattacagcacaagaattttaactaagcgttactgttatcaaagcatgctgatagaaggaccttggagaccctctcaccatacacagacatatatatatataatatgtatatatgtgtgtatatatacatatatatgcatacacatacatatatacatacacatatacatatacatgtacatgtacatgtgtacatgtacgtatacatgcacacgtgtatacatgtaggtatacacgtgtatacatgtaggtgtacacgtgtatacatgtgtacgtgtatacatgtgtatgcatgtgtacatatacgtgtgtatgcatgtacgtgcgtatacatgtgtatgcatgtacgtgtgtatacatgtacatgtatacgtgtatacatgtacatgtatacgtgtatacatgtacatgtatacgtgtatacatgtacatatacatacacatgtacatatacatacacatgtacatatacatatacatacacatacatatacatatacacatacatatgcatctatatatatatgcatatatatagatgcatctattttatagatgcatctaagaatagggtcagtggtgaaccataaactagaatgatgagtatgattcaggaaaaaaaaccaaaaactaacatcactcttgttcccattatgggtctataattttattaagttattcagagatagcatctcagttaataattctcatttaataatcccaacagccttgttagagaagtgggataatttccatatcgaaaatgaaaacaatcagactcagaggatttaagtaatttcagtcagtcagtaagtagcggataggattctggccaaggtctgtttaacaacaaaggacatgtttgaactctcatccccttcaatggaaaataaggcaaagccaagaagccaaaagtacaggcacccaacaaagtgggaggcacagaacaagggggagggcaggtatgaacatccagagcgactttgattctagggagatgctcactcgtctacggaaggtgtattgtattcagtttctgtacttccggtcttcactctagccttgccttctggattgttctaccaagtactttggcttttctcatagtctttcaaaaattgttaatattattttgattgaccagtcataattgtacacatttaaggggtacaatatgatactgtgatatatgtatacaatatgaaattattaaatcaagctaattaacatatccatcactccaactacctatcattttttatggtaggacatttgaaatttactctcattttgaaatgtgcaacacattgctgactatagtcaccctaatgggcaatagatctcaaaacttattcttctgcctgtcctatttgaaacttggtaccctttgaacaacagctccctacttcctccctccccctcccctgccaggctttggtaaccatcattctattctctacttctgtaagtttaatgttttaagattccacatataactgagatctcaaacaaactcaaatcagtatgtcaaaggaatatcttctgtcttagtctgttttctgctgctacaacagaataccacaaactacgtaatttatagagaaaagagatgtatttggctcacagttctgcaggctgggaagtccaaggtatgatgcccatatcgggttggcctggggaggttgttcttgttgcattgtcctttggtggaaagcaactgagcatgtgagacagggaggaaattgggccaaactaattattttattaggagcctatttctgtgataactaatcccatgataatgacattagtccattcaggagggtagagccctagtgacccaatcatcacctaaaggtcctacctctcaacattgttaagattacagttaaatttcaacataagtttcagaggagacactgaagacacagcatctgcattcccatgtccatgtagctattcacaatagtcaagacatggaaccaaccttaagtgtccatcaatggatgaatggataaagaaaatgtgttatacatatgcaatggaatactattccgctttaaagaataagaaaatctattatctagcacaacatttatagatctggaggacaacatgctgaatgagataagccaggaacagaaagacaaatcccatagtcctgaagtcaaatttttgctgccacaaactgacgcgtccatggtggcagctatccctgatctctcatgctattcatgggtatgatacaacagtggccaacttcattctcatgcttttcacttcttgcctcccaccttgggggttttcaatgactgcttagatatgagacaccagggcacatgctcactcctcatgcatgtgtaatccagaaagggcagggagttaacaccctttggagtgaactttgagcaagggctgttagaatgtgtagatgcatttttctcccttcctctccctggatgaactcttcacatttataataacgtcagttggcctctttgaagatgtcctgcaaggctaggcaaacagcttcgctaagctggacaactctatagtacactccattatatttgtttccccttacactccttttccttcacttctgctgttttgggactgcgccatctcccaataaaatgttagcacaagatgcttttgcaaaggcttttttttttttctgggttaagagcagggactgggctgtgaaggagagccataggctaagatgataggacccacaattttcttagtgtctggtagtaatcccaggtatccatcagttcaggaaggtaggtagaaactataagtagattaaaacagggtagcaagaaggacttctgaaaaagtagtgagaatagatctgacagcttccacctttatggaatgaaagcttcatcctgtagattggttcttgtgatgcttatttaaaataaatttccttaaatgaggcccaacatgaaccaattctccacccctgtgaaaattttctattgccagtttgaacttctatgggtgatcatacaatcgcatagcttctgaggagctaactttcactcagaacttaggattcatctgttgtcacctcctctggggagaactcactggcccctctcctttctgccagctgttgagaatattagggttccctcttctgtgtttcagaggtattttctcatttctatcgtggcacattttatgctgtttctgcacaatgcagagagatcctgaaagcagagaatatgccttagccactgctgaatttctagaaactaacagaagcctgccacacagtagccatttaacatggattgattccattgactaaattaaagaattcatgaggagctctgatcatggcctgaggtttgcagttaccctattgaacaaatcccagaagagaatttgcggaattaggtctacatgtaatacacatttacccacatgatgaaataagatgacaagagctttgtggtatcaaaatatctatgtctctgacaattttcacaactttacttaattatattagggttaagtattggaaagccttgatacaatgctaatttggaagcattataccaaagtgttagatcagattagccccagttctcttctaaatagttccagaaaccagatttggacccagtcagcctaacggcagtaaaaaccaagacctgtctatcatgctacactgctttcttcagatgacaggggccttaagagcaaagtaagatattgattggcctccaggatccaggaaaaacaaaacaaaacaaaacaaaaaagccagaaagaatacaaggtgaaggcaagactgaaaggaaaatagttttgatgtactaggaaacaaaatcattgaatctgaaacactgttgtctttggaatatcctgagagaaaggagcccaacacaggtcatttggctggaaggaagatcaaggcaggagtccgtctggtgcgtggggttctccatgggagactgtcaacagctaagggcagcggagggcaatgatgaatgcctcagagccgagggccacagaaaaggcactgggaacactttccatgcacttcatacctatgactgagaggatggcctaggcaacctgctttagggtggaaactatagttacaaagatgagcagtcacttaatttactaatgaatgaccccaggtctcatagcttttctttaggaaggattatatagtagttaaaaagtgcatggttcccagatatagaaaaatctgggtattcaccttggctgtaccatttactgtgtgaacatctcaggctactatctttacctccatttgtctcagctggcacctccttaaagcaaaaataataatattacttcagagggttattgtggacattagagaaatatatgtgaaacacctgtccaagtagcaatggtgagtgtgcaatgaatactagttgtttatcatgtgattattagtctaattcttgcaaaatgtcccagcctttgtgttttgatgaacaagaatatatttttaaaaaattaaaaaattttgttgtcctcataatatagacatctgctccctgggacctaaaaagcaatccataattttccaaagctgctaaaaaatctgccatgttctaaatgacctttatcaagcgatctcctagtctagagaggcggaggagtaacttgaaggtgaaataccccgttagcaatcccccaggtgaatagaaaatttaaaataatattctaatgattcattgtacattactacgccccattaggtgtctacattacatcttggggcacaatcaatatctgtcatcctgcttatggttttggtgctagagcggttcaatttcattttgcaactctcatgctcatgaagctgtatctcgggtgtcatatgataaaatattactcagaagtacgtattcagtcctaaagcatagtgggaaataattgatgaagaaagtgtctttccatctggtcaaacaccattaaagtgaggatacgatttatatgagaaaaaacgaagattgatattccttttttttttttttttttttgagacagagtctcaatccatcccctaggctggagtgtagtggtgcaatcttggctcactgcaacctctgcctcctgggttcaagtggttctcctgctttagcctcccgagtagctgggattacaggcacgcaccaccacgctcagctaatttttgtatttattttatttattttatttttttagtagagacggggtttatcatattggccaggctggtcttgaactcctgaccttatgatctgcctgccttggcctcccaaagtgctgggataacaggcgtgagccactgcacccagccaaaagactgatattttatgaaactttttggtaaatccacgtgagagagaaagtttttattctgtactcaacatagttccattacaagcatttttcaaacatttaaactggattgctacttacaaaattttaatatagacaagactagttcatgaacatatcccctttataaatacaggtaccagtacgtagacatatatttcttgtatttaaaatttaaaaaatcatactacattttagaatatggcaaagcttaagagattccaaaacagtcatggataagtaataagtcacttgtcattgttctatacaaaattaatgaatgagttaagtaacctatgttttgagctgtttcctttcagaattgaaatgccaaaggagtgaccctctttttctcatgtgggtgcacacaagcatactccaatcgaaatatcttccccacacattctaccatgtggtagtacctagtaagtactaacctactcactaggttagtagagacttgtattagaattcagacatccttgggagggttaaacccacgatcaagtgactcatactttcacatgaatttttgaaaactttaaatgtatgatttctatgcaaattgagatcagactaagtgtgaattctacttaaaagagaggatttcggagtactgtggaataggacatgccaaggcccttgccacagcttgagacagacagaagatgacataaaagtgcgtgtgtgtctgtgcaagtgtgcgtgtgcatatgtgtgaagtataaagggcccatggagggctatagagatagatggataagagttgaaaaatggatttaacttggactgctcttctgttcaagatgcttttggctgctgcaccctttgcaatggctctggaaaatcaccaatagcatggggcttcatgcacagatgctctaagtgctactcgacttacccaactttataaaaggagggatgtgcacagctagtacatctgtgatatttgctttgggatcagaaatactaagtgggacagtggttttctttgatatagggagatgttcaccttaaaaatgactggaaaagtggcttgatttggtcttcaatatctaatcatgaaatggatatactttataaccagggtatatagtttgggagttttgactgattataatttatgtcatttcttttaaaaggttgagagattcaaatgccttgatactgatatatcaatgacacgttggagatgcattttttgggttttagcatactgaagtgaaagtcagtcaatagaatatacattgattccagggtaaatgtcccaaatttgagaaaagaggttatcctgaaaggggagaaattatctcacggtcccaaacaatatgttgtttcattacactgtttgtgggacaagaagggaagggggttggatgcaggattaagacaagtgaaactgtcacatagaaacatgaactctggttgggacaatctcaaaatgctgcaggtgtttgtaaagcttgctgagattgactgggctctcctattacttacttttgatgctggattttgtctgacttttgtcccataaaaaataagacactagaaaggctttttggtttttataattattcatcagtttctattttcacatagctttggagcactgtagaggatcccttgtatattttagaatgcctatgtgggggaaagaatcacaagtagtaaagagcttaccttgatttttggaatagatatgttttaaccaagtgtagtaaagtgaatattctactttctagtcatttgttacagaatcaggcactactacctccctactgtcacagtaagtagctgtagtctttctataacttaggactggtgtggggtgatttttgatgggtaaattttcaacattcttatttcagtcctgaattttagaattttgttgacatacacaggattcttcaatagccttctatttagtcttctatttgccacttcttatttccaactcatcttatatgttactatgagacaaatgttcattaaacattacttttgtttgtttttgagcaattgcttcttgaagtgccagttttctattgctcttgtgtataatccacttttctctttctggatttgaaggtcatcctcagttttgctccacttgatctcatgttaacttcctgcccctccttatcatgaaaagtactccagcctgcaactaagcccttctcctcaccctctatcgttgtctctatgcctgccttatgctattgcttttcccaagagtacccaccccaccctcttcttcctcctttttataccttactgagctttaagtttcaccttaatttctacctgtataataacaaagtagcttgcattcattgagactccacaataggccagccactattctcaacacatgtcatgtatatgttgttaaatgttgatatcaccctattggggaagattcttcctctaccctctaagggtctctggcagtacctaagaattaaattaaactgaggtggctgggcgtggtggctcatgcctgtaatcccagtgctttgggaggctgaggcaggcagatcacaaggtcagaagttcgagaccagactggccaatatggcaaaaccccatttctactaaaaatataaaaattagccgggcatggtggcgggtgcctatagtcccagctactcgggaggctgactcaggagaatcgcttgaaccggggaggcagaggttgcagtgagccaacatcgcgccactgcactccagcctgggcaacagagtgagactctgtctcaaaaaaaaaaaaaaaaaaaaaaaaagaaggaaactgaggtaacacagatcaacaggagaatatcatacacaatttgctaaaattttacatatatgtggaagtccttacaaaacaaaataaaaaaatatagacccaaagaagtgaccaaaacagatagcttatataccttttagacaaagaaaggataaatttttaaagaaatgataagacaaagggatttgggctaggagcaataaattgtagggaagtaactaacagatatattggggaaaactagtagaagataaaggttattttagcaagcttgtttgaacagattcatttcagcattgattcccagtctctggtgattagagtgttcctcttttcttggtacagggagagcacctttctcaaatgaaatttatgtgtttttttttttaatggcccatttttaggtagcaaaggggaggtcagagaccccttcctgcatctgctgttcctcaagtatctccaactcaaaataatcaatatgcccaaatagcatattttgaggtggcatgtcctgaactccttcaaactgtataaggtagttctacatctccattttacaaataatggcatcaaggcacaaaggaataaactcactaagggacacagttgtgaagtcactccgctgggacacaaagccagctgcctgccccacaccctgttctctctgccactctgctgcccttcccttcagtcttctcggactctccagctcattctgctttcctctatctatgaacttatatggtagctgttttcaaaaccgtacagtttatcatttcattgtgacgagttcatgcatgttagttttttctgagcaattacatagcaagatatcttgaaatgatttctatgcctcattctactttctttccaaagcagtcctggctcctggtaagaactcattaaatactttgtgattgatagataatacaaataatagagataggaggcaggggaattctgggcagaagaaggcaggtccccggcaagggccccaacctcaagcctgaaaccacagcccaaagtgagaacatacatacctgttttcccactcaaatgttgccttttccaaaaccacccatggcctgtcccactcccaatcctgtgcccataaaaaccccagaactcagccagcagagaggagaagcagctggatgtggaagactatggttagatgtcagagagaagtgacttgacttcagagggacagcttgatggcatagctttggagaggaatccggccgttcctcctccatcccctttccagctccccttcctgctgagagccactttcatcggtaataaaatcccctgcacttaccatctccaatttgttcctgtgaccttattcctcctggatgccagacaagaatttaggtgccatgagtgcgggtacaaaaggctgtcacactgaccttccactgagcttttaacacttaagccatccagccatccacagatggcaaagttgaaagggcactgtaacactccttctagggcttcaggtgttgcaggcacccccctagatgctgctgtggggtctgcacaaagttttgctcctgccggcacccaaaaacactcatcctggctcccgtgtccactcacctgctctccccctcccacaaaaggtggaacacaactgggccaagcaagtggagtctgaccctgccagcaccaaaggagccagctagcctgtgaaggcatcagggaagtatcatgcttcacaaagacagctctcctcccctcctatgatacaaacaattgtattgatttttgtaattcactctgactatatagaccaagtgccttcaagcacggtgacatactaaaaagtatacatttcatgtgactgatctacaaagtagccctcagcttagctgagagttgactagcatcctgcaatggtttctgagttgggctccagtgggtctgaattattcagttttcttttttttctttttttttctttttttttttttttgagacagggtctcactctgttgcccaggctggagtacagtggtgtgatcttggctcactgcagcctccacctcctgggctcaagtgataatcccgcctcagcctctcgaatagctgagactacaggcatgcactacaacaccccaggtaatttttgtagtttttgtagagacagagttttaccgtgttgtcccggctggcctcaaattcctgggctcaagccatccacatgcctcagcctcctaaagtgctggcattacacgtgtgaatcactatggccagccttcagttttcatttgcattgttctgaaacaattttttaacattccatgttatacaaacatcacacaaacaagaagattacaccatttgtgatacgtacgtggttatagttcacataataggagacactattcaactaccttaaaatcagcttactgagcaccagaaacaacatgattcatatattggcttaaaagtccagtatcactgtgattttcctgattttttctttttttaaaaaaaaccatatgatgattatgacttgaggttctatccgggattgatactggaataattcttgaaggttggtggttggggacagagacctggtaatcaggcagacctgatttggaatctcagctgtaccactgattaacgtggcaattttagcaagaaacttagcttctctgaacaactacttcttgatatctaaagtgggaataataacccctactctgcagggttgctataagaattaaattcaataatgcatataaaggaattatactttctaccacatggtaattgctcaataaaatgtttttattagtggtaatcatgtatccataagcatagtaattgatatatgctgactcacctgaaaaaatggcaagtagaatttggaaatgacagcctcttttcttccttttttccttctttgcttccatccttccttcctttcctctttctttcctttcttcttttttccatctctctctcctccttttctttctctcttctttgtttctttctgaggcataatttacatacaataacatgtatttattttgatgtacaatttgatggattttggtcattgtatgcagtcaagtaaacgtccttacactgaagctataaaatagtgccatcaccctaaaacatttcctcatgtccttttgcaatcaactcctcacttccattctcaacctcaggtaaccactcatctgtttttgatcactatagtttggtcatttctagaattccatatacatggaaacgtaaattatatagttttttacattcgatttctttcacttagcatactttttgtgattgactcatgttaagtgtaataatattttgtttatttttattgctagtaatgtttcatggtatgaatatatcacagtttgtctattcactagctgatagacatttgggttgttttaatttttggctttaggaatactgttgctataaacacttgattgcaagctttcgtgtgaacttactctccttacagggcttagtgtgcccagaaaaaggacactgggttacaatgggaagtatagcacatcagagcatctaagttgtgtcttctccttgcctctagtgatgataatgagagtaataaagccgactttcatttatctagcctgtttcctcctctcagagaggctgctttcacagcccccactgtccccaaagagtcaggttagcttgtccccatctcatcactggttcattgagctgtggtagacacctgcctcaaactggaccaaatggattttctaccctgagaacgtgaaattcagaaacagggtcttttaaaattaattatgtatgcttaaactagaggtaagatagacttagctaggatgggcaatttgagtcgaataccaagacaaccgacatctccagtgtgaggaaagagacagcgagagtgagaaagagagagagagagagagaaagagagagagagtgaaactgcagataagcaatgaaatccagaaataagagactagatttcaagacagagaagtgagctatatttatttcaccctctttcagtactgtaagatgccacaaaatcctttaaactctgtggttttgccagatgctctgaaagtgttccagggaactctctctttggtttgaactaggttcagcaggcttttgtttctgacaaataaaataaccaaataatccctgactgagacaaatcataattgttatgaagatttgttgaatcctaactacctacctactttaataataattctattaatcctttcttacatcggatcaccaaaacaaccctgtaaggaaggatttttctttgaaggaactgaactaagaaatgagttcagttagtcgagaaattaaataatttgtataaggttacatgtttggagggtagcaggcctggagactaaattctgaactgcttttccccaaggtctctgatggaaatagcagtcccatgctggaccctgggtgtgacatgaaggagacagcgtagggctccatacagctcccccagcttggtgatctctctttatatatctaagaaagtgagtggagtaataggcattgagagggctcctgtctatggactccactttctctgtgaatctagattatttgctgttaataagggaagatttgatagtgttggatatttgaaggaagtcatttgtgaatgctatcagatgccaatttggaaatgcagaaagattataagccagtatggtcctataaggactatatttcatgtaagtaaagttgagagaaatagagacatttccctcttaaatgtttgcctgttggtttgtttttacattcattttgtggaggaaacacatgactttaaaaaaatgtaaactatttctgtttcttcttatgagtgaatcgtggtgggaaagacttcatggacagagtgaaaatgaaagaaatgctttctaaagcaaaacacagaaaaggagaaagctggctaggaggtgataaggaatatgaaaagactccaggagttataagagagaactcagaagttacagtgattcccctgcctggtgggcttcagaagcatttgtagaatgagtgcagcataagttttagtcatgcaatttggatgtgaatagagactttgcactatctggcctttcaccacttccttttcttttctcaacttgggccttctcatcagaaactgaggattgttacacctcacaggctagttgtatcaactaaatgggctgtccaggagtggtggctcatgcctgtaatcccagcactttgggaggccaaggtgggtggatcacgaggtaaggagtttgagcccagcctgaccaacatggcgaaaacctgtctctactaaaaatacaaaaattagctgggcatggttgtgtgtgccagtaatcccagctactcaggaggctgaggcaggagaattgcttgaacccgggaggcagaggttgcagtgagcaagactgcgccattgcactccagcctgggtgacagagcaagactctgtctcaaaaaaacaaaacaaaaaaacaaaaaacaaacaaaaatcctaaatgggttaatgcaagtaaaatactaagcctgctgatatagagcaggtgctcaataaatgtcaggtttcctatcaccacttcatactgttctttgagacattcattggtttttcaactgtttgcctttaggaggatttcttctggtctggacaatcgaagaggttcacagtgatgcacgtcatttcctggcctacagtgaagtgacaattgtacactcaaacacaaatctagatgtaaatatcacagacttatttgtagttattaatttaaattggttaaaacaccttcttagttacagataccaaagagcttaagtatgtggtttaaagcattagacgcaaaaggtattacagacgcattcagggatgatgggtatccccggatcctaaggcctagtgaatggtctcttctgtagaagacagagaggataagagtggggactaacaattcaatcttataccaaagataaataagtatgtatagatatcaacataggtatataggtatagataaataggtataaatatatatggatatagttctaaagcatactactttacactctgcatacaaaatatattagttgatagctttttatatttagccttgaatattcttttgtgcagagagactttataaaatcaatgtgactccaagaaagtattagcaggaattcaggccctgagaaagacaagcttatggagcaggtaaaaagtttcataattgggtcctccagtgttgtgctaaatacagacagaactgtcagagtaggcttttgacatttgcccatttattcttgcactaaaatgagcaatttaaaaacggttggaaagaaatcagtggctatttttgaacaccatcctctgaaagtacagcagataaaaacaaaacagaacaaatatatggaaaaatatgtagctgatatcagggaagcccaaaaaccaccttagagttacacattttccaagatctcaactgagcttctgaaccactcccagtcaaatcaaactcgattatttgtaaagatgctgtctaatgatcagtagaaagtgaagacacacaggatatgtctccatcagctcttaacacacgttggctcccaaaccttacaatagctcaaacttctcctgcaagtttgatccacaaagtgatcctgaactaacacgagcagcccaggcatgatggcatcaccccagaacagaacacttcctccaggcatacattgtctgtgagcttcaaattgcttcttgtcctgtattgtttccagatgatgagttttccataaatgttgtctcttgctagaaaatgttatattccagcatctacctttaaaggcaactatcaaaacaataatctttaaagatctgcagatgcctgtggagatgagactcataattactctgatgaaattgttgtctttgaacatagcaatgaagagttatttttatttgggaaaaagtgtagaaataagaaaatagcatagtaaggctgctcttgactttcgtacagcttcagccttttcatgaaacataactcagatgatcttcttctgaattagtgaaccctgatgttagttatataaccaggggaccacggtgtcagccttgttattttaagggtcttttccagtctgcaagacccaaccaatttccttcacctttcacatgtggacttctcattgttactaaactaaccatcccttcctgctcatctctacacatactttaggacttattgatttcatggacgttcatttgtctcacaaacttggtgatatagaaactgcattttctgctttggtgcaccccttagagagcctagtgtggttcagacaaacctgatgagatgcacaacttggaggtctcgattttctcatctgtaaaactgggcaagttgttataaggattgtgatactatacaggaaagtgctaaataccgcaggcacagatgaaaggaaatctttccctctcctggcacaatgctacggatgcaaacaaacacattgttttacctttacatatcatgagttacccagagttttctcgttcatgtatgaagggagtactaattcgtcatcaccaaagcatgagcatatttagaactggattttgagttttgtaaagatgtgtaaacttcccaggtgccagtagcaggcctgtgtagatgttgtcctcatcaaggatcagggactgcttgttgtcacgttcctgttgaggaatgcctgcacctctgaccagcctcaaacactgctgtagaggaaagattagaaatataaattatgtaaaatgcagatcattgactgaacatttgactgttcaaggagttgcattttactgcttggaataccttttaaagtgaaggagaagaaaaggaggaagggggagggaagggaggagaaaaagaagaggaggaagttgagaagagggaaagttgctccataatttacaaggctctttttttcacagtgggattattatttcccattatcacatgaaacaatcttcattacttttcttaattctgtcttcattctcacttcaccttgtccttttatatatgttctctcaacttgggaataagaaactggacctttacagctgggcacggtggctaacgcctgtaatcccagcactttgggaggccgaggcaggtggatcatgaggtcaggagttcgagaccagcctgaccaacatggtgaaaccctgtctctactaaaaatacaaaaattagccaagtgtggtggtgggcacctgtaatcccagctactcaggaggctgaggcaggagaattgcttgaaaccggaaggcagaggtggcagtgagccaagattgcaccactgcactccagcctgggcaacaagagtgaaactctacctcaaaaaaaaaaaaaaaaaaaaaagaaactagagctttacgagaccaaatatatctgaatatctgaggctttagaaaaacagaagaaaggaaggaagggaggaaaaagaaagaaagaaagaaagaaagaagaaacagacaaaataaaagctttggaattgctatagaaaggattagattagatgactagctaagaccttttctcgtgtctgtatttggggaagagaaggcatgaatttccccttttagttaggtaaacgtatttttatattgagaacctcttgcataaggacaggtgaattaatatactcattgaaaatgaaatgacttcagagctcaaaaagatcttgagaatatctggcgcagtgtttttgaaacttttaagaaatcagcataattattccccccatttatatttcagttaagtaaaattgactctaagtgcataaaatacgggaaacctggctactagggtttgaatcgaaagcagggtttgtgttatccaaggcatctttcctccccttcgctgtccttctctttctccaaggttaagtctgaggagttttctagaaaacctcaaattcagtggaacacattctacctccatcataatgtgaaaagaatctgtggtctaatctgatgaaataatttgctcgtggctagctgataaaaagcacttgtagctaacacatattgagtgatgaacctggactagatgcatgaagtacctaatctccccaccaaccctgtgatgtacacactcttatgacactaattttatagagaaggaaactgatttcagagagcttaagtgattagaagcaaatccatgactagaccttggtgtccttaaccctcagggcaatgctttggcactctacaatcttacctcctagaaacaccttcaaaaccaccctatgattagaactgaattttagcatctacaaaaattcacagttcacttttagttctctgttttcctgggttcttcccaggaatttaagttattttgagaccagagaagcttaaggcattgacattccacatgccctcaggatttaacttaagctccaggctgtttcaataccaaagattttgcctcaaactttgccaccactgagaacttggggatgtgaaaaccactgaggcagcaatggcaaagagaagagtgggaaaggcctttccaggatccatgtgcagaattagatttgtgtaccacctgtgataactgggaaagatcttttttttctggtttttttttttgttcctttttttttccacgttggaggcaggaataaagcaggtgagggttccatcagagtatctgccctaatttcctgtaacagcaacaggagttacccattactcctattgccaatagatatcatggcttcactcctaaaccatactcagagcattcacttgttgatgttagtaaggaaaagcaagttgtgcataagcagtattatacagcatgcttcagtacagtttgtagctatttgcttaactgaaatctaggtacaagcctcttcaaataacagatcttctttttctgtatgttccttaaagagaaagaggaaagagaaaagaaacatgcctggagtgagcatttatcaccaagacaatttccaatttcatctcacgatcaggtttacttcccaatattctacaaccgtaccattttatcatgggcataaacattgagaataatgactcttgtgtcttttcagagcctaatttgtgatgagagaattttaatgttggaaacaaactttaaaggtaccgaagtccagacgtctaatataccctagaatctctctgcagctcgttggcaacagacatctggcccagctgtgatgctctaataagtccaggcaagaggaccatagcactttagaaagacatgaagcttactgaagatatgacttacaaatagagcttttggtacagtgcagtctgaaactgattttcctaaaaataaaatgctcacgtaggtctcaaataaaggtgcctcgctcctcagatagatagaaaatagtacaacacccaacctaaatagtcaaaataaaaatattgtgtatccaaaaaaaagttttagaaatgtatttagttaccacttggagccagaggtagttgccaacccaatttcattataagtgaaatttctagggtattaaaaatggctctcctcttcttcttcctctcccttttccttcttctttttctgttgattttttatcatttaattttgatccacaattctgtataacatctacatctcatatcaacctttttttttttctagaattattctactccctgggtcagtccccaagatgtttcacttcattatggatctccttagcgctggtgctaaggttaaaacattaattctccgcatgctgagagttacttagctccatggtgaagtctctatctgccaaaagtctctgttcaaataaatatgtaactggtgattctacagcatgcattagaatcatgcagagggtttgttaaaacacagcctgctgggccccaccctcctaagtctctgattcagtggatctgagggagcccaagaatttgcatttttagcatcttcccaggtgctgcagatgttactggctcagcaacaacacttagaacaactgttctagaaagagagtccctagaactgttgcattctagttaaagatggtgggaatgggaggaagacattgctctataccaggctgttatgggcaaattcgggagataattgtgatgaggttgaaaggtttgaatttaatctccaaatttcagtcagagagtaagattcattaaggcttttttccatccccctgcaaagtccattcttccagccagctcttgctccagccctgctgtgatgagactctgctgttttctgttttagctacttctgcagctctcccaaccctggaaaagatgaagaaagatgatgattttgttctcagctcttagtctttagcctttggacagccatcaaaagtacattttaaggaaaagggggaaaatatgtctactaggagaaatgccttgtattagactattatatcagtgatttgcttttacttaatgtagtattgaggagaaaatgcctctcttttattattcaaatggtttgcttttactttaccaaattacaagaaagcataccaaatgcaggcttctaaatagtttaaactggtttaccacattaaactcaaaagagagtatttcattaaaaaatataaatggactggagctgttttctgacaatacactgttgggctttttttaaacttctacttttgttttatgaaccgaactactggtgtttaatactcaaagatgctcagcttttaggtaatatttgttgtaggaattcttaaaagccacagatactgctaatggggaaaaaacaacttttcttatgttgaggttatagcaactttggtggataacagttaatacaattagttttccatcagtttctctaaatgcattttttttttctaactaactttagggtattctgtatccttggcattgatttagtgagatcttcattacatggcatttcactttagtttccattgcagattgatatcacaggtaataactgaatctttagggtttgaagaagctgacctttctttaagagatctaatcatttcacggacaagttccagtggtatttctattaagaaatcagggtatggctgggcacagtggctcatgcctgtaatcccaacactttgggaggccgaggcgggaggatcacctgatgtcaggagttcgagaccagcctggccaacatggtgaaaccccatctctgctaaaaatataaaattagccaggtgtagtgtcacatgcctgtagtcccagctactcgggaggctgagacaggagaattgcttgaacctgggagacggaggctgcagtgagctgagatcacgccactgcactccagcctgggtgatatacagtgagactccgtctcaaaaaaaaaaaaaaaaattgtctgtcttcatggtaagataatcaggactttaaggaagtgtgtaagacattttactcatatttttattaccagtttacattatggtttctaaggccattatgtgaatccaaataccatcttgaaatgaaaacacattaagctatttttaatctgcaaattatttgatcagctgcctcagatacatgaagaatctgatggcaagggcacagaatagctaaagtttaacgggaaagctggtactatccaagtcagtgaggtgaacacccagctgcagagcggaggctcagaaatggtgagtgccaagatgaatcaagccacaaaaggaatgtggaggacctctgaggtttagcttcatatattgggcaatgtttctataggcagtcattggcctttcgtcttcgtcttctgcaccgattcagtcatttcatttgtagagtcttcctcaacatattgtttaaaaaaattcaagatttttcaaatttggttttaggatttcaaaaacaatcaggactagtatgagctattcattttttttttttttttttttttttttttagatagagtcctgctctatcacccaggctggaatgcagtggccaatttcagtttactgcaacctctgcctcccaggttcaggtgattctcctgcctcaacatcctgaatagttgggattataggtacccaccaccacgcctggctaatttttgtgtttttagtagagatggtgttttgccatgttggccaggctggtctcaaactcccggcctcaggtagtccacctgcctcggcctcccaacgtgctaggattacaggcatgagccaccgtgcagggcctattcattgtttttttgttaattctctaaggattaacttttgggccatgttggactgacagattctgtcctttgctctgcttatgttttcccttctattttcaggtagtgattaagactgtgaagacagaaggtctgaattagcaatttttcaggcagctgacttaataatttagactaaaattcgttccaggatgcttgctcacctcctgcatgtggtgtcctagaaagcctcttgtttctccagctgtcctccccggcagcattggcatcacctgggagattgctagagatgcagatcccaggccctcgcagatccatggagtcatcacctgcattttagcaagagttccaggtgattcgtgtgcacattacagtttgaaaaatattggtaaatattatggtcatcatagcgggttatccaactactggttttagctctgccactatctaattgtgtgaccctttgccagtcagctcagcttttcaaactgtgtttcatggagctgtatccattcagtttattactcagaggctgggtagtaaggtcagcagctcccatctgagccctgagcgactccagttttattagtttttatctgttaggctttaacttaagacactgtttgaagaaaaggtttgcctgtgaaagagatcgaaggcctactgtctctgatgagtcttaaagtcatttcctgatctgaattttctatgattataatatcattcattgataggaattgtttccttagcgaaaaggaaaaatctcttcatttctatacatgtggcaggttgacatttgtcaggtactgaggctgacagacagtttagctacctttaggaggttccttgatcaaaatagagaaactttgccagccactgaacttctcactgttttcctcatcttagcgacttaatccaggcctcaccccatctgtcactacagaagaactgtttacgagacctcactttactagcttttatttattttatcagtgttggttatttgggagcaaactgaccctgagctatcctttggccagtgccattcactttgcatacattgatctaaaaaggcaattgggttccgaggtctgagatacccaatgatattctacatgtgacaaagacatttccagtcctgcacaccctggtaacctaaagaaggccaagcatctcaattaattttcagttgacagtttctgcagctgagtccccaagtcagagtccctaaacaaaattgtttgcattctataggaaaataggacacattattagcccagttctaaatccagttccatctttcctcaaacaacagcaaatgttcttctcagattcatagcatggagcatcatccacttttaatgttttccatccacatagctgcattgccctgttacttatttacaaatttattggctttagatggcatattttctccaaagaactcaggcagttgaatgagttgttttagaagtctacaaaatatacccttactcattcacctgtgggatttacatgaggttatttcacattcctcttcatgtattgcgatggggttgttataaagatactcacacctttaaatcttcccagtagcacgtatatttctgctttcaaacacaacaaccaagaaaaaagaaaattctactgaaacaactgaccaatcttctttccttagaaaaatcaatctcatcagtagctcatgaaattcaatttccctggtcaggaacaaagcagataatcatcccctaataatatttatggatgacagaaatgcagagcaaataaaattagcctctaaaactatcatcaagttccttgaaacttttttctttatctcaaggggatttatggagtaatggtaagtgtgtttttctccatttctatttaggccaacacacatcagaggcactcaatagatatctggtgaatgaatgaggagtgagtaaatgaataaagtaaaatacagatgaccctcaatttggacataatgcattcctagagactgcttcataaaggatattgcttaaaggcaaaacaccgactgcaagaatgccaccacttttgtctgtaaaattcattacaaattgacagcagataaagtagcatatatatctcttcattaggtaacagcaaataaatggaaaggcaaaagagggccacaatgaagcatgaacaatgtatagaattctagtaaaagatgattgcataaggacatttttaccttgcttctctttatgaaagtgtccatcaatatgaagaaaaagaagggaagaaccaccatcttctccatgacagcatgcctaaagctagtctaatcttctctctgtcttgaaaggttttatggatcctgtgagtctgcttatcacagtcatttgaagagagaaacaacaactgccaatcatgaaacagaggatgtgtgagatatgggcttgctgtgaaccaagatgatccaaaggggatgctgaaagcttagcagaaccaaatactcaaatagaaaaaatgtggctgatttgcttcaacagctttccgagataatataccaaagtggaaactgatagcttctccagatcatacttgctcattctgtccccgattcttgggcagaactctggtctagagagaactttccttattccaagaagcaccgtgagcagaagacctaaaacaagacccatagagtaaagggacatgggaaacaaaatggcaaatctgacatcagaaaaaaatgaagaagaaaataaataaaaaatatagccttcatacttttaagtaaaatgagtgtaagctagttgcaaaagacataaaattaataaaagataacaacttaataaaagatatcaaatctaatctgtctctctcacatgcacagacacacacacacacacacacacacacacacacacacaaagtgttgaaaggataatcaggcaggccgattttaagaaataaatgtaaaaataaagtcatcaaaaactgtcaccgcattaagaacctaaaggattaagaaagacaacatagaaaatagcatccatgagcatagaaggcttgaaataatcacagaaaaagaaatgaaacaaaaaaattagaaagcgattagatacaatattatagatatggaagtcagacatagaagatacaaattatgatataaattatagtctaaaaagagaaaaatataacacaggaaaatttaaaatatttgttaaaataacatctcctgaaatcaactaaaaccagaatcttaatgttaaaaaaaggtctattgtgttttaggaaaattttatgtgaaacatctcctgatgaatagaaagtctgtggccatccaagcagaaaaatcaagctagtctaaaattcttcatggcagaattgaatgccagaacacagaggaaaaattgtataattatagatactattatccaaggtttttttttttttttttttttgagatggagtctcgctctgtcgcccaggctggagtgcagtggcgcaatctcggctcactgcaagctccgcttcccgggttcacgccattctcctgcctcagcctcccgagtagctgggactacaggcgcccgccaccgcgcccggctaattttttgtattttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacacccggctaatttttttttttgtatttttagtagagacggggtttcaccgttttagccgggatggtctcgatctcctgacctcatgatccgcccgcctcggcctcccaaagtgctgggattacaggcgtgagccaccgcgcccggcctatccaaggtttttatacccagtcaagctgttcttcaatgtaaaggctatatactaataagcaatctaggctataacacccatgatccttcaaaaaacaaacaaacaaaaaaaccagctgatgaaagaacctaaccatagaagataaatcaaagaactctgggttagagaactcattgaattggtattgaatctatatatacttagagataggactaaaaaaacactctgggaattatgataatagaaatataaatattacaaatgtattactgcatctttatattttatttttcaataattatataatcagcaactgggggaagcagttaagactttaagtttggggagaaatgatgcctctgattggtctttttggggtgtattaatccattcttaagctgctgataaagacataacagactgggcaatttacaaaataaagagaggtttaatagacttacagttccacgtggctggggaggcctcacaatcacggcagaaggcaaggaggagcaagtcacgtcttacatggatggcagcaggcaaagagagagaacttgtgcagggaaactcctctttgtaaaactgtcagatctcctgagacccattcactctcatgagaacagcatggaaaaaacttgccaccatgattcaattacctcccgctgagttcctcctacaacacatgggatttcaagatgagatttgagtaggcacatgcagccaaaccatattgggggtgtcttaggttaggttctctcgaaacagatcctgagacaggaatttgggtaccatggttattgagtgagtgctccttagaggaaggatgtggataaacaggatggggagacgttaaatgaagatgtggtctcagcttgagtccagcttcagtctgatcccatagagagttctggagcataaattgaaccacagtgctagccccattttgaggtgaggggctggacttttgttccctcctttcaatcagtcattgactgcaggctgttcaatagggaagggataaataggggtgtaactttagagctagatggctcgacttccatgctgggtaattccctgaaaaagagacagctgggggctttagcaccagcacccacagcagcaggggtctgggtgcatcagtctgtgaaagcgaatcttggcagtttcccaatggtgtctcctgtagagcattgatagctctggttgatgttagctttccctgtcactgactggtcctttgttatcctttattatggcttataaatgtcagttttcagtgtctgaatgcatttcactgagagaaggaaagaaaagaggcgctgtagagggaaaaggaagtggggaaaagcctagactttttttaaggagaggaaatgtgccagtgagctttgtggaagttgtttcagcatggagcagttatacatgttgccagatgtggagtctcaacaatctcagagggtcagcctctttagctatgaagtgttgctttatgccctccagaaattatccctctctcccctccacctgctgctcatcccatcccccttttctctctactcaccctaatgatccatctcacaagagatggcatgtctcaaatggcaagaacaggaagtgacaaacatagacagtgttggtaatatcgaaatgaaaagaaataattgtctctgattaagatgagactagaaagacattgacattgctctttgtagcatgtactagggagcacccaaatctctaagagaggactaaagtgtggcattttgcaaacttactttacaattgtacccattgtctgttgactattcagtgggaataacattctacaaaaacattctttagcaaatgtggatgtaggcaatgagatccagggggttttcaagaaatacaggtgaagatgacatttgtgctttagcaataactcttaaagaaatgtggaggatgggttagagaggaaacagaatgtcagggaggccagtgagggctatttcagtagtctaagtaaaaatattaaagtcctgaactaatcttagtagttattaaagcaacctcccagataacgcaggatcccatatccctgacagaagagccactgatgcttctgtgtccatgaaacagctaataaaaactgatgtttgagcctaagcattaagaatgttttcctgatagggagctaaaataatctttgaaaatcacacccaaaatattagtcctgccctttgaagctatgcagaacaggttgcttgttcactaagaaaaagatgtatatatcaagtgctgtcttacaagtgggaatacaaaggtgaggaaggcatagccgtagctctcaaggagctgaatatctagtgagaagaaaaagacatactcaagttttgttgcaataaatttcagcagaggaaagctatagggattttagaggaagaggtgaatgactgtccaggcatgctaagaggattcatggtgcctttatgaaataatccttctgatataggagggaaggaatcaagtccatcctacccctacctcctgtttgtttgtttctcagtttgcccagttcttgaacttgttcttttattacatgaatctaaatttcattgaatcccattccttcttcctctggagattttgtacttttccaatgtttttctttaaatgtaggcttccaatcattggtcattgtctcagctgtgatctgaggaacgtagaattcagcatagtgtgctgggaagtggcaatgtacccaaaatgtgtgtggaaggcttgccagtatattagcaataccttccctctaccctttgagttctccttagaggtttaactcactttctaagcctccagaaactgtatcctatgttcctttatattgtattagaaataaagaattggttaaactcaaaataaatagatgttagtgcattaacacaagcctgtacccattataaaaatgtatttggcaaagaaggtaatgtttaacccaaagaaatatcctttagggaagggattttaggcaccttaatgtaaaatacacatttggtaaagaggccctcttcagtacacttgagtcacaccatatattcaatttctgacttcataagaggctaggtcctgataaaaatattgaaggaacacatgtgttaaaagtgtagtataacatctactattattggatgctacataaaaagcatggagctaagcaattctccatgtattatgatcatgcaatttcaacaaccactctataagatatatgctattatctccattttacagatgaggaaactgaggcttagaagtattgttcgagatcgagtgaaagaggcctagttttcagatcaagaaatttgattccagttttgattttatcacttactgtgattttcgcacaagtcatgttactatgtttaaccttttgtttctcacctgtaaaatgaaggaagatgactaaaccatttcttggggctgttccagttgtatgattttatgaacatctccatgaaagtatctttatttagcaaatagccaaatctgagaaaaaggcaaatttattagtctttctagaactctttagcatcctacctttaccatgaagcattactccacattggctggcctgtattctttccaactcctaaacagtagctcttctttcaaatgtctccctctatttaggcacaagcaaggtgctgaaaagcatgagaaatatgagcataatacaaggaaatcgataaggttaggaatcttcacacgtttaacttaatcatatcagacactgaaaacaaagtcatattttattgccaaagagaaatgctctttggcaaaccatgatagtaatctgattgtgaacaatgcttattcatcatttctggggcactggctgctgtgccagccaaggggacagctgacctaatgggcttgaagttgcattcctcaacattagttatgttgttgtgtgcaatcaccaacacaaagatagtgtacattggtcaatcagaaaatatgggctccttgcttgtttcccgttctgtttttattgacgattgggggataaattgcacagtgatagccaagagcataaattttctttgtacttttatataatcttgtttctcattttacaatatctgtatttattcctaaagttgagaagaggatcagacattacaaaacaatctggaaaaggtatggtaataatctaaaatatcccatagaaaacacctttatgtgttgccctaggtcactgaggcagttataacaaaaaatactatagactggatggtttaaagaaaaaaacagttatttcttgcagttctggagactgggaagtccaagctcaagatatggcagatttagtgcctggtgagaacctgcttcctggttcatagaagtctgtcttcttactgtgtcctcgcatgatggaaggaatgagagagccctcttgggtctcttttataagagcactaatcccatttatgaagtctctaccctcattacctaatcacctccccaaagcccccatctcctggtaccatcactttggtaagggtttcaacatataaattagggtgggggatacaaatatttagttaattacatgtgtatttatgtctcagagatgaggaggtcttagtttcaaatagttacacctatgcaattatcattccaaacttaacttttcctgtaatcctctccttttgatgtcataccatttgtacactgtgtaaacagttactctgggacatagtccataatttacactcccttttccttaattttactttgaggttccttctcagggcttcctttggactctgtggttacctctatcataactcttatcacatagaatgagatataattatggttgtgagatcaatctttagacgagagtttattgattgtttgtgactagctttgtgttaaatgtggggtcactaaatcctgcatacacttcttttcaaccaggtattgtttcaataattccctctatctctctataaaaaattgaattccttaaacccgggagtccttatggatcagagcaagtgagcagcacatcgcattctaccaatttagcttttttacagaatcccagtccaaatgggactattccgtaatgttctgtggtcgtaactgttgtccagtgtgattggcctggttttcttaggcatgaaacatgatgtattaattatgatctgaacagtgagccagaagttactgtatctagtttgacagtattaacatttatggcacatagttaaacaaggacttttgattctgaggtaggaggagttgggaagatatgagcagaatttttatacacgggggattctgattagaggatcaacaattacaaagtatagttatgcaccgtttaatgacagagatatgttctgagaaatgtgttgttaggcgattttgtcattatgcaaacatcacagagtatacatacacaaacctagatggtatagcccactacacacctaggttatatggtacagcctattgctcctaagatacaaacctgtacagcatgttactgtactgaatactgtaggcaattgtagcacaatgataagcacgtatataaacatatctgaacatagaaaagaaatagtcaaaacattgtgttataatcttatgggactaccgtcatatatatggtttgattttgtccaaaacgtctttctgagacacatgactgttgtctcacacaataaagagatagaaccttcataaatggagagtggagtgtcaatgcaaagtgggattaaatcaggaacttacttgaagacggaaagaggaggaacaccttcagcaccatctctcccatccttatcccaaaacactgatgactttacagccacctcccatacacactgcaagcacagggcactgcaagaagctgtggttacagaggagacactgcctaagggatcagtctgagtgccactggtatcttatggaaatacaagccagggactatcatagtcaatggaagaggattcgtgttaatgtcccacagtcagccagaagtgcttgtgactctatgcataggcacagtgcctttgaaaattgactttcaatcactttgtgagagtgaacactgttactgcagggtctagctgctccacccattgttctagatgggagataaaacagcctaactctagctggatgctcagtccaaactctaggatgagggtcaaggcagggactgcactattcattcatgtttgcttttctgggactcctataactgatgccttggatttgtgggatggttggttatgaccagtggctacacctgaggaactcactgtagcttgatggttcatatagatttgagattaccaaaatgttattcaacattcatactagatggtcttgaatatacttcaaattcagcatgttctcatctgaactcacatctcaacatcaccacactgtccctttcctttttcttatattttcagagtatcagtataaatctcattgcaccaggcagaatctgaggagaaatccttgcagctccttcttcctgattcatcatcaaagcctactgattttgcctccaaaccattcacttctgttcctctttacatatggacaatgggaggaactgactaaccacttgggcttgtcattctgtttgacccctttccccagatgtattctttgtcctctgccctattctgccttgaccttgacttatgccctccaagtgggtctggctgagaaataactggcaagagatgagcattgggaaggggagataggaaaatatttatctccatctcttgctttgtcagctcttctggttgctactgcccctacctgccaggctttggtaaactgcccctctccttgtcccttcaagctatgatgtggtgcgccaatggctgagtcttcctttttgactcctgaattttgctcatatctgtgttagtgactcctttgctacattttctttaggccaaccactttttttcttgaagaacgctggacaacccactatttttcccatactcatgttgcccacttcaaaactgctcttcatcctctagagagtggtcttttaaagggtaaatttgaccatcacttttctgattaaaactctccaaggggatcttgttgatcttaatattgacagaaatagctctaatgtggcccacagcctgtatgagctgactcctgtctgcttctccattgtcatctcttgtcacagtcactgggttccagccatgttgctcttttattgttccttgaaattgccatgggacctccagttttgaaggtcttctttaattcttctgttttcagaaattctctgctcctttcttgcctcctcccatccctagcctgcaattttataggaagtgttacattcctttttaaaaatttttattttaaattcagtggtagatgtgcaggatgtgcaggtttgttccataggtaaatgtgtgtcaggggggtttgttgtacagattatttcatcacacaggtattaagcctagtgtccattagttgtttttcctgatcctctccctcctccctccctctgtcctctgataggccctgttgtgtgttgttctcctctatgtgtccatgtgttctcatcatttagctcccacttacaagtgagaacatgtggtatttggttttctgttcctttaatttgctaaggatgatggcctccagctccatctatgtccctgcaaagaacatgatctcattcctttttttatggctgcacagtaggaaatgttacattcttagagaaaatcttcctcttcatgacactttatgacatttctgccacaggagtttgattctatagttaatatgttctcataacaccttatatctttgctccaaagcatttatgatggagtataattacatagaattgtttcattgatataaaataagttccagtgtgtgtggaaggatgttctgtgccttgtttttcattttatctgtaacaatttgcacaacttgtggcaaatgattatcattttataatagttattgggtaaataattaaaaagtatctctagctaaggccaaccaggacagcaaaaataaaactaaaatgaagagcacttgaatgagacagcaacagcagtgaaagtagccttccatgattattatcgaaatatctgttgggagttaagctgaaaactgacttgaggagtttgggaataaacatagcccacagtcagaggaaggggctcattcaaaaacatttagttgctctcaggtcaacgataggtctcaaattccatttttcacgagcatccacaataaaacctcagagcacaagccaataactcaagtactcaaatgccctccagggttccttccaagttgctctgctgacctgagctcattacttttatataatgattgcagcagaagcatctatggaagtactgtctacaatgagatagtcaaaaaaatactaaggagataattacagtattaattcttaagttttgcagaattaattaaacataaaaaatattattttggaacatcaagtttggatatatggtgacaaaacaaaaccactgctggccagtgagaacttctagggaatctatattatacatttttacattatgtgaatttgcataagtaaattatccagaataatttactcatgtcaattaacagaaaaaaaaacatgacttaattaaaatctcattacaggaactctcttcaatcaataattttggaaagtgacagacaaagatggtccacagggggatacatgaggacaaacatagctttagataagactgtgtttgcaccctagactggaatgtctcttcctcaaacatgtattaagccattccatttactgagcacctcttatattctaagaactgtacttgtcatcgtggtgggggaagggaggcataaataagctgtgatacttgggacaggacaaccaaaacctagtttccttcaaataggacttgagtcactcatagaagtctttcctaaatattccggtcttcaagaatttctctgaagacttctaaaaagtactgcttatgtcacgtgtgaatcctttcttgatgatgatgatgatagagaagtatttattatgaaagaaagaaagagaaggagagagagaaagaattgacatgagccaattcccaaaataaatcttttatatatatatgtatatatctctccctatatatatctatgtataccatatatatatatttatatgttacagataaaatgaatacatatatatgtattcatatatatatttatatgttacagataaaatgaatacatatatatatatacctatacacacatatctcctattggttctgtttctcttgagaaccccgattgatacatagatagaagagtgtatgtaaaacggaagcaaatagatcttcatggaagatcagttgggtatgaaagcaaagagctatgaaaagtatatgatgcttatttgcttattgttacttgtacagattttgatatgtattattgtaatgattacttttatgtcaacatgactgaactaagggatgctcatatatcttgtgaaacactatttctgggtgtctgtgaggatgtttctggaagagactagcatatgaatgggtagacagcatcaagaagattgccctccccattgtgggtaggcgtcatctaatccactgaggggcgaaatagaacaaagaggctgaggaagggagaatttgctttccgtttgaaacatccatcttctcctgcctgtagacgtgggtgctcccagttctcaggtttttagactcggatcaaaatatatgccatcatttctctcaattctcaggccttcagactcagactgagttacaccaccagctttcctagttctccagcttgcagagagcagactgtgggactccttggcctcccataactgcacgagccaattcccataataaatctccatatatatatatatatatatatatatatatatatatatatacacacacacacacacacacagatacacaccatatatatctctctatatatatgtataccatatatatatgtatatatacacacatattctcttgagaacccagactgatatatagatagcagagtgtatgaaacgtatgcacagtctataaattatatagtaatcacctatctacccacttacctacccactacccaggtaaagaattagaatatggccagtgtcttagaaactttctgtatgtctgtcctcgattacattctgttttatcccaccctccagaagtactcaccatcctgtttttaggttaattacttcattgcttatacttatgatattatcaacagtgtaaatgttttcaaataatatgtggattagttttgaaatttgaatagctgtgtaagaaaagagcaatattgccactattacacaatgcctcccaagagaagagaaatagaagtctgagaaatctcatggtcccaacttcatggaaagtttacatggatgagtctcctctaggcatgtcagaggccccactcagaccacgtggtggggttaaggtgtgtaccatgtactggatatccagcagggatatgatcaggggtattctctgcttctggactcatcgttccctacctacagctctcagagtgggtcaaagctgaacatttctgtgaagcaaattgagtgtcttcagctgattcaggaagcatggcagagtggacaggatatttattagcacattgacaagacaaagtcagaccagctactattgagaatcatgcttaccaaggaattttattctctggtaaaaagttggtatgaggtgtatgtatcatggcattgggcatcttagcgtgtataactttcagtgcatctgactcttggggtgcattggtccaaactctgggttgcccttgaatggggggaactctgtccttctgatataacattttatggtgctccatagattctcacatcctttctcctatgttgaatgacctgcttcctatgtcttgttctttgttggcttattattaagtattattattattactattatcgtagagctcatatttgagtcacttcttaagaaaggaaaaggagtgaacaatgagaacacatggacacagggaggggaacaacacacactggggcctgttgggtggtggggtaggcagagagagagcattaggaaaaatagctagtgcctggtgggcttaatacctaggtgatgggttaataggtgcagcaaaccactatggcacacgtttacctgtgcaacaaacctgcacatcctgcccatgtactcctgaactaaaaataaaaattaaaaaaaaagaaatgataagagggaagtgaatttttgaatcttgaatgtttgaaaatatctttattgaaatatcatattaattgctagtttgcccgggtttagacttttagatcagaaataattttccttcaaaatttcaaaggcatttttcaatgtttcctttcagggttattgttgagaaacctgatgccatcccaatcctcaattccttatcccctcatttgaagcttatagaattgtgatttcactgtgctggaagctcactaggtcctttacatctaaaaactcttgtcattcacttctaggaacttcttttgaaatattacagtggtaattttctcctttctcactgctgtgatatctctttctagaacatctgttatttggatatgggatgttctacatactttgttctactttacagtatattctcttaactttatcttacaactcttcaattgatattttcattttatttcctgcttattatttgaatttctaagaactcattcaaaatgatgggaatatttttcttatgtgttattctctttttgtttcatgtctgcattaccctatccctctgagactatgaatcatagctttatgttcctttttttggtcttcttttggcatggtctctattttctcctagttcctctttgttctgtttgtcctttgggtctctgtattctattttagagtggcttctttatcttagaggctttcctttaactctgatatccagtaaacctaggtacctgttcatgattaagaatgaactactcagaggtttatttgaagctctcattgtctggtatgttgtcaactttcagattcgcaagaggagaatgctccagtgtctttggtaatttttccttgtgctgctcagatttcccagaaaaccctcccactcttcctcctgtaacagcagaaatctgactgccagagcaactgtcttggagattaaacagtcagcattatttttacatagttacttatttcctttgttttcagtatggtgcccacaccctcaactgtgcttgatgtccctagaaaccttctgttttgctttttactttttttttttaagggaatacgtatcaacaattttatggtgcagcaaacatcttttagagtcatggagttgaagagaatggcaactagtggtctacctgattcttagatggcttcacccaaatatctgttactttgacctcttccttccctttatctgcctctcctggttccaaacatgactgggatgcccccttctggggccccttgaggatttgaggattctgtggtgtaacttgtgttggttttcaattttctttgatactgacttgtaatttaactttctcggctctatcaagttacttcttatccacttgcttttggcttctaaaatttggctgctgttgtcttcttttctttcttcccatttgcaagagtttgtttctacaaaaaaaaacattgtttataatgaatttagtgggtttcatggggaaacaaaattaatgtatgtgtttaacctgtcatcttaaccagtaactcggctggtgtagttttaatgttaagctttcacctatttaacacatatttcttgatctctgtggagtgaagaagaacatcatctcgcctccataaattctaagacaattacttttggcatcatttagataccctttccttattaagtttaggatagtcaagctttcaagcactaaaagtgctgggtaataatggtaattagccaaattgggaaaataaggccatctctctacctcgtaatttccttttttccctctaggtttagcagtacaatttgaattaagacaaattcagatgttctctaaacatattaatcccattgcacccccaaattatacactttttcttcttctaatgttaaaatagttactaaaccagcgaatgttccttaaccacacttatgctacgagccccttatccaaacattctctcagtttggatgatttcacctcctgaatatctcctgcattttttccttttgtattttccctgctgcaaatctctcaaacctacctctttgattgctgtcagacagtttttttttctgaattacaaatatgaccatgtcactttcttttttaactcccaaatgaatctgtattgctttaataaagtctaaacttagagcagcatcaaaagctgtcaaagatgccctaactgccctcgtattttcaacctcatttttcaccatggctttcctgggtgcagcacttcagtaagaacacatgcaggtgtgtgtatccatggcagactccaggcaatttcatactgctgtgcccttacacatgctgctctctctgcttggagcatcctccttgtgctgtctcctctggtgacatccttcaaaaccaggttggatgcctctaggaatctctcaccagccctcttgaggttgggctcagagccccttctttacccatggagagtcctctgcattggtgcatcctgcatcgacatggtttgcctgagcttccatgccctcttggagccccatgattttattcctcatgtcttgcatgctgcctgacagtgtagaatgtttcctactgtgagaatattgaatctgagggctgccaacagatgaatcttttcccttagaggaatgttttacccatttccataattatttcagccatttagatttaaaattcactcactggcctaggattaaggtaactttagtgtattccttttttttctttccttctttctttctttttctttttctttttttttttttttgagacgtagtctcgctctgtcaccccggctggagtgcagtggtgccatctcagctcactgcaacctctgtctcccgggttcacaccattctcctgcctcagcctcctgagtagctgggactacaggcgcccgctaccatgcccagctaattttttgtatttttagtagagacaggttttcaccgtgttagccaggatggtctcgatctcctgaccttgtgatccacctgtctcggcctcttaaagggctgggattacaggtgtgagccaccatgcttggccaactttggtctgttcttcatgagctgtttaatttctctgggcctcagctatgtcattttaatcattatttgtttagattcatataatttaactctagcattgtcatctttctcaaaatccttctgtcttttcctgatacttgtccctccagccccatacatccttttctggtgtttcctacataaagtttgctgctagcaagctctcaataagttcacccaagttttagctaataatttcaaatacactcccaaatggatttgcattactagaaagagttctggatgcttgaaaagtcttataactccaaagattaaagcttcctatggatgggagatttcatagtgctcattaaggatattgggtgaaggggctctactctggatcttctcctcccaccacctaaataactgtaccacatgcctttaggagggtgtgtgtgtgtgttacagaacatggtctccaattcttttgcttttatttccagccaatgagctcagggatgtgagttggatagaaacagtcggctagactaccgtgagatctgaaggataggtgtttattttagtacgtttattcagagaatagcaggcacctaggaaggaaaaccgattacagagataaaaagcagttaggatctctcggaaggataggaattcatgtgcattcagaaagaaaaaaaaacagttgttcttgtgtgtgtaaggaaaatcatctctgtggaaataggttgtttacgttttcaagtcggcaaattcccttcacagccacaccacgtatcaaatagagaagggagacttttttttttggtccctggtgtgcacaaggaggatcccttgagatgcatcctcgtggagcaggaaagatcataatagcaataatgacaacaatgcatcaattgttctcaaaggcatctatggggcagagtatgcttttcaaaggacattcacttctattccatcccatttgatcattatgacaaccgcaggagggagataagatgggtttcattatcaccatttcacaagtaagcatcctgagatggggacaatgtagagttatttttctggaatcacagagctagctagtggcagctttggagccagagcccagttttttctaagaatttctgtcacataaatggattatgtgtactgcatgaacacagaaatgcccaggatgtggagaaagcccaaacctctctcttacttggaagtctggatcagtggttctgggaattcgcagatttgcctggcagttctcttaagaggacacagaaaggccaactgggaaatcccttaacactagttcattgataccttgactatcttagccaggagaattggtgtttttattttccctggctagctgttgggtttgtaaatctccagagataaattaaggatttgttcagtggccttgaatgaatcatgaattgtttcataattgtttctttatgcaaagaagagcagaagggagtattagtggcctggttctttggacggtgtgtctactgacctggtatccaagggatgtgtttgctctgcttgatgaacagagaagaaagaagaggaaaggaaagcaatgctcagctcttccatgtaacacagactactctgcatttgttatcccatcagctcagaatgttaggtggcaagggttttggagatctagtgcaaacccctcactcagagaagggaattgagactcacagagctgaagtgtccacctaaagtccagggaaccagttaacaacaaagctgagactggaataaaaaagccaataggactagtttctagctaccattttcttagaatctcctttgtgcttgctacagtgatgcacacttgtgtatctgttgctctattgtttcttacattccccaaaattgagtcctattattccagtgttttagtgagggtaagttaggctagtttgaggtaacaaagtagcactgcaatctcagaatcattaatataacatagatttatttattgttcttgctactaatttagcgtagattagtgggtgacagatgcagcatgtatggaagtgcttcttcttgtcactgccaccaaaggacccagactgagagaatgtccaacttgcagtaggtgcacccgagagcacacatctctgggtttgctggggcaaaagaagagaattcccttctctgtcgttaggcccataagagcttcacatcgctttttctcatagccccttgatcagattagtcacacatacccatccaactgccaaagagctgagaagtcactgtcttcctgtccttcaaaggagatgaggacagacactgaggaacctgagagatgacagccactttgatcttcttgcttctactcataacctttaattgccacatagcagacaaagtgatgtttttaaaataaaaattgtattttatatatataaatatatttataattatgttatattacatgttttatttataactgtatattacatataaattatatttataattatacacataactattgatacaatatattaaaaatatattataaacacataattacatatatacaattatatataacttctaggaaaagtaaattcatatatatacatacacacacatatatatatacataaattcattattatttcacagctctgatggaagttccttccgactgtatttccttcctatcatcttaagataaaagacaagccactgtgccataaggcctctaggcctgtgtggcctggccttttctattctcatgcttcagtcccctaaacgtgtgctgtagcaggcatgctttcttccagttcttgcatattccaagtgctttctttgctcaggttcttgacccctgctttctttttgcttggctaattcttatgcagctttcacgtttcagcttcagtgtcatctctgacctgctctacgttccatgcacgtagagagcatgggtattttgttctccattatagattcagcacatcatactgcacctggcacaaagaatatactcaataaatatttgtttatattaattaacaaattaataaatatttgttaaatgattacacgcaagaatgaatgatcagaggcctcccatatacagcactatatgtagtcttctaaagcacattgacatagccataacagataaatcagtcacttagaacagcaaccatttatattcttttatattcttagcaatattattatgataaagatgcccacattgcaggtaatgataattccaagtgttcgcaattcatcacctgcctactggacattttcagcatacaacatattattatttttagtattaaagtacataataggaatggaaatctaaggtttgagtaacaggaaatgtgcaacatattttcaaagacagataccaccaattcagcctctctcatgagaccaatggagtgatattttccaaataaggtatcaaatgcaaagtgacaaaggatttttgcatcatttccaaatgtggaccagtacttaagaagagtagttttaactccctacattgacatagctaaggcaatttgatggttcggaaggacaatggcatggaatatgtataattagaactgtcatggagaatctgagacagattgttgtcatctagtcagatctcaacagaagaaaagtgattggaagcctgatatacctattttaaaaggtacaatgagtggtataattaaaaaggttgggtataagcttgacgaagttagcagatactcattaaaaccatttcagtaattcctataataatactggccatggttttaaagtcacctagtgaaagtcattatattgaaataattaaagaaaaacttcatattgtgtttccttggcaatagaacattcagatggagccacactaaatatttttctatttattgcagccatctccttaatgacacttttcagcacatattatacattaaaattgtttatgatattttgttattgctgaatttgatttaattacatcagggcttaaggaaaaggagtctaaactgagagagttcatgaagacttcgttttctaacagtttagcgaaaggtctttcaattcccttgcctctgcttatacgcctcctgctccccactcctaaaaccatacataaaatggtattgtccaatctcttcttagtcttaccttcactaaaggctgtgaactgccttcagaaatatactcgtaaaacttacacagactctcattaggaagctgctaccctccactcccgtcacagcttaactccaatctctttggtcttttaaataccttgtttcctctccatctttaagagacaaatagatatatctttcaagaatgtttcaaatgagaactcataactttcttgagggaattctcttgcccacttggaaaatagcttctctggcaggggttgtgatttccgatgggggcgaagtcacggcttttcgcaactactctgtatttttgttttaaatgtacaggaatctcttctaaagttcagatatagacttatactcccctgacatactcggggggtctggatattttcggaggttgaagcattcatattccatccagtggtttgtatgaaagtagagtcagcgtgatcaacactggacactgggaggtgactcttggacagccaaacctctcctttctgtgccagcttcccccttaggaagaccctactataccattgtcaggaattccggaattccatactcccttcctcaaaacccccctttttcctgaaatccactctcaggaaaacaggtaagctcctttcaatatacaaatgaatcatcagatcttatactctagctttcctgcagatatttgagtaattgcagaaggctaagctttaagttaaagaagttaatctttgtcatttataatagaaaaaaaataaaagcaaatgactaacagggaagaaattaagtaagttattacttatacctgatggcatgttaccaaagcacattgacagaaagtttaaatttttttcctataaaattattaaacatttaaaacttgtagaatattaatggcaaaacatgcttatgccatatgttgagcaaacacaggaggaaagagtataatacgataaaaactatttaaaatgtcacagaaaaagactagaagtgaatagttgcttttgagtaatgggattatggtttttattttaatttaaaacatccctttattattttttgtaacagggaaaaatgtaagtgtaaaataaagaatggattctcaatgggagattttttttaaaaaaccagtttctgcttgaatatatatacatacagttttttttctttctttctttccttttttttttttttttgagatggagtctcactctgtctccaaggctggagtgcagtggcgcgatcttggctcactgcaacctccacttcccgggttccagtgattcttctaccttaacctcctgagtagctggtatgacaggcatgtgtcaccatgcctggctaatttttgtatttacagtagagatggggtttcaccatgttggccaggctggtctcgaactcctgacctcagttgatccacaagtcccagtctcccaaagtgctgggattacaggcatgagccaccgtgcctggccgaatatctttatctactaacacctacactccttatttggtggggaatggcataccagttctccccacatgctttccagaaggctgattgagtggaacacttggagctgatgacttggatttacataagtctcatcttactaacacatcaaggcttttggatttaaacctcttcagcatcctctgtatccctaaggaatgcagtttctgcccctcttatccctgagtatagaggagaataaagctttggcatcaaatcgccttcagttgtggttgaatccaccatttgctagccgtgtgaccctgggtgtctacttaggcaaggaagacaagctttcttatctgtaaggtggtaatctggtgaaataaaaatgagaaaatctatgttaaaaaattcttagcacagattctcaaacacgaatagttacttaatatctcatgactcattattgcactatgcctccaaaactgaatgtgcctcatagtgtgggttttatcaagattgggatctgcctctcatttcttaggatgagatctttcttaggaatacctgtggctctatttcctccttccccaatcatgcctgaaaccttggattggcaaagtcctgcttcattcaaataagccctgggtttgctcaagagaacagtggcttatcttttccaagttaatagaatacaatttaaattacgttttcaccacaaagactgagttaatcctgctagaggctttttccatttcctgaccaatacgatttggcactggaggagactatggtatgttaataacagtattaattgttaaaattcacttgttacaaagttttcattgtcttggtatcattataattttccttttataaggagaatcgacttaaatcacttggctgctctttgttcttcctgtttgctaagcactggcgacgtcttgttttcagcacttaactgagtgcacatctcagctctcacctaaagcctttgccaaggggctaatttccaacattgacagcatcctccactcctgcgtccctgaagcaaagctaaagaaaaagtaggaaatagcaagagggaagaagtaatttccttcacttctttctgagtctgttcattccttcttggaattcagttgagggttaactgtcttctcctttcctgcgaatgcttcacgccgcctcctggtgaccaaataaagccatactttttttgctgtctttggaaatattcttcatggctcctgtgggctgtgggagcaggaagccaacaaaagataaggtctcaaatctcttcaaacagtcctcacacttgctctgctgccaagtcattaagcaagcaaactcctctcccatacgggctgttaacttttatttgtgtagtgctgcttttaaacatggctggcctgaactcttttttttttttctccttgtattgagaagaaactgcccagcatctgctttgatcactgcaatgtctgctagtctactagacttttggcctatctcagatgactctttgaatgtagcttgttttttttgttgttggtggtggtggtggttgtttttgtttgtttgtttagcctcattcatgtattcattcattcaggattcatttttctaattcaacaaatttattttaatcagctagtatttgaccattctagatgttaggtatatatcagggaatatagcagttaaaaaaaaaaaagaaaaaatccttgcccttctaaagctcactgtccagtaggggaagggagctatgcaagttactgcatatagtgtgccataatgtggttaagtgctttggggaaaaagtagaacagggtaaagaagatcagaagaatcaatgggagaggtctatcattttaaatgaagtggtcaggatgggttccattgagaagtgaatgtgagtcaagactcaaggaactgcaggcatgagccaaaaagccccacgaggcaagaacgcttcagatcctgtgggaggaaaccaagacatagaagcttttgttcatattcttggcagtatgagtcattgggggaacacagactaataaagtatgtttcttgccttcaaagagtttatagtctaatataagaaacaggtccaaaataggcaatttcagtagactgtgattgataaaacacttggctaaggatgctttaggggcataaaatggtctgaagaaggtgatattgttaatggcttctctttgtcagcatttgttaaatggccttttgtagagtatagaccactaattacagaaaataagagtcattggggggactcaaatttgtttagcaaggtctatataagttaaatgatataataatatattaaaatttatacattaagcgtaataattaagtgctcaatttattgattatatttatataagctactacatagcaatatattattaatttatatttagattgtctcaataggattaattcatagattgattattttaatgtatggattatgtaaatgtagttcattatgtttatgtcaatatattaaatttttttttttgaggcagagtcttgctctgtcaccacactgcagtgcagtggcgagatcttggctcactgcaacctccgccttctgggttcaagagattctcctgcctcagcctcccaagtagctgggattacaggcgcccgccaccatgcccagctaatttttgtatatttagtagagacggggtttcatcatgttggccaggatggtctggatctcttgacctcgtgatccgcccacttcagccttccaaattgctgagattacaggtgtgagccactatgccaggctctcaatatattaaaatatttgttaagtaatatgaaattaatgtattttgtaaattaaatcattaaataattgataatgagattttgtgtatttaattacattttatataagttaataaattttaaatattataattaatttcactttcattttaactacttttacagtggccactagaaaatttgaaattacacatgtggctgacactttatttctatttgtcagcactggtcttgattcactgaacagatggctggcttcctagttccttacctcttagcattccagaatgaacaaggttaccccaggtcactgagggacactgttgaggagaaaaagttggattcattgagatcaacatacaatgtctttccaactgccttaccttcttcttagtaacctgatgagtacttctcatgcaggggatttagataaaactttcttagactttctgtgtgaactgttagcaggtacatgaatttatgtgattcttcattctttttgcaaaaaaacagtctaagttttacccactctataaagtctgttctctatttttcagccgcttgtggtgttcatttaccattcaacacaggttaagcactgctactgctgattattataataattattattttgcgatagttttggttttacctgcaagaaaactcagtctagttttggatttctttataccgcaacccatggagcaaatgttactcatgtaaaactctcaatgagtgtcttttatctttgctgctgccatttcattacctgggacatttgtgccttgaattgtgtatgaaattctactttaaaacagattcctggtttatatactcatattgatggtctctattttattccttggaagcagttctgtgttctgtttcctctgtccccacccacactatacagttctatcattccattcttgagagtcataattcagcattcccccctgtatcagtccattttttcattgatataaaaatacctgagactgagtaacttattaaaaaaaaagagttgtaattggctcacagttctgcagaccgtgcaggaagcatgatgctggcatctgcttctggggaggtctcagaaagcttccaatcatggcagaaggtgaagggggagcaggtacatgacttggtgttgaaagcaagagcaagtggggaggtaccacacagttttaaatgaccagatctcatgagaactcactcactattgctaggacagtaccaagagggatggtgccaaaccattcacgaaaaaatcatgatccaatcagcctctgaccaggccccacctccaacactggggataacatttcaatgtgagatttgggcagggatagatagccaaactatattactcatgcagccaaacaccctcgctggtcaatctccttacagtgggcctgaagctctgaaatgtttttctggtctgaagattttgaatcttcccttgacagaacagtcaagccatactactcaattttaaagtggctggtgacatccgtatctcctaaggcaaagtgttctagttaatgatttgccacttctgctaggtgtgcacacttaattgaggctctgtatgagtctgatgctgagattagaagtccaaaagtcaccagaaattattacctggcataacctcgttttcttaattacaaagaaaaattaaatatcttctttccttggctaacaaaatagagaatgtatgtgggccataggcctgggaaatttaagatgtgatctgtctgttggattttattcttattctgatccccagacttctcactaaggagagagaagtccatttattagctctggaaggcaacatgattctgtggtaaaagcatggattttagagtcagatacattttaaatcccagcttcattgcacacagctgtgtatcagccccgcatcatgtgtgtgcggtagcacaaggccccatcaaaacaggcagtgcccctgtggtttaatgccctgcagttgctgctttgagattcttcataattttactttcgaatttgtggttcataagtgaagcccaatgggacgctggagcaagccctgggtcgctggccttctcacctcctgctacttccacccctccagggaaccactttgctgctcctccactcctgcccagtcacggctgctgctgctgcccctgcagggtctggatgcaggcatgggaggcatcggggttggcacctgctcccagggagtgtgacattaaatagcaaacaaaagcacaccatgcaggtcaagagggagaccacagaagaaaagaaatagctttttttttttcctttttccataaagcagctgcattttgattttgtcctgggcatcacaaattttgtagctgaccctagctgtacaactctaggaatgttccttagccatttgattttctgtgtatccatcagagtaatggttcaagcagaaaagcaccctaagatatgcctgtgtgtatgtgtttataaatatataaatatttgtgtggatgtgtacttatgcatatatgtgagtccagtgcatacataggtgacataagacttcagagattgtttaactgcttacaacaatagtagtatacctttaccagcacagggcagaatggctgtaagaacttcaaggttgctgaacctgtcactgtggaagagtgtagaaatggaccactgggcagatattccctctttaggggagcacagctactgccacactttgacccagcaggggtgggctggtgattgcattcaccgacttttctcctctgattctctcacctcatgctggtgccttcttctgatagaaaaaggaccagcagccccactgcagggaccacagttgacgtggtccctggaggccagccttccagggatggagtggggtgaggaggttggctagtagatctgtagggcaaataaagaatgcccagctcacctttagcagggttgctttgaagattacataagatgaaataagtaaaaccctttataactggaaagacagaggcatctattattaccgttaagatgattcatctctatggagaaactggagcaagtttgagttcaggtagtgggattggaagagtaaagaaagttctgcggcattcctgattccgtcatagcaccatgctcagaaatggtgatgtcatgttaaggtacaaaataaaattccagtgacacagcctcaaaattagtaacacagagatgggggtgttgcgacatctgggttctcattctggctctgacacctttctgcagaacaatcacacaagtcacttgcctcctctcctcccctccttactcgtctttgagaagggcgggctagttacaggctgcttgtgaggattggagagatatctagaaactgctctgatacaagccacagcttttatgagcgagtcttttcctgggccaagcatggaaatctaggttggtgggtctctgaagcagttggttgtccctaaacagcgacttcatttccggagctactttttaagtgttggtgaaaacacaaataactggagactgtgaagtcttttagcgccgggacctgtggggcagtaacctccaacaggtagagtgaaatgacatcctttctctccacgcctgagtgttcctatggcaccagttgcttgtaatgggtgaagaaaaaattgaactcgtttctcctgagacacacatacgaaagctgactctaagaaagaaaaactgaaatgtggaccatcttatttagttccagttaaagagagatgtgtttaaagcactctgatgtgtggccttaaaaaaggatggggctgcctcttaaggcggaatcacacgagcacatagaaataaaaatcaaagcagttatcatatttaattttcttactgactagattcattttgcattagcaggggatggcgaaggagagggactgggaatgcattatgttcttatttgggtcatttccttgtgctttggggaactttctcttgtcagcgtgcacatgcatgccgggggtgggcgtgagctggccccatgcactcactggcttctttctcggtgtcgtatgacccaggagggagtctgcagcatggggtgattctccacatagagagtcattcaccactctcaaccccgtctccaggtacttcctgtgttcatttgagaagaggcagctgacttaaagcctcatttctaagcagactattagaaaacatgtccgcataacctggagcggcagctcacgcctatagtcccagcattttgggatgccaaggtgggcagatcacgtggtcaggagttcaagaccagcctggccaacattgggaaaccctgtctctactaaaaatacaaaaattatctgggcatagtggtgcacacctgtagtcccagctactcaggaggcaagggcaggagaatcacttgaacccaggaggcggaggttgcagtgagctgagattgtgccactgcactccagcctgggcgacagagtgagactgtgtgtcaacaaaaaaaaaaaaaaaaaaaaaagagagagagaaataaataaaaaagaaaacatgtgggtacaaacaggaagagagagggcgagaggggcatcctggttggagacagctggactcacacatgcactttgtagccactcaccataaaggcagccccaaaggctctgagagctggagggggtgtaagagatcctatcctggaaagctcccatttcatacacaggcagacagcctgtgaggtgaatggggtgacgtggggctggaagagaagggcaagggtcaaaggaaagcattttacctcctttagaaaccatcatgcccccaaacctaaaacttagggaccaccgctgccttcatccatttgtcacctaattctctaatattccagtcttagtatcttttgagcccattttattcttgccctgtctattgccactgccttagcttctggcctccctcatttttcatttaaatgactgcaagtcttcaccctcagctttctaaaatgcaggtccggagactttactgttcttgctatatttcctcaacattcccacaccattctcaagacaaatcccaagggtgtgagcataggacaaagggccctctccatgatttaactggcttttaagactccagttgcaccacattacatatttgccaggcacagttctaagttctttacaaatgttagatcatttactcctcaaataaccttgggtgatgtgtatttttattgtctctacagaggagaaaactgagacacagagaggttcagtgattttccaaaggtcacacagccagtaaggagcagggctgggacttcgaccagacatctgctggcagagtcggtgcttttagccctggcacctgctggtgtggagtgctctgtatgaatcagacccttcctcacctctggcactgtacacaggctgtttcctcactttgaagcaacctttgctcctttctttgcctgagcatattctgtttgtttttccagattcacctcaagtaccacacagtgtctttcataaaacaagaccctgtcttacttggtttctgtgacacattataccagattgaaattactgattaatttgtctgtgtttccccagacaacctgtgtgtctctcaaggttagggacagtttctacctttctctcacttgcaactgaatcatgggggcacggaatgaaggatggtgcaaatggtctttcaattcttgtctctgactgttcagatcagacgagttacttatctctgagatgctttttataatagaggtaaacagagttcttcctacagcacagctattgtgaaaagcaagttaaatgatgactataaacccatagccctggtctggcacataatagatacaccacaaagccccctctgttgagtcagtctggtgtccttgcaatccatcctccactacactcatttttttctaagctcatttctccatctggactcatgcttgctatcaaggatgatctccccacttctaccatcacaattataaaaattcaaatccacctgtccactaagccttccttaactgtgtagctcgctttggtctctccctgtttcctaaaacatattctcagtgtcaacattctctggaatggtccccatcatgcccgctgcccccctgcctgaaaattttgactgtggatttatgtctcttatattctcaatgaggttgtatcctctcaagtgatcaaggctataatttttatttctttaccatatttacaactctaggagaatgacacgtgttctccaaatagtaaatacttgcagagctaaagtgaattgaagtgaattcctttcccaggtactttgctgcctcctagtgttgtggtgaggctccaggctgagagaagtttcctctgagctccagctcagccagcacccttctgagtgatgaacactgttgcagaccatagacctgagacagctggctgcggtttgacacagtttagaagatgctactacatcagaggcctctcttgtccattgggtcccttgtagtggacccctttgctttactcctgaactgagtatcagtagggcatctgtgcagggcttttaaagacttctttcctctctcaaatacctcccttcttcccagtttctgacctggttactgtttggagtttttaattccctctgatcttaaggttatattgcagttcatgttaacattcaaatactattgagaaaaataaaacataaattttccagttatctagattgtaaatgaatttatgatcctgacgagaaaaaggcatgaaaggtacccactctatgaaaaagtaaaatggggccacgttaatgagacagaaagcacaagaagcagaaagccttgtgtatgtcatagattaaccagaagttgtttcggctaggtaccggcagagacaacatggtacagtggaaggaacatggattttggtgtaaacactgaattcaaatcccagctttttcagctgttagctctgtggtgtgttaagtctctcagatcctcagttttgttgccagtgcagtagggcagcgatgcgtagctcagagtgtgtcatgaggattggatgagacaatatatgccaaggcaattaatacgatgctaaggggtttgtgtttttgaaatgcaaagagtttagttttgtattgattcccattacaagtttgctcctgtattttccggctgtctagtccattcacacatcttcatctcttagggaaaagacatggtgtctttaatgttctctgaattagcacagtgcctggcacttagggttgtagtaacaattatggaataaacgtaatgcctacagctaaagatgctgaaactctgtgactttccattatacattcttttttctttctctttttcttttttttttagaccaagtcttactcttattgcccaggttgcagtgcagtggccccaacttggatcactgcaacctccgtctcccaggttcaagcaattctcatgcctcagcctcccgagtagctgggattacaagtgtccaccaacacacctggctaatttttttatttttagtagagatggggtttcaccatgttggccaggatggtctcgaactcctgacctcaggtgatccacccaccttcgcctcccaaagtgctggaattacaggcgtgagccactgcaccttgcccattatacattctttctattctcagtttttatctttaatattttagagtcggagactaatgactcccacatcagcaccccaattaaatagactttttcctgtttatcacctttcctttaatttcctcattcaaagcattattcagttgtcctctcctcttgctgcttaagcctctcaccagctctcagtcaatgctcccagatgcagctttcattgcatgtgatgttgtttaatttcacttgtcttatctataatcacatcaagccatttatttgttaataggctgtttggtggcttcacagttggaattgctgtacatcacatttcatttccacaaggacatcctttatgccggtctgccttatgtggcattcgtctcttcctcttgccaggctgggccagcttctcccgctgtaccttccacatcagctgttcattttccccctgctgctgtcactgataatttccaggttaaatcttataagtggaaattggatccacagctggagttgaaacgcagctccttggagttattaccacagtctgttcccgggtaggtgggaaagttgaagatgatagatttccagtgcctgggaataacaatgctgtccctctaaccacaactaaggtgagattactttcccctggggagagcgatatttttaccttttcactctgagtttacatcagggggattcaagagaggcgagtggtttttcagtagttttctgttattttatgagagatgagttaaagtgataatgtaggctggacagcaaataagttataagtgattgaccagccttttaggctgtcagctatctcaaatagaggctttctttatttttttttccacagtagaaacatttgatttatttgattcaaacagtagaagtatgagaggatcaaataaataggtttgttcaagaaaaaaaaatattttagtatttcatgctttcaaagcctatgccataacctttgaattattcagcaataattaattcaacaactatttactgagcagcttccactgtttcaggattggaaatatcagcgcaatagatcacacaagattccatctttttgaagctgggcttctagtggacaagactgataataacaagacaagatacataagatgatttccaatgtactaggaagaaaagaaaacaggaaaatgtgagaccatcttgggtgagatcatcaggaacaacttttcataggagagttgatgttagtgaatccataattgctaaaggagatttgagtaattaaaaggggtccgggttgatctatatctctatttcttttctctccatcccatgctttcctctctgacccaccccagcccctagtaaccatcctgaggtcagaaatatcaagataccttaaggggctttctccttaagatgtcaacaacatccactgaggactgaatagaagatgccagcgcttggctcaggtgcaggggatggcaagagctgagctctgggctgtgaggagttctggttctggtctggcctcatcactggggctgtgtcaccttgggcaggtcttgccccctttctgggccttagccttcattttcatttgtgaagtcagtgtgatcagatgatgtatgaaatttcagaatcgtatagaagataacctacctattaccttaaacagtccgcgtgggaggagaaggtagcaatagttgacatgaggttgtgagggatcaaaatgaggctctcagtgctaccctacacccctcaactttgtcacactgaatctgacctggaaggtacatgtagggacagtttcttatagagaacacactatctaataagtggagacatggcatgtcctcaaaacatctcccttattgcccattccgggctttaacatctgccccttccaattactttgactcttcaaaggttttcagtgcaccttaaatggtttgtacatcttctgcccccttggatacaacagcatgcacggacatttgcttttctgattaatccctttgctaccaccctcaactcaaagcattacaggtaggaaaatggactcaaagatatacaggttaataaagagaagaggggaagagccaggagcacaagcagtgtccacgggctgctggtcccagccagtgagtgagcaaacataatggacctgggcatcgaggttgggagaatgctgaaaaagaaatgccaaagtcaatttaagccatgttatcctatttcctgggattggtgctgggtactgaacagaggctctcagccaacccctacctcacccagagcacagtatagagtatagacactgtcttgtacacactcagaatacaatagtgatgtgtttctgtgtgcagccctggactgtgtgaagtggcttctcctggacatgtcaactctccttgcttgtggcaggacatcaaaattggttagactgaaagtgtctaatgagctactcccatatgccaagcaccattttcagcaacagggactcagcagtgaacaagactggcaagatctccaccttcaagggtcttatattgtagtggggaagacaggaaaaaataggcacataaagaaaagcaaatcaatacatttcagttgctgatgaagaatgtaatgtggataagaaataactgtatgggtatttgtgttgctttaccctgcatgattgggaaagtctctctgagggatagatatttgagttcattcattcaacagagataattaagtaccttctatgctgcaggcccttttctaggcagaaaggattcattaatgaataaaccaaacagccccatacacagggagccttctttcagcaagaagagacaaagaaaaaatatttaaagtgtaattttttataataggtataataaacttcatatttaatgatgtataactgatatataggaacagtaatcattcttattgctttattgagcaatgcacatcatatataagtgtagttgtaacccaaatactaagagggtggagccacttaaagatttggataaagcacgtcccaagaagaacatagtatcctcaaggcacaagtaacatcctatgtgatggaacacttgggccaggaaggcatggatgggaagataagaggttgaagagagagccaggagccagatcatcaagccttgatttcatccaagtttcaagggaaaagcctgggaaagttttaaggagatggcagaaggaattggagagatctgatttaaggtttagaagattctctctggcagttggtggagcatcaacttagggacaagaagggcagcagggagatgggtgagggagctgctacagaggtctagaagagagagggtggtgacttgaactagggctgtagcaggagaaacagtgatacatagatgatacatatatatatatatatatatatatatatatatataggcaaataatagatgatagatgagtaaatagataatagatagatagaaataggtagatagatagatgtagacctgacagcgtaactactgaattggttgtaggatgggaaggaaaaggagaaattaaggttttcccctaggtttggcctgaagagttgggtgaatgttggggccatttatagagagaaggaagactttgtgggtagtgaagagggaatttggaggacacaagtaaataaatagctcagtgtgagccttttacagtttgactttatacagtatgcaaatgaggatgtgaagtaaatagatatgagactacagttttgaggagtggggctggtatttggaaggcatcagtggtgaaatggcatttaagctagggggaggatgagagcaactaaagaaagtgtatacatagagaagaggtttgaagactgagttctgggacattttcagatttggaggtctaatagatgatggagtcccagcaaaggagggcaagaaagagtggattttgacagaggaagaaaactgagtgtagcatagtaaaattctagattcatgggaaatgttgctgaaaaggtaagatgacagagaattaaacattttccttgagaagggatacagttaccgattacctttaaagagtgtggtggaggaccaaaaccaactggagtggggtgaggagaaaaaatagaaattagggagtgtcaacagatagcaaagacagcttttttttttttttttttttaagaattttgcttagaagtagagaaaagtgctatttgttggatctctagttggagtcaagagttaaaataaattatagaacaatatgtaatcataaagaggtgagaaaagtgtggatgaatgctgtggcttcctttttctctctagtagtagtccctagttggtctgcaatgaacttttgcaagaacgagagtggggaagactcttcatgaggctgataggctgtagctctcatggtttgtctttaacccacaggtagtgagcaagccatttgctctcagggaaaatgtggctttcctgacagccccagatgatccatctgtctctgcagcctataggtggggcatattggaaacaaagcatttaataaaatgtaatagttgtgactcgggacatagaagaggcagattgaaagagaagtggagaccaacacgccatctttccacataaatggcttcagaaagctgcagactcagagtggatttgttcgtgcaatcctcacctctcctactagttaacaagtcggcaagccagcagtgagggtttggtttgtaccctcagttattaaccattagtatttgtgtcatgtgcttttgcctgggaaggtgtccagagattggagagtagtgttcagtcttcagtgggtagaaattgatcaactgtagaaagaaataagttatcatggatatgtacatcagctgtgtcttgtttctaatggctcggctcgcgactagctgaaacaatgaaaggaaaaagtgtgggtaattttcaagtaattgatgtatttggggctcatgtaggccacaatcatgatagtcacctaatttgatccttatctcagagccaaatcttctcacagagttgttgacatgggatgtattttgatcttgattttggagtcttgaattctttttccaaatgttcattcttctccctctgtatgtccctcagcactagattttatcatcaggcacagaacatctttctgagtaatctcttccatactccaggtggcgaattaaaaactatgtgaggatgactggaagtaaaacatttaggcagtacttgctgctctggagacattcaaagaacaataaacacttctaatgtagtatttactgacctccagaagtgatagctgatagtgaagacagagtgcccgggcgctccaggctattgctccatgttgagattggctgagaggtcttcggaagtcctcagattgaatggtagtttcactttaaaccaagcaaaaattgtcatcaaaattcatgactctctcctaccccagctttcctccaactaattgggctctctttctggtcttgaatgcatcgagtttttatttgtctcagtgcctttgcactttctgctctctctactacaaagcccttcccagggccctacacatagttggttagcacattctcgtctttctggcatcaacttaaataccgtccccataaggagatagtctttgaacaatcaatttaaagtaatccatccatgccttttattttctttatgacacttatctcaactttgttcattttgtgtctcttccatcaaacaaaaagctcctctaaagcagaaattttcatccttcctgctctatgctgagtgcccagcccaatggcagacacagctgacactcagtaaatatttgttaaacaaaatggcaagtgtgagtgctgtagagtattatatgtttaaatattaatttcaaagatttttaagacttttgttgacttcttcaacacattctcctcccatgctataagcatctgggggctcttttccacctcttccctctcccatcacaatgtctgacacataacagatactaaacaaatatttgtggtatccatgagtgattccaattaatttgtattgggtatttcaatatagtcataagtacatctccatgtccaagtatatctccatgcccaagtatatctccatgtccgagtacatccccatgtccaaatacatctccatgtcgacatacgtgtccatgtacaagtacattcaagtacatccccatgtcccacatacacctgaggataccgaagcttagtgtggtgggcagaataatgccccttcctcatagatgtctataccctagtccctgggacctgtgcacattgccttgtatggaaaagggattttgcagatgtgactcaggtaaggatcctgaaatggggggattatcctggattgtactgttaggtacaatataatcacaagagtccccgcatgagggaagcaggaaggtcagaacctgagaagaggcagaggtcagagtgatgcagttgctccctggaggacacaagtgaaagaatgtgaacaacccctagaagtcagaaaaggcaaagaaatgaattcccccttagagattccagaaggaatgaaatcttagtgacattttgattttagcccactgaaatccattttggacttctgaccttcagagctgtagataatacatttgtggcattttaagcactaattttgtggtaatttgtcacataagcaacaggaaactcatacacttagttcctcacattgaaccctacccactctagctctctcgccatccctgttccctattagctagattccccaattcacacacctggaatctccagagagggagttctagagtgtgggactctcccaccaatctgtgtggatcatgagtaggtagatcagagatccatggaaggccatcaagaccatcagtggttggagtaggtcatgaacgtgatagggccttgagggtgagtagttactcctctcccaatttggtaaagaataaacttcttccaggaaaatcacagatattgtcatagactgcaagaagaaaaaaagcaaaaaaaaaaaaaaaaaaaaacaaaggaaggaaagaagaaggaaaggacagagagaattatgactgtgttgtgtctttctctgatacacactcctggagcttctccaagcctgtacttgccttctatgccatatgcaaatgctgtagaatgatttctttcagtgctaactttatttaattctatcatcatggtttttactttaggaaattttggttccaatagtttaagaataacatggaactgaccttagaaattgtctaatccatattgtgactggcattatgaaaaagctattattggtgaaccatggactgccctgtgggagttgggaggagaaggagggcagaggggcagagtggaagaggagaagcattcacagatgaattcaaggtctttgcataaatgtgaggtttcttaccactataattttttttaaataaaattaaagaagcaagcaagcaaacaaaacaaagagaagatggttcctgaggacaggtgttttatctaagacatgttggatgcccaggatctccttattaggacttaggatattaggccacagaaaccaaagatttgtgagggagaagttggggaccagtgtcaggtagtcaggcctttgctggtaggaagatggggcttacataccctatagccacacaggcttggcactggtcctgggtgaggagagagtggggcccaggtataggccagccaggcttccccagatgatgcgtctgtactttccagtctcactctgctcccctcaccacctctccacacaagcctcagttctcagtcactaagcagcattgagaggcaattacagggtgcagaactctgcccgggctcctggaagaaaagaatatgtgccatactgtgctaatgcaggctcttctatcatgcctctaataaatgggttcaataaataaatgggttctataaatgggtccacaagcgtatgtttgattcactatacttcatgttgtcattttcgctggctccttggggagaagtctcatgcttcagggaaaggcacgattcaccagaagccccacctcaaacttcctttttgtttttgtttttaaaaatgaacttttgtgttctcacagctccatccagcagggaatcctaaggaagctctgaggagagccacagcaccccctttctcctgcctgggtgtctcctgtccctccacaccagctccgtccgctcctttagtttggaatatttccttaacagacctgtaggctctgcctccctactccctcctaagccctcatccgcaatccacatgtctgacctctccaaatagattactagttcagttggttgctggacatcttagctctcttgctatccatatgatattggacaaggagaaagacagggtttttctttgttttttgtttaaggagaaaagtgatataaatgcccctagtccttgtcaagttttatgttattatcctttcctcaaaatagagcacacatgcacacaccacatacacataccacatacatctgcacacatgtgcacataaacacccacacacgtacacaccacatacacatacacacacgacacaccacaaatacatgtgcacacatatacagaaagtttttgctgtagatatgtcattcctttagcaactattttacactttttggagtcttctctcactattagaaagagctttgcggtttacttttagagaaaaaatccacctcctcctttagcatctagtcatcagttgggagacagtttttttttttcccaattagaaggaaaaaaattccaagtctattttagaaaagaaataaatattctctttctcaaaatgcattttcagccaaaatatgccatctgggggatgttagaaatttcagtcagtttatctttataaactattgaagctgcacctgttataaatggcctctgacacaaaacattctagaaacttcgaaaacaacattgaacatgacttcttgactacagatttaaacttatttcatcatacgtgcttcacagacagtgagctataaggtgtttaattagggcacagcagtcatttaatttagcagttaaataacttcaactaagataacgggttaattttgaggagagtgataaactccactccctaggtcttgttttattggactatggggcttagcccttagcactggattggcttgggaatttatttactgatgaattcaaccaatattacaggtacttttttaaaggcagtcagctgaaagttggaggaaattctgtttcagattctaagaaaataaacaaatctgctcaccttccactctatgctaccttttctattttgagagaataaacctctaaatctttagacttttatgaagaacacttaccatcatttgaatgtctctcttcatttccagtctattctgaaagtatcttcctcccaccactaggctttagtaaatatttataacccaatcatctcaagtccattggactccatcactggtatgtttcaattatttaaagtcagaatagcatcttctgggcagctaatgacgtctcaatagatatacattatcgaaacatattgttatttacttaataaatcaagcctgttggggaaagtagatgcaattcaagtaccagaaatgaggaataatgatggcatagatcatttctgaatcactctagcccattttacagcctgtaaagtacactgaattccataaaagtgacaaatggtacaacattgtaataaatagctatagtttgtgcattgtgaattggagcttagattcatattgaaactctctgtcaaaaaagaagaagatgaattaagtattaaaatcatactctgtaaaaggaattatatattttccatttatcttgatttattatatgacatcatgtgcttaagtatatgtaacctttccaaattgagttgatttaatgtgaagggaaaaaatgttaaaaaagaaaatttggtgtatgtttagaattttctttattttcctgctatatttttataaaacttttaactgttccatggaagcttaatcatattacattttttaagttgaattcccagaaatatgcaataacatctacagggcttattaagaacaaatgtgctaaatcacaattaatatgactgtttttcattcaaatttcaacgtttgcatattaagaacacataaaactggctgggcgcagtggctcacgcctgtaatcccagtactttgggaggccaaggcgggcggatcataaggtcaagagatggagaccatcctggccaacatggtgaaaccccatctttactaaaaacacaaaaattagctggacatggtggccggcacctgtagtcctagctacttggaaggctgagacaagagaatcacttgaacctgggaggcagaggttgcagtgcactgagatggtgccactgcactccagcctggtgacagagcaagactccatctcaaaaaaaaaaaaaaaattccaaaactttcagtgaaatattagctgtatgaagagagtgactacgctgaagggtgaatctagacttccaaaatgacagaccgaggaatgggcatgccttgaatttttccaaatttcctggaatttaagtgatacatctaccgttctatttatcattgaaaaataattcttagaggaataagcacatgtaaacaatattctattgacatctgctatttactccctcaagttaacaatacagccacaaaatgattaagatgaacaaacccaactcttactgcattgcttcctaaggagatgaagtggtttttcttaggcatgtgcattggctccattttttttaaagttggtttgcagcacacttcaggaggccagaagctaaacaagcaagtgtgagcgttagcctgtaggaaagacaaaggcacaaagtgaggaaaagaaatgtgtcttggtcaccctcacctttcccggtgtccaactgacattacaccatctctctgtcctctgctcatctgcctcttgcatgttgcattcttgaagctttcctctgtcattttgctaatttctgggatggagctcgcagctcacccgctgggatagcaggagaatgggtgtgaagtatcaagggctgggttggccacaatgtcctccttcgccttccagcaatcgattcctttgtgctccattttttccaagtgtatcaaatggatccaacgctgtcctgtgcggagtaaaagaggtattctaatgatattctaatggtattcaaatgatattctaatgggaggtgtaattttatgaatacttcttgcatctcatctccacaattaaagcataaattttttggtttgaattctgtcaacagagactattcactaggccccttctctacacaaggctaagttgctatatatgtcctattttatataattatctaaccaagcagaaacgtaaatatatatcttcatttagcttatgaaggaaataatttccaagctcactaagaccatagcagaggagaaagactcaagaccatggttgtctgatggcaaagcacctactcttccccctatttcatattgattctcattaacaactaaggttatttagaaactatatattccatgatataaggtacccggcagatcacaggccttcataaaagttttaagttaataaatcaaccactgagggaaaaggttttttctctgaagtcctgggttttccactggtaccaaggtattaatagtatcttatacatagtagacataagggaaaggaaaatagaggagaaaaggaaaaaaaattggggagaaatgaggtagatgagtgaaggaagatgaatgaaaagaaagacaaaaggcaaagcagggaaggagaaagaatatctcaggaacgatttctgttccaaccattgataaactggtacaaggagtctactgctctcaggctgtggtgcactgtttgttttgtttttgaaattataatgaaagaagagagagatttaaagatcttcactcaccagaaaagttttgtctcctttcatccattaataattttatttaatttcaatcacttagagtggtgtggactaaggatgctcttattgccttcagggaacactgcagaggcctggaatgagttatataagcaatatacaagcaaatgtcaagtgtaagcctcctctaagctcagtggggcctcgtgatggaggttatagcaagaatggctgtgagcctctggttcaagaagggctaatcctggctgtgttcctgttctgccaagacaggaactctgtcactatctccttagccttagtggactagagcattagctcttgtattttcttttgcacaacagctgctgggcttctcttttaggcctcaaaatgcctggtatagtgcgtgacatgaaataagtcctcagcaaatacctattggattggattgattaagtgggaaagaatggagtaatggctttgtcttaccacattgcccacctgatctgttctttctttttgtcccaagcacttaaagcattcttattgagtcatggtgacaagctactctctggataaggcttcttgaaatggattttagtcaagcttagcaccaacggccattaggaagccaacaacacaacacatttctcctctgtacttcgcagattatttagtgaactcagccatgcttcccttggaggagtgaaaacagacatggaaactggggtgaggcacacagcgcagcatacttctgtcctggtgtggacctctgcatgaagaaatgtgatgtgctaaataaattcctatccccaggaggcttgtcttcttatctcagacctgccacctataaactacgtgacttcctggtgttataatttactcttcttgtgccacagattccttgtatttaaagtggatatttgctaagtgtctgctatgggtcaggtgcagtgctaggcacacatggacacttaactcatagaatagattcattcattcattcattcattcattcaatgtatattattaagtacctccctctgtgttccagacactattctggttactagaaatactgcaatgaacaaaacagataaaaataaaatatctttacccttatgggggtggatgtctataattcagacatatgagaaatggactctgtgttcagtagccatgaatactaaagagaaagagaaagcaggcgagggagacacaattttcaggggttcaggttcaattatcagaagcgttttttccttatctcttgtctttagatagcctgcttgggagacaattcactgagcaaaccatgccactgtcaggaagaacattctgggctcagggaccagcaagagcaaaggagctcagccatattaacgactgtgccaggatattttactacacagtgaaaaacactgtttaaaataatgaggcattatcacagaaaaagaaatgatcacatttaaaaaaataaatttgtatgtagaaataattttatatgtgcaagaaagttgcaaagagagtgcagagagttctcacatgctcctcgacatcttcttttcattagcattttgcgttatcatggtgtatttgtcaaaacggagaaaccaactaaattatgatcctgctggtttctccactaatgtcctttttctgttccaagatctaatccataatacaaaattatattcaggaaagtccattttaaacttaggtgttaagttttatttttaattctgattgaatgctatttccgtgtaccaggtagcagttgaaaggcagttggcaaatacttgttaggccaccaagtctcccttaagtgagtcacacacagcaggaagaacaccaggcaggtggtctagagtcctgggtcttcatcccagctcttcctcaaccaaacatgtgtccttggacaagttttcctctggagctgaggcagatttcttctgtacaaaatttagaaatttaggttagatttgtaagatccctccaacctcttaaattctgccctggcattatcatggcatcagtatcttcatactcagaagcatcaaaaattatgtgactgatttccctaatgccaaacgttggttcattacagcaccagagtgggctgagagagcttcagcacaacccttgcctctgactaccatactccactccaggctccctccttcctatctcccatcctccaacagctggctccagacagtaggtgttaacggctgagatcactaaatgaataggaactattcttagtattttacttgtatttcttataaacacccttatgaggcaggtacaatttttttggcttatctatcttggtagacagaataatagccccctaaagatgaccttgttgaaatcctctgaagctgtgagtatgctgtcttacaaatctcacatctgcaaagggattttgcagatgtgatcaaagtaaggatcttttttccttagttggagattagaatatggggagattatcctggggagatagggagttattctggtgggactgatataatcataagggttgttttaagagggaggcaagaagtcagagagcagaggagaggctacattgctgattttgaagatgaagcaaggggccataagccaaggaacgtatgaggcatctagaagctggaaaaggtaaggaaacagattctttcctagagtcaccagcctgtgacataataaaattacattttttaaagctactacatttgtagtagcatattggcatattggtttctacattagtagtaatttgttacaacctcaataagaaatcaatatgcccatgaaagttaaaagaatgtgtccagagctggaaggcattatcctcagcaaactaaggtggtaacagaaaaccaaacactgcatgttttccctcagaatgggcactgaacaatgagaactcacggacacaggaacgggaacaacacacactggggcctgtgggaggtcggggactggaggaagggagaacatcaggaaaaatagctaatgcatgctgggcttaatacttaagtgatgggttgatcggtgcagcaaaccactatgacagatgcttacctatgtaacaacctgtacatcctgcacatgtaccctggaacttaaaattaaaaaaaaagagagagagagatactgtaaaaaaaaaaaaaaaaaagtgtccaaaattgggtaactggtaagtggttcagtctagatttgagcataggccatactgcttcactaatgtaatgaaaaggccttccccatagttttttttcttttattgatacacactattttatatatttatgggggcacatgtgagtgttgcatgcatagaatgtatgatgatcaagtcagggtatttggggtatctaccactatgaatatttatcatttctatatgttggtataaagttctaacttctggttactttgaaataatcaaaatacgattgctgagtatagtcactcgtgaatggaactggaggtcattatgttaagtaaaataagccaggtctataggctttttgtgatgcttgaacgaagtacacagagaatgcaatgcttagaacacacaaatatcattgagttctgtagttaccacaacaatttgtggctctagtccacgatttctcaatcctgtcacactcacccacccatcccattatcgcctcaatcccgagcctctgtcctcggatctgacctgtttgacttttgtaagacgacaatcagaattacagtgtcaaaaatgacctcatgcaattgtacagcaacttatgctattcaccttgcataagtaaacgcgatcatatttagttttgagtcaaacatccttgggaatgagttaaagaatgattcgcctttgctgtaggtgtacctatccctctctcttgctctttctgttcatttgccttctgcattctacctattcttacatgtttgtctctgtatcaccaaatctattttggtcccttcacttcagcctatttcttgtttttgtagcagtccagaacaaagctacaatttattatttaatacataaatagaatttatgtgtttttaatataaagatcagaactgtaggaggttttatattttccttaaaactccaggcaaacaagatttttgactaaattgcttttttatatatgattctgctttttctcatcttatatgttaatagtcttgggtatgaaaagtacttaaatttagagacatggtaatttagagacagaggcctggtttagatatgctgactttttaacactgagaaagtctcttagagtccctgaagatgaaagtgtagattttagttactaattcacctcttgtgcttgttatccatatgaggagctggtaagggacaaatcctgcaagagtgagaaaaagcacccatttttctatttgctctacatttgggcttaaattgctgctaagtcattccccgagggaaatctggagtgagtgcatgttacaaataaacactcccaactttgctttccacagcctcagcattttcagctccataagagacgctctgaacaagcaaatgtgcttttaacttagctctaaaatatgtcctgataggtgggagctatttttaagacaacagcaaggacccggcagactgatatttgctggaacccaaattgcctcacatcttctctgactttgcccaacaatgaggcccatcaggttattattgtcccctgagaaaatatattttgcattgcactgtatgttactgctccccttaaagatgttggacatttttaagctgcgtaatgaggaagagaaagtgggtggcaggataaagaagtgggaaaatggtaaagagtcctgcatgagaaacaaagaaatctttgcaaagtgaaacaagagcaaaagagtaagataatttaaactagagtgataaatcacactcacacacacacacacgtgtgcacgcctatcaacctatcagccatctgttaatcaattatttattaattatctatgtagccatctatgtcaactgtcaatcaatgtatcatttatttatctgtcaatctatcatctaccatgtaggaggcaggagggagaatgctatatttgaactaaagcagaataaaatagtaaaactagtctctgtgtttcttttgtcaaagagggtgaatatgccatgaaagtctaatgggggatgagaagtttgtctccttctcttctttcctctcagcagcaccccctttcccacttcaagtcctcctcaaggccaggtgctatatattgaaaacagatttataaaaactattcaaaatattcctgagagaccaggtttgtcaccaaagacttcccaaatgataacaaatcattttgttatcatattctgaaaagcagaaaatgtggactggaagccaggaaacctggagtgtagtctgggtactatatctcactcaaagataaatgggaaagggcagttctccaacttcaatatcaccgtggggcccccaaatccaaccaacatatctagaagctgtctgactagatgttcgaatataactcaaaacaatccaacataagatcccttaggtaggagctttggcaatgtgtccacagtaggcagaatgatgggggaacttgaaattatgatatgaaaagtagatgaaggtggccgggcatggtggctcacgcctgtaatcccagcatgttgggaggccaaggcaggtggatcacgaggtcaggagatcgagaccatcctggctaatatggtgaaaccccgtctctactaaaaaaatacaaaaaaaaaaaattagccgggcgtggtggcgggcgcctgtagtcccagctactcagaaggctgaggcaggagaatgacatgaacccgggaggcggagcttgcagtgagcagagcttgcaccactgcactccagcctgggtgacagagtgagactctgtctcaaataaaaaaaaaaaaaaaaaaaaaaaagaaaagtagatgaaggaattagagatgtttatcctggaatagaaaaaattcatggatggactatataaactctgtgaaaggctgtcatgcacaggaggaatttgatttgtcctattctattgtaaactggtggttctgacacggcttccagggactcatctactggatcatagttagacccataagtaaaaatgactgctagctgtatactgcttaaataagaacagtttggggtgatacttgattttgtttggattcgtgcccccacccaaatctcatgttgaagtgtaatctccagtgctggagacggggcgtactgggaggtgatgggatcatggaggtggtgtctaatgggttagcaccatcctcctagtgctgttctcctgagagtgagtgaatgagtgagttatcgtgagatctggctgtttaaaagtgtggtgcctcctcactctctcttcctcctgctcctgccgtgtgaagtgctggcttcccttttgccttccaccatgattgtaagtttcctgaggccttcccagaagccaagcagatgctgtcatgcttcctggacagcctgtggaaccgtgagccaattaaacctctttttataaatcacccagtcttgcatatttctttatatcaatgagagaacagactaatacctttaacatacgtgtaatgccatcccctttctctcatgatatgccacttcatagagggcagacgccaccgctaaaacttatggagggaaccagaaagtggtagggtacgtctctacagaaaaatgtgctttctattgatgaaaattctgacaattaattgaattgctgtggtaggtagtaaactctgtcacttaaggtattcaagcagaggtttgaatgaactctctgtcactcaaggtattcaagcagaggttattaattaatataatacaatatttatactacatatattgtgtatatattctgtatatgtagtatataatatttatactacatatattgtgtatatattgtatatatatagtatataatacaatatttatactatatattgtgtacatattgtgtacatgtagtatataatatttatactacatatattgtgtatatattatgtatatgtagtatataatacaatatttataccacatatattgtgtatatgtagtacatatataatatatacagtatacatattgtattatattaatgaataaccactaccatccaaatctgtctctcacatacacaaacatgtatgcacaaggaagaaaataaacatcatgaaagggcagggatcctttctcattataaaaataacatcatcttttgtaaacaatttaactttcaaaagataatacagttggaagtaaccaaattgtgactctatagttaaatactttgaattgatctaataatatagaatgtaaggtgttacctagatgagtatgaaaacagaatgaagcaaactcaccaaaacatgaaataggccccccaaaataatacaacttgtttatgggaaagaaaacacattgtgaagtagacgaaaagatcgtatctatcattctataataatcaccaaaattaattcctcaaaatctcagagttggtagtggcatgaagataaataaatgcctattagaacatgaaaggttcagaaatatgagaaacatgatcagaagaggcagatctctccaccctattcaatctgtccagctcccgtgacatgtgctaaatgagaactattgtgtgagctttcagggaaaggagtaaacctacagcgaatgataaagtctccagatatttgaggttaatgaaggggaaggaggaggaaaaacaacatttgtggagaggctacatgtgccagccatcgtgataggcttttaaaatgtgatatttctcaaaactggtccatggggatgacactgttatctcttcttacagatgaagaaactgaagttgagtggtcatgctgagattcatatcacagcttttagaagcaaagcctgtgctctttctactctaccgttctcgagaatttaaagtcgtgtagaaaacacaggcgtggaacctataatatttaatggacaaacaagtgtattttactttttcatttagtctttgtttgtttgtttatttctgagacaaggtcttgctgtgttgtccgagactagagtgcaatggtgtgatcatagcccatcgcagacttcacctcctgggtctaatgatcctcccacctcagcctttcaagtagctaggactacaggcacatgccaccatgcccagctaatgtttccagtttttgtagagacagcatcttgcttatgttgtccaggctggtcttgaaatcctgaccacaagcaatattcccaccttggctttccaaaacattgtgactacaggcaagagccatcacacctggttatatttgtgtttcagaaattaagaaggtttgagaaaaaataaataaatgaaagatcttcatttggtcaagtccaaatgaagtcataacttacaggcatcttggagtgtgaacaaagagaaagcaccgatagttccacacaatcaaaaggggatttggaaagatgatcctgaaaaaaacacctgggcagggttctttataggtcactttgcagaacaagagaagtacaaggaaaagagaaagatatggtcccaagctatcaaacgacgaagcagaagataatccaaaagcaggtttctcagctcaggaaagcaagaacatgaacaatctcttcaaagggaaatagatcttgggccagctcacctagttcctgagttctagagagttttaagggctgctaggaaagctgtcttgatcttgttagggcactaccctggggagaaaacactcacatatggaagaaatgcaatagctaattcttgactaactgattgataggatgggaacaatgaagggaatgagggtgagaggcaactaatattaactaaaaagtaattgctgtcttttcatcaggagtctgctgcaaaggttgccttactgcaaacaaagtggctgaaaacagataatcctttgctaggacatctccacttttccaaaggatggaggcatcaaagaatgattactacatttgatcgtggtgaaagaggaatcatgactaataccaagagaggctcaagcagataaactgctgaaagaagtatggcattttattccaagtggatcagaaatatcctgttttatgcaatgatggggaagaaaatgaaagactcaggacatttctgggcaagggacagtggtgtcagtgagaaggggcagaccattttaccactttatattacccgcctcatgtgactagacccagtctgcaagcatcagcactgtgatccaataatctgttacaaaattcataggtttttccccctcccattcaaagttcccctgggaccccctatggaaagaaataggaagaggagagcaaaatctccctctctagcagggtcagcatccccgccctgcacagcgtcagcgccgcttgcccaccactctcctaaagacccgtcattatgaaaggaaaagagaagctaatggctgacttgatggaaacattcttggcactgtggacaggcctgcttggaggccctgtctgctgagccttgggaatgtgaagaggaaaggtagctggttaacattgtttaacacagaattaagtcataatcgcacctgaggcatattccagatctttgtccccccagcacctgtcacatttgatttaaagatttctcaaagtgaaaaatggtctccataagataaagacaactccccaatagcaaccgcaacacaaaactgctacttaccacgattttccagggaaacaaggaaaagggctagattatacagcaagcattatgtgagagaatgcaactctttttcttatacatttgaaaacattggagggaggcagtgaaagtttctccaagggctttactgggagaacatgaagtgctgggagacccaggatttccatgagtccattgggcagggcacagcgaggcaggctgcctatgtgggttatacctgctcttaagtaaggcaatggaaggtaacagaagccaagaaacaggatccataaactgaatagttctcactcctcaaagcccaactaaatagcaacagcagggagacgaaggggcttgaagaataaagatgaaaaatgcatgctccatttattagtatttgagttttcaaaagttgtatgaaaagatgggaagcaatgggacatttgatgacgctgaaaatggaaagtggggatttcatcggtaagagtgattggtgtgcaatttaggagagaaaaccgaagaagaaggaagcaaaagaaaaaaataaagacaggagacaaaagaatagctggcattagaggggaaggctgggctggcatgtcacaggatcatgttccctctatgttgagatgtgggtggctcagtctctggggattatattcataacctatatagaaaaataaggcaaagccaatcagaaagggcattaacctctggaagacgaggatgtggatgaactatatgctattattgtttggaagtaatgcatttgcacttcaactttaatgacagaggatgacaaaaattagaaaggtagtttctagtcttttccactatagtaaaggactgatttcttatagggaagtaatttctcctgacacattatattaggtaaagattgcatcttatatgaattaatacatttaaaaacaaagagaactattcacctttttttgatttgtttcagtttaaggggctaaaatctgttaatccgctactatgtgctgtctcctttggttattttatttgctcttaaccacaaatttggggtggtagtcttctgagattggtggaaaactcatgattttctcaaagtcatggtgttcatacaaacactcagaaatcaccctcattgggttcagggaaaggtaggcaatgtttcattccaagcctggccactggctgattatcatccccaccccctccacttattctgcctccagacaataaacttaaaggtgaaggcagggaaaggggaatgaagagttcaggaatatcagagatgcgtgatgaaataataacagatgaactggtgattatgatatcaaaagcaccactacaattgttcaggatgtaaaagaactaggataaagtaaaacttctttatcaacaaactgctggttacccccaatgtagagttataaaaaggaagagatggcagtgccaagatggtggtggtgggatatcaaagtcctaacagtaaataaatggcacattcagtgagcttaaattaagagagttatactgaatggactgtttacaaacatgtgggaagagttagaggataattaaacatccagggaccagtaatagtgagaaatccaatttttcaaggggcagagatattaaaaagtgattatcacatttgtttgtgtcactacctgtggtcttgaagagggaagaggagggaatcgtagtactggaatttaatgagagctattgcaccaggagaaaggtggctggaaaggagctacattcttagagggacacagtgaaaatctgtgcctggcaagaaggaagcctggggatggggtgaacaaatacccctatctctctgtctctctttgatccaaccttgtggttttcttacagggggacaagggactttgagtaaacagcccacagaaatcaccctctttgggtacaggacaaggtagggaagagtggagaaaaagtctggagtggcaagcaaacaaacaaacaaacaaaaactagcccacaggactgtgactgagctaattagcacaccactccttccaggccaccctacagaagccaacactaaacaaaaacacagcatctgctctgcaagacagactcaagatatgttctttggcatgtctttccaacaaaattactgcctctgggtcatcctgtgtagaaattctggagctaccaatgaattgggaagagtgttttttttttgtttgttttttgttttttcatagaaggatgagtaaagaaatttcacttgttttagacaagaggaaggcaagaagacatagttaatgggtacggcatggtaaaaggagtacagaaattaagaagagcaggcaaatagatgtgatggagaaaaatatatggtatgttatcaagaggaaagagacagagaacaacgaatcatgatttgggaataaagttggcaggactgcagaatggtgatatgtatgttttctccctcatctgtgcagcagctttcaacactgaattaggaaaaaatgtggatggtgatgtatattactttatttacacctcacagcaaccttgcgagataggttatccccatcttataaatagggaagttaagtaatttgtcaaagagcacacacttggtgatagggaaagccaggaaccaacctcgcttttgtttgtttgtttgtttgcgagttcccttggccaacaggccttcctgtagagaacattgggaggacatataaattgaaagcagagtggaggtggccagtatcacatacctgggacccaccggactcatgggcttccaataagagtaaccagaggggtccatagaaagtcagagctgctgccattgatgacgaggccggaggggctcttttttgccatactttcttaaagcaccatggccctatgctcttaaacatgtctctatttttttttaaagtaacaggcatgacagcaactgtattggtttactagagttgctgtaaaccacactctgggtggcttatacaacagaaatttgttctctcacggttctggaggctgcaagtttgagatcaaggtgttagccaggttggtttcttctgagggctgtgagaaggagcctgttccatgcctgttccctagctgctggtggtttgctggcaatctttggaagaagcatcaccctgatctcttgcctttattatcacgtgacattcttcctgtaagcctccctctgttcccaaatgtcccccttatgaggacactagtcatgttggattaagacctaacttaatgacctcattttaactaattgtattagtaacaactctaattccaggtgaaattacattctaagatactgcaggttgaacttcaaaatataaattttggggggatataattcaacctataatcgcaacctataaatttgtcaacaagttctaagataaattggcaaaaaacataatagatctacggtagataacacaaaggaaaaccatggacatttagaacactgctaagaactatgataaccagtatctgtacaaatgtaattggctctggtgttgaagaatcaattatacaaatgtatgtaatgcacaagtatattttatcataacctctgagaataaaatgaaataccatatgtgacagcactttacaagctgtgtggtattcaaattaaggcattagttttattgctattaccatgtctttatttatataggtagcttatttttattgttacattgggcatttcacatttttatggtccatttctttttatttcagttacatcctagattaatatcatctatgtctatttcttcttaggaaactgagtttctccattcctttttttccttgatcattagaaaacatctttcccaactcccatttaaatgcaaaatggagtcctggcactgggttgctcaaatagccaactccatctaaacttagctcacgacagaaggaacttaaactgtcagcaaaatcagcacactgactgcaaaccagttctcatagagatcaattataaattgagacggtgttctggatgctttagtcagatttggctggtaccccaatgatctctgactctatttcttcagatactagtatgaattttcatcttcaattataacctgctaccaggatggcatatacctgatcctcttctatttattatttattttgcagaaaataaaaataggaaaaaaaccctatgtttgtacttttacatttaactcaaaactcaaatattagtgaattcctttgatttatgtgaaaattaaagttggatctaacataggcatccagcctcctttttttgacctttcgtcatactctctttgctactctcaaatttggtcaccccacactggagactggtaatttgcaagttaattcattcatccagaatttattgagcacccatcatttatcttgtactcagctagcagctatagaggagataaggctagttgtaagtatgggatttggtgaatttaatgttattgttttgattaatgactgggcccactggtttccgatatgcagtactttgcaattttgaggggcactgacttgacatatgcgctgggctttgagtgggagccctttataagtgagggagtggagtgaactgctcagcgcccacagctcagtggcttgattgttttccacttgccacagccttggctctcctcaatttttaattttctgaattttatagggggaaataatgtactgtaatggtaatcatggaaagccttaaagtgtgtctccaaaaatactgaaactctcttctcctgtataaaataaaaaaggtttgcaatctagattcagagtttagaaataagtaccttgacattttcagcccctaagagaaccttttaccccctaaactttctgtagaatttataacctataaccaacaaaacaccaagttatttctcaagcagctatgcagaagctcttctatttggaaagggaattaacaaaatcagtataagacttgggagctttctgcaaggagtttataaatctcgtcggagagaagggacaggtttctttttatagcatcaacacaagtcaggaaagcaggaaatgataagccatgttatttgttccggagtctttaaacccagactctacatctaatcaccatcataaaaatgccttttttttacctccagctttatagagaggagcctcagagtgggccatcctggaggagtgcacctatcagttgagaaatagggatgacaaggatgtaggcagctgttgcattctaaaatgtgaatttgttttgtgaaagcctttcattaacaaaattatgtgccgagaaagggcaatgacaaaactgaccaaattccttcccttgtaggtcagataacatttaagagctttacatgtctaacaaacttgaggttgctcaaactggacaaaggaggagattaaaacactttctgtgatgacataaagcagtgctacgggtaaggcctcagtctcctgccagcagaagcaaatgtattttctccatttaaaagagttgccttcttaacccacacttccccaggcattcggtcctgatagggcttggtttgactgattaattgtaattctgctccatacaaggtagacagtgatgaattgatacattaaagatgtgattaatggttactttctattcagtgtaattatcaggtgatagtttcaatgaaaaatgctggaaaatgaaacttttcactctagataactatccaccctgtctggaaagaaaaatggttctctattttcaacattttactctagatcaaggccaagagagacagagagacacagcacactggctttgtgagttttatagaatgagacggatttggaataatgcctgtctttaaagaaattcttagagaggaaatctctggataataaaactttaaattttatcttaatcctggattactttgccagctcctgcctggtctttctggtcaattctggcatttaatctatcctgaagatggttttggattaatttccctaaagcaccgcattaatcatatcacatctgttttttttttttttttcggagacctccaacaacttcccacttaaattataggaagaacaaaacatcaacatgaccctcaagaccctttgataaaaggcaaacactctttgtcaaactgtttcaattcctgtgcgctgttctttcgaggctgtcagctcactgccatctcagctggccatgatcccccgaggccatgctttgctttgcctctttttctacatgtttttagctggtagaaaaaattgtggacgacttaaaaagggaccaaaagattaccaggtttccttaatggagaaattttgtgctgtttagaatgcatcctctgattcatctgattctgtagggttttggcatttcattgttttggaactattatataattttgtggagttagaagttaacttgcagaaaattcatagaaatataaaacatcattttctttttttcttctctttttttttttttttttttttttttttgagacagtctctctctgtcgcccaggctggatggagtgcagtggcgcatcttggctcactgcaagctccacctcctgggttcacgccattctcctgcctcagcctcccgagtagctgggactacaggtgcccaccaccacgcctggctaactttttgtatttttagtagagatggagtgtcaccgtgttagccaggatggtctcgacctcctgacctggtgatcagcccacctcggcctcccaaagtgctgagattacaggcatgagccaccacgcccagccaaaatataaaacattattttctatatacatgcagataggttctgtccaatggagattcaatggacttttctaacctgctgtggaagaagccaggtttttctgtgttaagcaaattcatgttggcatttttgttggccttttatagttactctttgggatctcctttgaacttaggacatgttaattcccatcttcctaactaatgagctaaataaaatctttgacatgtacattttatatctgtgtaaactcatactcatgatttacttattttaaaaatgatcctttaatataatctacccaatttaaaacttagacaagtttttagagcagttttaggtttacagaaaaactgaatggggcacacagggagtatgcatatatctgccacatcctttcccagttttccttgttaacaacatactgtaccacaccagagaggtacacttattccaattgatgaacctgtattgacacatcattatcgtccaaactacatagtgtacttcaggtttcactcttggtattgtacattctatgggtttggataaatatatagtgacatgtatccacccttctgtctcctacagaatagtttcactgtcttaaaaatcctctgcactctgcctatttatccctccttaccctcaacccctgacaaccactgatctttttatgtctccatagttttgccttttccagaatgtcatatagttggaatcatatgattggcttctttcacttagaaatatgcatttcagtttcctccatgtcctttcatgtattgatagctcatttctttacagtgctgaataatattccattgtctaggtgcgccataatttattctttcacctactgaaggatatgttggttgcttccaagtttgggaaattatgaataaagctgctataaatatcagtgtgcaggtttttgaacagatatatgttttgaactcattttgtaaatgccaaggaactggatggctgaatcatatggtaagagtatgtttaattttataagaaactgtcaaactgtctttcaaagtggctgtgccattctgtattaccatcaccaatggacaataactcctgttgttcaacatcttcaccagaatttggtgttgtcagtgatctggattttggccattctagtgcgtatgtagtagtatctcattttgcttttatttgtatttcgttgatgacgtatgatgtagagcctgttttcatatgcttatttgccatctggatgtctcctttgatgaagtgtctattcagatctcatgcctatttttttaatcaggttgttcattttcttactggtggactttgatatctaaccaattaaaaatttgaactcaacttggctgtacattagaatcatctatagagctttcaaataatacaggtttgacttgtgtacgtccttattactccagtaagtcacatatcactggagggatggtgatggcatacatagctaagtcccatgcagagaacttctgatttgttggggcctgggaatctgcatttctaacaagttcccaggtaacaggaagcactttgagaacacttgctctgcttagtatggattactagtagtacagtttgttaggctctcttctttctctatattagcctgttttaaatttaattgtatgtcccatattttgtttacaattagctatctaagtatatgtgcttttgtaatcatagcttggaattgcgttttctaggttagttttcaaaataatgcttatattctgctaagtccctgccttgtatttttgttaacagactgacagaaattggtgcctggcctatggcctagtggtcttcagaaatgttcttccaaaagctttttaactaagaagacaaaacaccatttctactcaacttagctattatccttttaaataaaactttttgtaaaaatatcccaacacaaacaataagattaaacaaaggatcatagatttctccctaggattatactctctattaagcacagaattgaatatatgtataatcagattttaaaatgagtttgggtctgcctaacctaaaatgtagatgagtctgcctctttctaaaattttaaatcatagtttcttgcagagaaatctggggatgtttaactgaaactttgactttttaaatttgaattttctgaggttgcagttgataatatttaaggtgaatttatttggctataactgaatctttgcactaaaagagagaaatacctgctattttaaataaatccaaaacaacatatctgcaaagctgaataaagtctattttctctcatataagataacgtatttcaaagatgatgagatacggagtaacctcttgatagcatttggttccctcctcattgatgttccactgttatgaatccttgcttaatataatgctcattctccttctaggcttttcttttatctcactataaaatatttttgaagcaaaagtccttctggagtgaacacacacatgtatgttaagactttaaggtatttacctgttaagaaatatttttttaaaaaagaacaaacagaaagcaaaaagagaatcacgaaagattcaaatgaatatttcttattcatttcgaaaagcatgaaatttctatcttagcattcatagatagtattctgagcatgcattttacccttttgcgtgttactttaattttgctttgagacaaaagctgaaaaagaagtatagtatatgtgtgcatgtatgtgtagtttcttctctttttgtagttagtgaaaagaatttacagataatggtatatcagttaaaaccaagcttaaatgtagtgatcactgaggggcaaatttctgctttgcttagagttgttaacaacctcaggtcacctgttacatacctttatttatttgtttatttatttattattattatactttaagttttagggtacatgtgcacaatgtgcaggttagttacatatgtatacatgtgccatgttggtgtgctgcacccattaactcgtcatttagcattaggtatatctcctaatgctatccctcccccctccccccaccccacaacaggccccagagtgtgatgttccccttcctgtgtccatgtgttctcatttttcatttcccacctatgagtgagaacctgcagtgtttggttatttgcctttttttaaattgagaaatcaattatgaatatttacaacactaggcagccaatgactcagataaactgcatttgaacttgtcgtggcctgacaaatgcaggctttagactttattgttagatattaagaatggttcacttttatgagtgaaaaatgtgaaccatcaggaaaccagaaatagtctaggctagaaccttagcaccaccatgaagacttgaacattatgtgaaggggaaagtttggatctcaaagtggattgagctagaagcccatcaggatccaggttcagcatctgggctgtgaagaaaaattatcagacttagaacattaactgagaaagcttgtgttagctttttatttttgcataacaaattaccacacacttaactttaaaacaatgagcgtttattagttcatagtgccgcaggttagaattttatcactgcatagctgggttctctcttcagcgtatcatgaggctggaatgagaatatcatatgacctacactctcctttggagactctagggaagagaccgcttccaagctctttcagattgttgacaaaatctagtttcttgtggttgtaggactgaggttgccagttccttactgactctcagcttctagagactgcctgcattctatgccatgtgcctccagcgcatttccctctcgttgactctctcattcttctactcgctttgattgacttatctgtgattgccagattcagacttgaagggctcatgtgattagtccagctccacccagatagtctctcatttttaaggtcaactgacttggacttttaatatcatttgcaaatccctttccagcgacacctagataagtttaattgaatagttgggagtaggcagtacatcaggggccagggactctggagccatctttgaattctgcctatcactgagctacaagttcaaactcaactgggcagcaagctgtcgagctggcagacacccagatcaaggaagcattgctgcagagtggacatccgatggacagtggaatcttcaatatttcaacagctacacagtgtcccattagaaatgatggtggcgattaccaccagaattggattttctctcaacttgatgtccctagaaggtctgaatatttttggacggagtatgacaccaacatgtgggagcaatttcaggttggtaaagcctcaagaagggatagagagtttcctgacaaaaggacacatagaaaattgagaatgatgtgactttgtattacaaatacacagaggaattcataacatataaacattgttttatggcccagtatgatggctcacacctgtaatcccagccctttgggaagctgaggtgagcagattgcttgggctcaggagttcgagacgagcctgggcaatgtggtgaaactccatctctataataaatacaaaattaattagctgggtatcatggtgagcacctgtagtcccagctacttagtaggctgagatggaggatcacttgagcctggggaggtcgaggctccagtgagctgggatcacaccactgcattccagcctgggtaacagagaaagaccctgtctcaaaaacaagcaagcaagcgaacaacaacaacaaaatacccacattgttttattaacttgctataagctcttgccccacatcaacccttgatatttgccatataatatgggagacatatgattaacagcagagtggggttcagcatccctgcgtcacgtcttactcactgcatgatgtgggcaaattaatcctaaaccttagttttcttttctataaattgggaaataaactagtaccagcacataaattatgaatagtaaataaaatacaacatgtaaaaggcttacagcagactttagttaagtacttgataaatagtcactatgttgagattaagttgtctggttcctaaagttaccaagccattgctatggtttgtatacggtttgtttggccccactgagtctcaggttgaaactggattcccagtgttggaggtggggcctggtgagaggtgtttgggtcatgggatggatccttcatgaatggcttggagttctcttcaaggtaatcagtgagttcttgctctcttagttcccatgagagttcccaaagaactgattgttaaaaagagcttggcatctgccccatctctctttcttctctcttgccatgtgatctccacgtactggctcccctttgccttccaccatgagcagaaggagactgaagccttctccagaagcagatgctggtaaccatgcttcttgtatggcctgcaaaaccataagtcaaacctcttttctttataaattatacagcctaggccgggtgcagtggcttatgcctgtaatcccagcactttgggaggccgaggcgggcagatcacgaggtcaggagttcgagcccagcctagccaacatggagaaaccccatctctactaaaaatacaaaaaaaaaattagccgggcatggtggcgcgtgcctgtaatcccagctacttgggaggctgaggcaggaaaatcgcttgaacccaggaggcggaggttgcagtgggccaagatcgcgccattgcactccagcctgggcaataggagtgaaactccatctcaaaaaaaaaaaaaaaaaaaatacacacacacgcatgcacacacacacagacacacacagcctcagttattcctttatagcaacacaaaatggactaaggtagccatgtaggtctttgatcatttttaaactgattttttttttcatagaataggatctacgttgagtcattcatttactgtccatttgttcattcagttatctaagtcatatttatcaagctgcagacaaagcaactgagatgccaatttaaatgagaaacaaatccctggagcttgtggtgcttacagcctagagattctaaaggggatcattcgcactctcactccacttcattctcactgagattccaagaaaaacttaaagggaacataatggcagttttaaaatagagcaataaagcaattttctcacattccctcaaacactgtaaactcttgcaatttagagacataattttacacatttttgattctacctaaagttagcatggtgggagcacatagtacattgatttaaactaaaaatactagaaacaggtattgtctttaggagaatgagcaataatatttgtgaggaccagtgtctaacgattaggcatcatcttaaacaagaaacatattgatttattacatgaaggttacaggcctaacacaaaagtcaaaatgaagcaacatttactgcaatctatgcttttaagtaatgcctctcaacaaggtcccaggtgttttagaagctgcgctattttagcacaaaataatatactgctgacttttcctcattgcttttgaaacaatatggatctacttttgtctcatttacagaacaaataaaaaagccctagattcagtgagtcagtaaataagacccatttttaagagaaagctgagatcctcagaaaataattggagagaatgacaggggtttatatacaaaggcgtaactcatgacatcattagtatttgtagaaaattacaacttaactacatcactagcaaaaaagaagtggttaagtaaattaccaaatagtcacaaaagtgccatattaggcaacatttacgaatgttcatgaagaaattttattggcataaggagaggcttagggcaacgttaaatgaaaataaaagcagactttggtcctatagcattgcaggatgactatagttaacaataatgtattatataatttcaaatagctagaaagaagatattgaatattcccaacacaaataaatgataaatatttgaggtggtgagtatgctacttaccctgatctggtcactatatgttatatgtatgacatcactatgtataccataaatatgtacaatgtcatttaaaaaatttaaaaagagttgaaaatacacataatatttgcaattatcataatcatatttaatttttttcctatataaaggggctactggttattccatttcagccgaacatcactttagaaaaacagttggtgcagtggttgagtgcaaattgaaggatgtagtaaaggtctccataaccatctggctgagaacagaaatgatttagttacggatttttgttgtatgttactgattggcactcagcatccaaccccatctctttcagttgcgttctatagaagtaggaaacctaaaactcatgtatctgattctctctggaaactatggcactagatgttagattctacaagttagatatacaattatgctgtccggtagaaaggcaaaggtttttttgggggggggggtaggggacgtactgtttataaaaactggaaataaacaagattttattgtagcaccttactagtgagcatcctgtacattttgtgagtgttgaaggcaggggaagtttcttgaaccgggcattccacctcagtctaaaaccaagtgatggcttgaagcaaaggaaaaagcccctcaagtaggtcagttttataaagttctgggagtaattcctggaggcccagcctgtggagtgttcctcctgtaccccagtgaggctgtaggcacttgctgctcggtgttaacccccttcctgctgaaaatatcacgtggtttctcttttctatcctaaaccaaatgaagacaaacagatataacgtgaattctgctattacagggaatattgtacacctttctgtaatgtcattgattatgtttttgtcatgcatgtgttttgagctccttttccataaaaaagtgctcatggtaagcatatacaagaatacacattagtggatacgaggagtgagtagaaagcatgcttgagggtggttataagtgtgtctgctacagactctaaaaaccatttcaaatattttcttaagtcagcactaactatacataccaagataatacattgaataattatcttctggttaccaaatttttcattcaaaaattaataaaggagaaataggtatatattctggaacattattaccttaaccagatactgtctctttctcttttcccaaaactatgtattgttctctagttaccctggccaagatgagaaaaactccaacctcttggtggttgcagaggccctccatgcctaaatattaatagttggaaatacagtctttgtttttactcaagccagcaagcatttatcaagtatatctactggggataaaatagatgctggagatctaatgatgattcagatatgaccctaattctttaaaaaaaactttcactatcttgtgaaagacacataccatgtagtagtgtactggtaaatgtttatcaaccagttttctaagaaaaaaatgtatgtgcatatatatgtgcatatgtttattataaatattattataaataattgcagcacaatttacaaacacaaataaaaatagaatcctccttattgtaagttttatataatgaattgctcctcaaagtatgctttcatcaattttactgaaatcttatatctgtagccaactgatggttgcaattgaggaatgagtgtagtctaaaaatgaatgatagtttatgtttttgtgtatgttaacactatgctaacaagtaagatgaaagggaagcaattaatatgaatcagatcttcactcattcatcaatgacatgagcaattgcttttcttaattgggtaataatttctaaatactgcaaagcattttctggattttttgtgttattcacaatgtaacagctaaaggcacaatacatgttaagtttaatgtgaagtgttaacattttctcaatcactttcttaagtctatactaacaatataacagtaatcaagttctgctttgtaatgtttgtcagtttcaatggtataaatactcccatcatgaacaattgcaagctgctaatggaatgatactgaataaggagttggaaagagaggcatagtacagtacctcattattttagtattcccaccacacaaataaaatagaaacaagtaacttcaaaggcatatataatagtaaaatgtaataagctaattagggagtaaggagttttgagcatttattaaatttatctttaatacaatttaactgtaatttcatagagtttacttttaaataatggctgtatttaacaattagcttttgaaattcactaaaatgtaaggagtggctcttgtgagcctataagggccatctctagcacaacactggatatgtgattggtgataaaggtggaatgaagcatgaggaaaaaatagtcgtctgtatttggggaaaatcaggaaataaatcctgaataggagccagccaggcaacactgggaggtgtagtgaggggacatcccatgcagagcagggagaagggttagtggcagaaggtatcacagcccacttaaaaccttccctcatctcttagcattcgaatggggtaaggtctgcagaagccagattgacaatgaaccttctaggtcaaactgaggtgtgagactttcatcttgtttgagactgacagcctttcagaagttttaaaagcaagataatgcatttgcattttgaagcaatgactctagcagtagtatggagcacagacagtagtaaagcaaagtcatgggtgggaaggccagactggtccatcaacgctgatgttggtcctcttatttgtctttggtcagcatctttgtgctttctctttactgtctttttctaatttgatcctcccattagcaaaggtcaaatcccaaataagtgagagtttttccacccagccatccagatttagaaggctcagaatgtacccaacctcttcctattttttttttttttttttgagatggagtcttgctctgtcacccaggctggagagcagtggtgcaatcttggctcactgcaacctctgccttcctggttcaagtgattctcctgccttagcctcctgagtacctgggattacaggtgtgtgccaacacgtctggctaatttttgtatttttagtagagacagggtttcaccatgttggtcaggctggtctcgaactcctgacctcatgatctgcccaccttggcctcccaaagtgctacaggggtgagccactgcacctggccaacctcttcctattctatgttgactttatacagctacatccaaagtgaagttgttaaccaaaacatcattacagttacaaatttaggaagaaaaatcaaataatatttgatgttattaggaaaagtgatactagagacttgaaacatactaccctcaatgacaatagtgatgcatgcagacagtgttgagaaacttagagagtcgatggaaaatttagtttattttaatttaggctgtatgtagctcaaacatatgctgagcttttataattaaatggagtttctttcgaaagtgtgacagctctttgctttctttctacaagattgaaattagagttggaggacttgtgacttctgaggacagagaagaatgtaagcagcagaaagtttctgggaaactttctagattatgatttgaggcgattatttcactgcctataccccagacacctgctacttcctgtttgatggtaaacttttcccttcagtttttataaagagatatggcatctgggacaattgcttggtcacatgaatttatttgagggaggtcagcatttctagacaactttgatatttaggtgatggaatgaaagtcaaaaaaaccagcattgagattttaatttgaaaatactgagttaagtctttagtgttaatagagctatgtttcccagttttgggatttcatgaggaatatgcttgtagagctgaggaatgatgcaggcattatgaacagaattgaaacaaaccatataaaaaaagctctcatcaaaagaaaggaaaatagcaacaaaacaaaataaataactcttccccctgaaaaaaaaaccctcaaaacgcttgaaaacatgttcatgctgaaaaataatcaaatacattgaaattaaaacaacaatgagatattcttatatatattctaatgagtatatcaaattgaaggttcacaaaaatatatactctcatctactacttttatggtgaacacttttaccatataccttaaatgtttatgtgtcttgaaggtacaccagtctctagaattcatgttcataactggtatataatactgcctctttctgtaaaccgctatgtgttgttggtctttttgtgattggtttatttagaatttcatttgtgttctacaacctatattagatcttaatctcttccagataatacaaaacaaaacaaaaaaatgctttttctctcatgtttcttttagtaatgagacttttatcaacagttaaacatttattcaccccaacttcattccccaaaccactggaggcagcctaccgcaaaatcaaataagtttaaaaggacagtaaaaggacgaaagtttaggaacaagaaaaaaatgaatcataagaagaaggctgcagcatgagaagaaaattagaacggtaatatagaaactgtaaggaactctaccaatggaacagcagagccacgcaattaatagactgggcttggaagtcaaagggaaggagccttgaccagctccactgcttttattcactgagtgctaagagcagctttgcataggatgctccacgaagagctgtgaaataagatgtagacctgaggactgccatagggtcccttgaggtaaatgcactaacgcgtgtctctgaagctgatttcctcactttagaacttctaaatccccgcaaatctccctccaaatttcattctgtctctactttctaatattcatcgcagtcggtcttttaaaaatattttttaaattttattttatttttaattgacaaataataattgtatctatttatggggatacaatgtgatgttgtgatagatgtagggttcacatccattgtcttttgctgtagcctagcaaacgggtctagctttccagcaccagagccagaggaagccttgctttgtgtgggggattggcggggagaagtgaagaaagcaatggggatgcatttggtctcctctccaagctcccttccttccttactttatagcatgcccacttgcaacaagaatcagcctaggacacccaaagtgcctttgcctcactgctgtttgctgcggttgtgatctttctcactggagttgtgaaaaagcagaaagtgagtcctcaatgtgtcaggcctgctgagctactgtgatggttaatactgagtgtcaacttgattggattgaaggatacaaagtattgatcctgggtgtgtctatgagggcgttgtcaaaggagattaacatttgagtcagtgggctgggaaaggcagacccacccttaactgggtgggcaccatctaatcagctgccaaggaatataaagcaggcagaaaaatgtgaaaaggggagactgttctagcctcccagcatacatctttctcctgtgctagagaattcctgccctagaacatcagactccaagtttttcagttttgagactcggactggctctccttgctccttaagcttgcagacagcctattgtgggatcttgtgatcatgtaagttaatacttaataaactcccttttacatatatatatatatgtgtatatataaactcccttttacatatatgtgaatacatatatgtaaaagggagcttatatgtgaacacatacatatgtaaaagggagtttattatatattatatatacatatatattatatatacacacacatatatgtgtaaaaggaagtatatattatatatacatatattatgtatacatatatacatatatatctcatatatatacatatatatctcatatatatttatatgcacatatatatatcctcttggggagaggtcaaaagaagcaggggatacaaatctgactgcaaaaagattgaaggacagtctttattgaaagcctttggtggggatacagaggagtgaattatattgagagataactcagctgaattttctataaattcattgttgctatcttccattttcctaaccacctgctgacttaacctgggttctttctccatttgctctctgactctgcttacctttcctgtctctgtggtgcttctcggtctttctctcatgttccttccattagtctgtctgactgtctctctctgtctcccccagcccccactggatcttcctgcatgttctctccttccagattattctctcttggtgtttgttctatgctttcttgtaaaaaaacatgttggcctctctgggcttttgtaattaatacatctggtcataggggaaaagaatgcttctaaatgttatttgtttttccctgacatgtatcaaattttagttttcactctacctaaagtcccgtctccagtttgaattcaccactcttgctggtggttagataagcaagcaacagacaacgtacacacagaccacatattgagaaacaagggagcctatttgaaattgcagaaattaaaacaacaacaaaaaaaagatgcataaggagctttctgaggagtacatcgcctacccaccaccccacttcaactggaaatctgtttccagtcagcagaaaactgaccaaagacccatcatcaattatactttgtgaggatggttgtctctgaaatatgcagagtggcccagaaattgtagaaaagaagggtttggaaggtccatgcctataaagccaacaagacactttctgcacctcaagaaaagtagtctcgctgttattgtattctgtctgatcaattttccttattttaatgacacatagttttcatgttttgtaatatttttgtcatcacacatggtaaaaagccaacccatatagtctgaggtggaggatgggaaagcataagacattcatacagtgacccttcaaacagtcacagatgacatggttcctggacagtggggcatatctcccagatgaatttcaatgaaagcaattctatagagagcagagaccattgtggcctaaacaaagagcttttcagtgacccaggaagagccaagtatactacttcaggcacctggagcaatggatgacctgaatgtcctcaacacaatcctggatcattatctttactttcaaccagattttgataagaggagatgtagtcagtgatttgtaatcccacagtggtttgccaatggttgctattagcaggaaatcaattcagagatgtcatttgaggatgaagctcctcggtattttgatgcctttttaggaagctaagaggagctccactaccagctcttcagaaaaaatctcctgagttgcctaatttcacctgaatttttggagcacacatttaaaaattacttgtgaatcaaattcaatttgaaaatatgcaacttttttagctcttgctttctccctgagctatttcttgaaaattgtggaggaattgcttctgctcattgggcccatttacatgaattatttatttttatatgtattacatatttgtctctcctccctcctacaagctgttccatagcaagacctctcgtccctatatatattcatggtgacattacagccatcttcaccctctgatgtctaaaggaaatggaaattctgagggtcttcgaaaagcaaaaagccaggtttcctttattctagatttctagaggatttcatagccactaaatctgtaataaccagaagtaacatacatgcatgtacctgggaagttcagtgataagataaatgcatagatgtctttacccatgagtatataatgcatcattttaactatatttttccatttttcggtgttcactttgtagtcatacaaatactagccattgctcattgagtactgtatgtcaggaactatgctatgcatttgtgtaaatcatcacatctctttccagttatcctgcatagtattgttactccatttttttttcctaatgataaaactgaggcagagagaagtaaagtaactttcccaaagttacaaaatcagtaagtcatgatttggtacaaatatgccaaactaccaatctgggccttttaactccactctgctgttgttacattatccttctcttgcacatttaagccatattatttcaatgaaattctgcaaatacttattgagcacttgttatatgtagccattgtcctagttactggggtcacagaatgaaaaagtggagccaaattataaggaggttagattctagtagacaagtcagaaagatgaacagatgaatgtcctacagggcagtacaggtataataagtgtttaccacttaactaaaggtggctcagatcagagaaagacttagtacattatggtgcttcaggatgctcactggtggccaggcagaaaagagtaaagacaatggcattccagcaaaagagagaggcatgggcagtgtcacctactggtgaaataatgcagacaaaaaaccaagaagagtaatttggtactgttgggccataacagatacataggggaatggtgggaataaggatagaaagtgactggggacagacaataaacataattcagtcttacaagtttggatttttccatgtaagttacaaagacccattcaaggaattttaagcagagaaataatcagaacaagtcatgctcagagtaaatataggacatcaaattgtttatcaagaaaaacagtgttttttattatactttgtgttttactggcaatgacatattcagtagatctctttttatctcagttgatattagacattagaaatgaaggctgcggctatattttaaaatggtaaagatcttccatctgtctagataaaattttgttcaacgtttcagtcacttaggtgatggaaatttggctctcctccatgaatcccactttccttgactccttcctactacaatgtcaattctcctgccctttcaaggtagagaaaagtgtttgtagtctcaaagataccagatggtatctttgcctccttttgaaattcatggcacttatgttattccacttttccactcaatgtctttgtcacttgcctatatcctagttgctaccagtgtcacagaaaactctgaaacttgatccttgattctcctttccatttcaactcccaccatcatttttgaccacaccaatatctttgtatgcagtacaataatctgggagtttgtagaaggaaaatggtacttttgactttggggattaagagaagttttaagggagacatgttctgttgctctgctcttccaaaggtaaatgaaactggaattattaaaaattgggagcagaggccacatttcctagttggaagaaacagcacaagcaatggcataatatgaaaagggtggcaggaaagcacataatcctgtgtgattgcatcatagaggatataaaaaggggcaatatgatacagggctaaagtggctaacttgttctacattttagagaaacttgttttaatatcaagagaaggagactgaatttcatttggctggcagtggtggcagggaggtggagatttttgagaaatgtaatgatcaaactgtgccttaagaaggtgaatgaataattttttaggttgggaaagaggatggagagagggagaagatagagtgcaaactgctgctaactattttgcttgttgtccaaagtgtgtctaagatcatctaggcagaggtagcaggaagtagaaggagcacagtgtctataactgcgtttcaaagaatgccaacacttaataactgaataagcttgggttggtattcaagtgaacttgaggaggagtgcctgacaggaaggagggaaaccagggaaatacttggcagtggcaagtagagagaatatgctctaggtcagaagcaccaatagtgttaaaatgaaaacaagaggtcaaataagatgtgaactggacagtaaatattagttataataacatggagatcattgatggtcttagctggttattagatcatttgttagcttcattgggggcagaatctgggagaatttggtagaaggaagtgctgcaaagtgggagactcttgagggaaatttttaaataaacactgttggtataattaggaggggcagatatacattcaaatcctgcttctcaattaattttatgtgtggcctgacttctcgaaatcttagtttcctcccggtggataagagaatggaagccaatgggtcattatgtagaataaatgagatcataagtcaataattggatgaaaagagttctgcgtttgcttgacctaagtattcaataatggtggcaattactatattatttgaatctggacaattgttacatattggaggaggaggttacaggtgtatacataacttgttagttatgttttgactgagaataaaactgttatcaagaaaaacgaggaagtcaaaaagataatctaaagaagagaatgaagtaggtttgtaattttttcccttttaaaaatatgcatgcaatgaaatgtgcagatattttacatttctgtgggttttgacaaaagcttatacacatttaattcacaacctttgaggctatattctatttctattactttaaaaagtgccttcattttcctttgcaggtcactcattctaccaccacctgtgggggcaactactgtttatttctataaccatagattagttttttctactctaggttttttggagtgatatagtacatacttgtttgtttctggcttgtttgaatatactactttttaaatttatccctgtggtttggggcactgatcgtttgccctttttttcattgctgggtttaaatatactaagtataccatattttttttgtttgttttaaaatctatccacttgtttatggacatttttgttgtttctagttttgcgctattttgaataaaatttctgtgaacgtacaccttgtataagtttcactgtataagaaatcatcacatgcccaagccatgtagatagttccttatgtattattttgttttcccaataaactttatagtcagcttttatgtttagagcgggtattcatatagatttaattattgtttgtggctagaattcagtgtagttcatgatttttttctatattaatattaacatgtttcagtgtaatatttgaagtatttttctttctccattgaattgcttcaaatatttttataaatttgtcttttgtttttagaaatatgactattatgtatctagggtctatttttttaatgtgtattctgtttgggattcattgagcttcctctagggatcaatttttttttcccagatcagatttggaaagttttaagccaccatatctttggatatttatttctctgccaatctctttgtcttccttctgagattccagttacacagatgttaaaccacgaagtgacccaggggtcacttagattctgttaatgtttaaaaacttttttccctctctgtactgattttataatttttatttctgtgtattgaagcttactgattgtttcttctgtaatatcccattttctgttaagcccataagataattttacatttcagatattatactttttaattcaagattttccatttggttcatttttatggattccattcatttgatgagaatttctattcgttcactcattataatatccatcctttccaaaatcattgaacatatttataacagctggtttaaagtccttctctattaattcaaatatatgtgatttctctgggcttgtttccaatggcaatttttttctcttggttatgaaagaaatcaaggtactttattatcattggaaccatgatataaatattgctgtgatttgacttgacacagctacaagcaattttgatatgccttggcatcattaatttattctaatttagtgtttaatgtcccagtaataatatttctagcctaagttggtgtagaatagaaacctcagctcttatgcattggaatagaaaaatacgattacacatgatcatgaaaagcaatgatgcctgaatatttggatttgaactgttttatctcacttaaactgagagtgataggttaaaagagtagtgctgcattgagtaaaggctattttgacagaatttgttgaacctgtgtttagaagttaagaaagagaggaagaagaaacaggaacactttaaaagagttgatgccaaagacagacacataaacaaaggtgagatgcttttctatttctctcccaacttaccttagaaggctgtgctgtagcaaacgactcacatttcctatgtaaagcctgttagaaactttttcagactattgaatcgccacaaagagagcaaggtgattttgtataacatcttattcagtatttactagatagctgatacatgcttggcactctaatgacgttgtaatgggtgggcacatccatggttcttcatcgagtttagagactggttagtgtattattttatgctgttaattttacaattgtgtaggtgccaccaagtcctctaatgaacaacctttgctttctgattctagaccaaagatcttctcacatatatctatttcttacatctatttcttattccataatctctcaatctcatgttctttctgtaaggaatgagaatggagatagagttatatagagatcatagaatcttggatgtggctttacagttgtgtttttttcttctgttttaaagggattggggagggaggtcttataagtatatggtgtttcacagatacaacactctgggattccatttcaagttttaatgatagtataagcagtacattgaaagacagccaataacattcatctcttgaaataagtatgctgcagggctgaaataactttggctttattgctttgaaacttcgtgaagcttgggttaagctcttggctatgttacatctgagaaatacagacctcgtttcacctgttccacactacagctgcagttttatttggaaaattgatgagggcattaagttctgaagtcatgttgattctaatgtaaataaatggtgtcattacttcatagttgggagtgccactaatgcagaccttaaaattaagggttatcttgttgattgggggaaaattaaagtaatcaactttcaaggctttaataaatgagattgcacacttaaaaatcattttcaaaccagctttaaaagtagatgactagaaaatcaatagcaataatacatacctatggaaacagaatgggctatatttatttttaaggatagtttcttgtgttatttggtttgaatttattaataaggggcttaaaagtaatcatataaaatattaagtatattttcataggaaaataccaatggtattttttgtggcagttaatacacatagagccatgaaagttgaattttccaaaagaaaaaaatgatggtacaggttcagtacacctaatgtaaattcatgaaatcaaagtatataaaggtttttctaggaagttagaggtagagagggctcaattctattcctgtatgtaatacttgttaatgtgtgtgtgtgtgtgtgtgcatgtgtgaatttgtgtgtagcatttattacattataaaatatagtatataaccttagaaactaagctctttccaatattggaatataaattgctttaaatatttggacacaatcactaccatcactattattatcatcatcatcccagctcatatttatgtagtctgagtctgggccagagagattccatgctaagtcctatttagtatgaagtgggctctcaacctatatctgtgaattaatctttgtgtcaccacaagtgtccagtaggctgatctgaacaaaatcagtactcaggatatgctttgaactgttaacaccagaaggcaagggcaactttcacttttacacacataagggagagtgtattcttcaatttcatgagtagagagtggtgtacgtgagaataatttataaagtgatgtcataagtccctatgtgcctgggaaacacaaacctgcctactccagacaacaactgggtggtttttattattgttgtttgcttttacgtttgaagcagacttgtgtggcacttcagaaacaatatgagatatttagcagtgtataaatttgagtttggagttgattcaggtcgaactttcaacagtaatctgatgtatatgtaatgggatacataattagtagtgtgctgtattgtaaacatggcggaaaaaatgtcagaagactacatgctagacagtcctcattgtctgtcttgccatccccagttcctggggccctggactaagcaggcacaatgggtctgagccagaaaagtccccattgtaagtataatcatagtcattgtaataataaaaatgatttccacttgtttcaatttactacatgccagactctatattacatacttaacatgcatatctcattttaataacaacactgagagataaataggttcaattttcatacgaaaaaaatggaggctgaaaacttggaagtgagaatgatatgatataatgaaaataaatgaaatttgacatcagataggcagcattgcaactcatgattcaccatctattatgtgatcatgggaaaattactcaacttgtctgcgttttaggttcttaaaccataacgtcgggattacttttgttctcctattctgaggatgcattcagatatgtatgtaaaactccaaacatagtacctaagacataggagggcatttgcaaatgttggtggtcctgacctcccaccattccttattgactctgcagagttaatgttgacctgggaagttttcaccctggctccagtaaggaaagtgaaaatgactaatgattttctttatccagtaaaggatgtggaggatggggcggtaaacttgggtacttttctacatcctcctcttttcctggcaaagtcccagtaaatacttatgatagctttgtgtaaaaacagcacctgtagccagacatggcaccatggaaggcaggttggtgggcaaatgccctctaagtgtaaaaaagaaggagtgttgtgggtccccagatcacccaccagatttgatgatttgctagaaaggctcacaggactcatcttgtagtcatatatatagctacaatttgttacagcaaaaatatagaaagcagaattaacaaagggaaaggtacatggggcaaagtttggaggaaactgggtgtaagcttcctagagtcatcctccggtggggtcacacaggattgcttaatttcttcagcaaggagttgtgacaacacataaatgccttccaaggagtctaattggagtctcagtgcctagagtttctataaggggctgctcacctaggcaacttctccatgtaccaaattccagacatcctgaagtgttcagcatagaccatatggtttgcataaacaggcaaggcacgaggagccattcttatcagggaatggtgggaactctcttcaaatcccactttccagacctagccaaggaccaactttgcaagcagacctttatatggatagcagtctcaggccttctcagtttatattaactcatattaacatagtcttagggtgggttacctcttacctgcacagaaagacatagttgcgtgccaggacacaagcatagcagagcaggaaacagatggagttttgccctgacccatctgcgtgtacagatacctttaggcaatgaacaatctaccaaaccatggatggcttccctgcctactagagaagcctcacatggaagagcacgctgtgtatgacctcattctgccttcactctctggtcctttaaatgttgattgatcagccttttttcactgacccaatttgccttctctgaagatgctttttgcaaatacagcaggtttgatgaatgcttagcaagaagtttggatgacttctgcactggtttctgtctatttggggctgattggaaaacttaagacactgaatttatcttatacttgaaattctgtaaccactgttatttatgtctctgtgtctgtctctttctttaatctttgttttgtttttcttcagtaagcagttctgtgaggtagttaggactatgattgggtagttgaggctccatgtggttaagtaatcatatcagaagaatttgttggaaagactcagaccagaatacagatttgctgtttcttgaatgagcatctcttctgttgaatcaaattaatactataaaagtaatttcatggaaagaataatcataaagaggcaatatcagtccaaatacagaaaggccttgcttttctgactttctgtagtagtagcaaacccagtggagttctgaagaatgtggtcattgctatggattgatgttagagaccagagctagattagtcagactggtcaactcttctagagtgactggaaacttaagcatctaagaacaagggcaaatcagtacaaatacagttaacccttgaacaatgcaggtgtgaactgcatgggtccacctatacgtggattttcttctgtttctaccatccctgaaatagcaagagcaacccctcctcttcctcctcctcttcagcctacctgacatgaagatgacaagaatgaaaaccttcatgttgttccactttcacttaacaaatagtaaatatgttttacttccttatgattttcttaataacacatttctttagcttgttttattgtaagaatatagtatgtaatacatataacgcacaaatatatgtcaatagactgtttatgttattgataagctttccagtcagggataggctactcgtagttaagtttttggggagtcaaaagttgtactcagattttgaatgcacagggttttagtgcccctaaccccgatattattcaagggataactgtaatcaagacctgacaagtcctgtctagtcatcaaatcaaaagttcatgagtgaggagagatgtaggagaagaacttaaggatgacagaatgaatacattaaggaataaagtagcaagtaaggaacagacttcaaagtaaggatgaaggtccaattgttttgccaagaactgggcttgggtgttcacttttcatctctaagtctgttttattttagcccatattatctccctcttatttggatataagatgtccagtaagtgggtaacttgcctgtttggaagccactacctgttatgaacaaggcttaacttgttcatatttcattcagtatctcccaaatgttgaaataacgatttgggcaggagagttagttttataaagacatcccaccataaaagatatttagtattcaataaagcttgcagttctttaccttaatgttgtgtcttaatatattgactcaggtctcacttgaaatctgaaacatgggttccatgatctatacacttaataagcctttaaataatgaaacaggatatacttgaagggccagctgtctttgtttctattttatgcctgcattttatgggcttgatcactaggactcagactggtccttggcaacattgcaaagttagcgaagatctttccagccctttcctgacttcctgctacatggaaattttttctctgactgcctgatgctctcatgctgcttgtatttcagtgtctgccttatccctaaaggatttgcctgccctagagttgtcttatgtaccagatctaggtttatcaatattctgggagtcatttgttaagttctcaatgtattccttcttatagagaagtctcttattcacagtctcatatattcggaccagtctagagtacaatgagtgggaatgacagtctggaaggggagaagacaaatgcaataccatctggtgcccagaagaacttctgcatacttaatcagaccccaaagccttatatcatcagcaaagtgggaagcttagtatctcacattcacataatttttagaagccatttcataccttataaattttgtcgcatttcagcaagagttcttgatatgtatttaaacctggactctcttatctaagtgctgtcattgggaaggacacaaagtgttactgggtatttgagacttagtgtggttaagcatattgttgaaaagatgggactatactctataaattgtgagaataatcatgacttctctatttccccgcctgggatattcaaggagagagtgctaaaatgaaaagtaccataaaagctctggagtagcactgacaggatgatggagacatcaccatggtgaaggttgtcctgggttgtgagatacccttaatttgataccttcttcctaaaagattaattcttacaaagtttgtctgtctccaaaatacaagggccctaatatggatcaaacaaataacagggttctcactggcttttatagaaaacataaaatgtcacttgagaatgagaagtccagagggaacacagttctccatgctggaaacagaagacagcaagaaagaaagataaagtgtgatctaaagaaggacacactgctcctgtttgtgtggatagatacaactgagggaagagacaatttgtaactggaaggataaggcagatttatgggtgtttatgtgcctatgtgacaaaagggaccttggggtgtaatgggctagatttaagtatgaagtatgactgcctcatgaaaatgttcattcatggaccttaaatcttgcacataatgaggacaagaaactgtagctgattcatgcaaatgtctccttatatatttcttaatattgcccattttcttgttcactggatatgtgagactctggcttcatcatctcatcctagtagtcaacagattccttcacagcatttactgagtccagctctgggaatatgcagaaggctgaggtaggccttctttcagtctgtcctcatagtcatcaaacctgagagggaaacaccttttcttctttgccttgtgttctctgcatcttactgagaagatgttgtaatgttatgcttttgtttgattttgtttcctcatagagactttcagactcccactatgtggtttggacacgaagtcagtctgagtgccaccgcaccaaccccaaactattgtttctggacccagtgtggtcttttctttcaaggaagaatcttgtccatccagtgcaggggttggaggattacagaagttcttattcctttatgtattatgacccccaagcttgtgagctggtcatgagcctcaaggttttcatccactttccatctcattaggctttcagccatccctgcaaatagcaccatcttcctaaagccctggtcattactccgtaactctccaaacacaagtatttactggtcctgactaagagacttggcttataggggatctgagtgagatgttggcccttattcttagtgagttacaatcttctgagcagacaaatacgcaggaaataataagagactaacagaagataaccaggtggtttggatgatcagtgccattcaatctctgctcaaagctgacatacttaccactaacccaccaagtacagatttgttctccaaattcagaaatgaacaaataattaaaaataatggtaagatgatcccagaaaagattagtgtagaaggagaggggtttgaggagacggtggtaacagcaaataatttgcagctcgagaaagatgatcatgatgatttcacattgatcaaattctatttctatcatatttatatgaattatctcatttgatcttcacaaccctaagatataaataattatcttaacacacgaatgtacagtttggaatcattgtaccaaaaagacacatacactcatatgttcatcacagcaccattcataatggcaaagacacggaatcaatgatgcaccgggtaaagcaaatgtggtacatatacaccatggactgctacacagccaaaaaaaaaaacagtgaaatcatgtcctttgctgtgatatgaatgcagttggcgggcattatcctcagcaaattaacacaggaacaggaaaccaaatactacatattctgacatataaatgggagctaaatattgggtagttagggcataaagatggcaaccgtagaaactggggatgactagaaaggggagagaggaaggacggcaagggttgaaaaactaactattgggtactatgctcagtacctgtgtgatgggataatttgtactttaaatcacagcatcacgcaatatactcaggtagcaaacgtgtgcatataccccaagaatctaaaataaaatttgaataaataaataaaaggttaaaaaaaagaatgtagagcttggaaggtttgatgaaccgtcactttcatcgagaatacaactccaggaagtgagagtgaagtttccagaaaacaaagcagaaaagcagcaagagccacaatgagggtatattttggagtggcggagacctattcattgcttgatcaatggaagcatatttctccccaggaatctgtataatctatatctcagaactttctcccaggggtggaaaaagagataaatatccttgacttgtgtctccctaggccaacatttatcccctgggcctgaactgcttccgtgacagtcaattcatttgcagattcccaggagccacaatagtctgtagggaagcctgggatgggaggtgagaagcagggggtggggtggtcccagcggtgcctgtgtgaagtgggtctgaccccacacacagatgggacaagagtcaggaggtgaagccaagaggatttgaaacgaggcaaaagtgatacctagtccattactgttttctttgttttacaagtgaggaaatctcaggcacagaaagccaggtaagttgtctaaagttgaaatctgagatgtgatagggaggacaatgtaaacacagagattccaaactatcgcatccaaactcccaactactaattcctaatggaaagggttcctcttgaaaactttcagagaatgacctactaggtgacatagactaaaccttcaaagagcatcaacaagaattgtaagaaacctgtgagtgagaagcacttactgagttaccagaggacagtgggaactaagagggtgtctttaacctggaaagcaaccagtgaagccaaccacatccttcaatcccacatcctttgatgccctcacctctcacgcacaatagagatctgagctgcaatttggcacccttaaatgtacttggctatgttccagaacagagaaaaggcaatgttcgtatctgtttcacgcttgcctcgtgccagagactgctcagtatttcacgggaacaacacttcaaggaagttaatagcatctccatcttacggatgacgaaactgaggcttagatgggtaaaggatgttctttgcttccccacattgtttttctggtatatatcacaggcgtatgttttgttttgggtctgtatttgccttctagaatgatattcaagaggtggggttataaaccctggctgggcattagaataatttagggatcttgttaaaattacagaaccccaagctctacctgaaacctaaggcattagacctttttaacctaggggaacggatatcctaatgtgaccatatttcactggggatctgatgggaagccagggttgacactcaaaagaatggacagaaaatagtgaacatgttcctgagctgcatgaaagaaatatgcaagattcagaaccagggctgggggaaaagacagtcctgctcttctttgtacaaatcaaatcacctctgaagaggtgctttgagttttgggtagcttactttaagtagcagaattggaaggaagaactgtactggggaataggactgtgtccagggcaccaagacaaagccagacataacccaagaggctgacaatttggggaagtctggtgacggcaactctctcacccacagttaacaaacaaacaagaaatattttctccgggctcagtctctgtagttttggcagcagggagtcagcgtccttcctgaaacatgccctgctgtgttcctgcccagtcttgccagcagctcagtctgcatctgggcttttccccaccctctgttgcctaatccacagcatccttatccctcccctcaggccaccaccaccccccttctcccacgcacccaggctgtgttttagcaggacagctattttctgccattcagcactgagtgatcatcatcaggtacagcttcccaaacacacaactgcgctgcttgtgtagcctcaggtataattacgaaggctgtcccagcactcgctacctacactatacttaatggggagggatggtctcttgttctctattaaatattttgaaagagaacccgtaggcatgacaaggttcaggcaccaagcagaaatgggaatcggagtgcccctgctctgacaggcaagcacaagttttaattatctgctcatccaggatttaaaaattttcgttttactataaaaagcagaaaaggaagacaacatgatttcatgtgcttacaggaaatgaaattggttgagaatattgtctgctgtcacttctctcttatttcttcctttgtagtgtttatttttcctgttctatgaataataaatactgaaaatataaaaattacagaaatgcataaagatgaacaacttatgaccccacagttcagacaaaacttctattaacatttttatatgttttcatccagtctttttcatgcacactcacacatacccacatagagacaaaagaattgattgtattatggtagtttaatattctaattgttttgttttgtgttacattatgagaaaatatttatgccaatggatacatttgaaaaacaacttttctaatagttctatatttcatgtttcactctgatttatttcactttatttccctgttattggatatttaaattatttccaatcctttgttgataactcttaataaattaataaatcacccaagatattaatcaagctcatcctatgtgttgtcactgttcatgtcagcattgtatgaagagtgaatgggctttggtgactgaaatgataggactaaatactgattctaccactagctcagggcatctaggaaagtcattaaaaatttactcatctgtaaaacagagctcatgctaactgctttgcttatttttctaattttgttctctccatttcctaggacaaacaaacaatgtcagataatctctttctacatattcttactcattctgtttctctgaagttgcaactacacatatactcacacaattcctttgttaacactacctcattctcaaggtcaaatccaaattctacatcaacgtctccctccactggttttcttcatctctgacccttctttttccaggccctgcacggatggcatcaaggtactttcattgactctggctcttcacctatgacttcttatgcctttgagtctgccatttctttttcatgggattttctcctgacattcctgcatccctttttatccagctcctcctcatgactgagaaatcatctctagcctcaactcctcttggaaggattccaaatcccaaaccacaggcagggctaagcaaccctccttgctgactcttagggctgaaccatttactcagtaaaagagatgctctattttgaactttctcaatttgaacgtttggtgctttttccctcatttctggcaacatttcaatgtttctttgctttctccttactatatctctagatatttcttcagctatacatggtcagatgactggagttcactagaggtaaggctatcctaaacctcattattctatggtatctattgacagcgtatgaatgagtctgtgaggcttattacctaatattagaaataaaataaatcaccgaaaaacttgaagcaaagtagttagcagttcatagaaaaatcctgagttagattcctggctcagtcttttaccagccatgtggcattgactgagcctccaagatgtatgttctttatctgtttacatgaaaatcatatttgctaattcttaaagttatgtatatagagttatttctaaatgacatataataatcacttaatgataattttatgagaaactattttcagctacctgttatttttacaaaagaatcacattaaaagatgctgttaaaactatgagaatacatgagatataggtggttattagtatttggcattcacacccaaatatctaatcactaaaattattattaataatgaaaatgaggcagatgatcatgacatttatccccaaatctctagcaccttgcacagtttctggtacgtatttagctcccagaaataaacactgaattgaatttatggtaaaataaatttttagaggctttgatattccatttttaagcatccaatctattctatacacactcatattagcatatttatgtgacaatgaaactattgcaaacagagagaagattattaggttatggatattaagttaatggggaagatataaaatatttaatagcttgggctagaccacatcttttagaagaagaaactgaggatgaaaaaatttccgtgaactgccaggacacaaaatttgagaggggcggagttggaattaaaacccaaccttttctcaagccaattagaatggcaattattaaaaagtcaagaaacaacagatgctggtgaagctgtggagaaataggattgcttttacactgttggtgggagtgtaaattagttcaaccattgtggaagacagtgtggtgattcctcaaagatctagaaccagtaataccatgacccagcaatccctttactgggtatatacccaaaggattataaatcattctacgataaagacaagacacatgcacacgtatgtttattgcagcactatttacaatagcaaagacttggaaccaacccaaatgcccatcaatgagagactggataatgaaaatgtggcacatatacaccatggaatactatgcagccataaaaaagaatgagttcacatcctttgcagggacatggatgaagctggaagccattattctcagcaaactaatacaggaacagaaaaccaaacaccacgtgttctcactcataagtgggagtagaacaatgagaacacatggacccaggaaggggaacatcatacaccagggcctgtcgggggttgggggcccaggggagggagggcattaggacaaatacctaatgcatgtggggcttaaaatctagatgatgggttgataggtgcaacaaaccaccatggtacatgtgtacctatgtaaaaaaccggcacattctgcatatgtatcccagaacttaaagtaaaataaaataaaataaacccaagctttgcctccctaacacaatttagctttccttcatacttcaccagactgatttatctactccacatcaccggatttttgcaggtctttcaaaatctcatttatgcatctaggataaacttaaatttaaatttaattttatgttaagcattgatcaaacttgcaaagtccctctaagtattgtgttgctcttgttattgctgttgccctctctccccacctctaatccaaattcctaatgcttggtctttctttttaaacaaagaacttgttttcatagaaatgaatctcttgtggatttttatgttatatgtcaagctcccttatgaatctatccaaaacatccaaagaataaatcccaggacaggaggaacttgtattcacacatctaattaacctttaattgtctattgtgactgctttgcagttcaatagttgcttgatttttattgcccgcctaattagtgtggttaaagtggctttttaagtcagattttattatatcagtttgcttacgcaatttcgggatactccgggaagttccaataacattgtgattcttaagtgctatatatgtatacacatttgttgtttgtttgctttttctcctcaggaaaaaaagtgctttgaccaatttctcccactagagtgtatgagtagtctatgaaattccttaatgatagcaaaagccttttcattaattgtgcataaattatcaacacagccagtcaattctaattaatcatttttctacccaataaaccaccagattgacagatttagaattctgaaacaaggggagcagtgaaggaaaccacccaaaatactgcaatttaaggcaaactaacatatatgcacatctctaaaaatcagattctacagctgtaatttattagtgagtccatggaatgtagctaattgagtatgcatctatcaggggatggttaagatttaaaataatcaattagatgtacaaatcttattgcataccatggatcttttttcttctttttgtttgctgttttattttctaagtaaagaataaacttgcctccaattatataatttgtattttcacatgttagcattcttttcttgttccacaaactttctaaattactgaaaattatcatgaatgcaatttaattttctacatactgagcactatggttgtctctaatattggccacggttgtagtttcccttagactccctgagctcttgctttattttctttgtctctattctcttggctttaaaatagagttaagcagtttgaattatttctagatctctgtctctctctgtattggagagacaaaagatctagtgcttagcagagtcctcaactcatcactaatagtcaaagtattcagtggcaattgccctgtgtatgaaaacagcagtgcaatacagagtaaaagtactggggcatgctgtctcttgcacagaacaggaaccaagagtaatgggttctattccctactctatgtttgatttactggttagccttgggcatacgatgcttcttaccctttcaatgcgttattctttccatctggaaaacaaagataattgtacttgtagggagggaaaagggagaacctgacataaattagtttggatagaaattatttgcaagattcaaaaatgattctgaaatgtaatccattccacatttattgggcatttcctatgttctaacaattgtgctgagtgctaaagaatacagagtttgccattacattggtgctcattatctgataaggtgtagccatataatggtaattataatataatgtgaaaagttaatattgatgagcccaactatctatttctagcagagagaactgaactaaaatttatttgaaacatcttctgtaactgttggctcatcataaatcaaagtgaattgcatttataaggatagtttgtctattagtaatctgaatgaaggaagacagggaaagacatctggaaaattaccacagtagactggattatcgcttgtaactctttcttccccattgtgaaagaattacacatgaattgtctttaccacttgactttgtagcgactcccattacaattgacagagtgtgcatccgtcttccattgactgtggttttggtgtaatgacttgctgtacccagtggaatacgttgggccaatgaggagacattgcaccagttctgagttgagtcttgaagagtcatgggaagtttctgccagcctgatgggatttcctaccatttgccaggacaagatcatgcttcaagtagctttgctccttggcttatgataagaacaaagaaatgctgcacagactgaactccaccaaaagcctggattccagtctaacccagatgataccagtctagaccagctgaccctcagaaacacttaggagaacaacataaatgctgttgctgtaacctttgcagacgtggggactgtttgctcacaacattatcacggttaaggaaagaagctggttaataaaacatctttttgtaaactcaaacaaaattattgactaaggaagtggtcatcaataaatgataaaactattaggtgagaggttgatgggaaattgagtctttacatggtgtcagactgtaactccacagtttcttgccaggcagagagaacagacataacatcaatggagagatcaagctttcactaccttagtacagtgagtcactaattatgtgacaaccagacaccataatacagcatatgatgacacatcaacttctcagcatgacctatgaagtgtttttgccaaaagtgattaacctgaaattagcagagtcctaggtcccaactctccctttacaggaaatacaagggatagagatagaaattaaataccaccagttaacatcagaaaaattcatcaagcacacgttctataagacaactgactggttacttcaacaagtcaatgttacaaaaagaaaaagtgacaaaggagtggaaaaaaccatattacaatgcaatgtgtgattctagagtggatcccagtttgaatgaaaacagccgagaaagacactggaagacaattgaggacatttacgtatgggtcagcttttagaatcactcagaaattattatatggttaggcttaatatacttaatatagtattgtagttagtagaaaactgtcccaacttttagacatgtataaggaattatttagagtttatagcttatatgtaaataattgacttgaaattacataaaaacagatactaaaattatggcaaagatgttaatgctgattaaatttggagaaaatatattaaatgtttatgattctattctttctaaattgtatatgtttgaaaaattctaaaataaaaatgaccagtggcagtgtacttaggactcatgctaaaatcatttgagatgtcactctgtgtgcaatctggccctatgtttagtgttgtttttagtgttctccaattatttcactcatttaaaggctgtatccagaaggggtcagtaagctgcataaagataagcaccaagttttatacttgttttcacttagcccaaacactcagtgggtatgcgagtaaattcattccattaaagatgatagaaaggactttcttttcattatttgctattacattatgtgactatttattgccctcctttgttcttatcagaggaagcagagactctggttgtgtgtctccttatcctatgaattagttgattaaatcagtccaggcagtacccacttgaagcaatcatgaagccagtcaaccggctggttagagctagtcagagatcacccaccaccactgctccagattttctctacatgtcagataatacagaatggaagaaaacagactgtgtgtttaaataccaaatgggtccacgcagtgtattttttaggtctccatgatgggccaaatatatttagaaaggagaacattatgacttaaatatgtatcaagaagctctcaaccttggtttcagtaataaaaaggtgtccatcatgttaatatcattggattaattgcaccacttttttttgaatcctctaatcaaatgtctcatgcttgtcatgtaattgttgaaataccagacttgattgacagatattgcaaattccccaagggtaaatgtttccaaaggaaaacatagtcatttcaatacagcaattaattataaacagccattaatgacaagtacacaggtctctctctcaacacagaggtcagaaaagtaaggtttttcctgaaagagatgaaaagttgtggttaccatcatacagatataatttttcaaaatattaatgaaaatgatacaatcatttattttcacccaccacatttcaggaaacacactcaatactctaagcatattttttaacagggttgttggtgtggggaggcggtgcttttgactaaaagtcttgtatgctagcaacattattttaaataataatactaataatagttcaggtggggattaaaatataatcaaaacaaaagtaacaaatcagtaagttggtaacatgtgaactgaagccttacatggaagactacatttttcaatggttttttgttttcttggaagggcattaggtaaatttagcatcagatgtcatcagtataaaataatgtaaaatattgaatcaaataccctgagaattcaaggcagaagtagcactatatacatatataagagaaagaaagggagcagggcggctttgcgttgtaattgtctggatgaaagtcgtaatttctacatcactcttaatgtacagaattaaggtccagagtcaagtctggacattatcaggaattgccactactgattagcaataatatttaacaaggaagcaatggaccacacatgggaaaggaaagacactgttgtgaaatgttgacaggaatttatttcttgtccgcaaaactggccgaatgatttatatattgtagttaggaatcagacgagaaccttatgacaattgggaacagtatggattatgatgaggaaacaggaagcgtttcagaatatgttatccacatgtattataagggtgacttttaaggaaaaaaagaagtaaacttttcagtggcagtttagaaacagttgaaaacatgcaaatacagttaacagtaagcacagacatatttaagtcaaagctagaagtattttaaagaacctaaatatctatatgtgtgtgtatatatatacatatgtgtgtgtgtgtgtgtgtgtgtgtgtgtgtacacacacatatagtgagagagccaggtgaaatccaaacatcagaatgtcttcaacatttttccagacatcaaaatactcgaacaattttgcctcatgcatcaaaaataagaattctatcttgtctctcttcccactccaaaccacaactctgaaaggattttccaaaaaattgcttttatcatgttacacctgaaccagataaaataaaataaaattaaattaaaataagcattgatggcagcatatctcaccactctaccacatcaggtctatgatcgccaggtagggctctattccaacatgcttgtcaatatatgattctcttaaactctatatgaatacattttcttcagtttctacttgcagttcttctgcagggggctcagattaaaggatctgggtggagggacaatttctataaatatcatctttatcaccccatccctactggcaccacattcactcctgttactactaatactacgatcatgaagcttacttttaaaatttgaactagctttctccaatcctttcaactttagccaaaaataaaagcctcataacaaactgacccattagggaggttcatcaattattacttaaaaaggtcctaaaaatctcggtttaagttggaattccttctacaacttattatgttaaatttaattgttgacatgctcatctttttttattagactataaaatttcaatggcagaaattatgtgttgttaatttctcttcctcagtgcccagctaatacttaggaaagcatgttatataaaacaacaagtcatcaacaggcatatatgttacaaaaaaactcaaggcaaggaaaataaagaaacacaagtgggtttttggcatgtcattttcaggaaaaagcagtgagtagatcggtttttctaaaatgaagccctctgagttggcatgtagagagagaaagaattgaggtggctgttaggatgttgcctacaggctgttaattatcgccttatttgaaataatcattttactattcagaacattaatttaattttaatggactgacattatgatggtttaattgaggttaaacagtgaagtcttatatttaattaaaagtaaaaaaacctattatagagtattataaaaaccctgtatgtgcctgccaatttttaccccaagaattagctagaaactctcttttcaattgacagtgaaaatttgttctgcaatatctatttggttttacgtatttgttttaaagagtatattcagagagtttcagagaaaagtactaggccaattaattggcaaattcaaaacttcagagttttggccctgcccttcagccccactgcaaaaacctttatctatacttataatggacttttcactgcagctgaacaaaaatgccgcatcttggtaccttatgcatgattttcttatcctaagatatctgtgtatagcttagaagctttgtcttttgacagtaactacatgacattcatcgaatctggtggaattggtaaaataagaatattgtatctctaccaagagagtatcagtgactaaatcttatttttcaattttaagtcattattaagatcctaagaaaagcccagccaaaatatggagacagataagaagctctgtggggttctgagagaagagatgaagctggcccaaccattgtctgatttttttgctctccactgagaatgaaacacatggaaataggattgaaaatgaaacaagaatcagcattggactaacacagctggatgttaggcaaatgcttattatgtgtagtgtttacttttccagaggagagggagacagttgtaatacttaagaaccaaacttctagaaatcaaacataattctatttatgcttctccatcccccaaacagtaaagctcacctttgttaatgtttcttgctttctcaactgtgtttcttgcactgtgctaatatgccttttatctacactatgttatttaattcttttatccaccatgtaagtccctcactacaagttctataaggctgtgtaatttgcccaaattcacacagattctaaatggtgaatattgggctcatatccaggtcattccccaaagtctaacctcttaatgactatttcacctgctaatgaatattcctacattaaattataatacttcattgcaagtaggttttttgtgtgtgactgaatccagtggagttaaaagggatcttcaaaaggcactccgagcacccttatagtttcagcaaaatgacatgaaacctctctccttgtacctctcaaaactctcctcctctctaaataaataaataaatggatagaggttttttcattttatagcacaactttctttagttaaccattccaatatttattacctcttctgcttgtgcctgcctccttgtgtgtaattcaataccctcaaaatgcaatttgattcaaacagctggtccagggatgcaaagtgcctgtcttattctgggttgagcgagtgactagccctgggctggctgctgtggcagggcacaaagaaatgacctcagcccataaggagcttaaaaactagtagataaaatgaggcatttacacattcagcatatagaggctatattgcctgtgtgtaatgaagtggtaagttgagtaatagactaatactaaccagatttcagacagcccacttgaagagacaggagtagctgagggtgtcttcctaaatgagatgaacccatcattggccttgaagaaaactagcttttattgaatgctctctatttggcagaaagcgtggtatatggtagatacttcacttatacttgcttatttgatcttcacaaaatgagcattattatctttttatagtttatagaaaatatggttcaaaagaaagtattgactgtgtaaatccacacagtaagtttttgaattaggccctgtccaacttatctgaatctgtccatctatccatccatccccatccatctatcttttttttttttttgctttttgcattactttacaattgcctccatgattgctatatcttgtgcagtaatatttacaatttcttgcacagaatccgttgcttttttgctaatagctcttctgcttttctttgtaggactgtcccacctcagttctcaatgtgtgttcttcaggtagggctgaaatcttcccatcaactctaggggtgaacaatcagcaaaataagcctcgctgaacacagcgattatttcagctggtataattggtcatttatgtgtgttgagagaaaagggccttctttctgttaaggatctcaactctgaaaataggagtccatggtttttagttgccaccttgctaccgaaaaatgagagggtatttgagaaagacatcatcagagaaaaagcaaatgtcaagtgacagggacagaaagatttgggcactagcatttgcttgcctggtcatgcataaattaactttttatttttgtctcaaccagttggatttgatgttctgccatataaaatcaaatgagcccaggcttacatggagggtattccaagaggggttgacaatttggaggtgacaggatgaaccaaggttaatgatgaggaaaatgacacgttttaaatgaaggcattaaaaatgtaaggctaaagtgaagtagaggtgttacataggagacagtagagcccaaatcccttgcactagctttcattctttgcaataaaggagaattcggttgacccatgaggatggtgcagtgacatttaaagcaccacagcaaaaatgcactgaatattaaatgcactgtagaaataatgtgcatcgtatgtttgtgataaaaagaaagataaatataattgtagagactctatcacaaatagaaaatctcctgtgaaatacacttatagaaacggtcaatgttttatgcatattaaaacattctccaagatgatacaactgccagcagcaccatagttcattttaaaagacaaatacattctaaaaataaaataaaactagcaaacacattatttgttcaaatagtattttgaggtcaaccaagatgcacttctagttccttgcaatttgagggatttttataaaacagactttcaattgagattttgagaaacaccaaggcaagttaaaatcttcatgactttattcaacaaaaaggtggcagcaattttttaaattttgtgtgaaaagtcctacaacagcaaaaatgacctataaaatagttcaaataacagcctcatggcaaaatgactttttcattctcctaagaaaagtcaaacaaagtataaatctattcaaacagatggacttaaattgcaagcattaattcaattcaaactttggtgcattgtctaaaaatcgctgttgagaaatagctttaagtctgaattatcaaaattagtaattaaaattcctaaaacaatccaattcaacagttactgagcaattactatgtgccttactctatttagtatttaaaatacaaataaaattcatccagtccaccaaggaatggccttagtatcctcgtctgtcatataggaatgatgatggtactcataggattgttagaatgagtaaattagtttaatatacataaaacacttaaacagtgactggagcttgacaaatactctttagagggtcattattattgctctgtgaataggtatattcacaaaactgtggaagcattgaagaggtaatggttagttctgtcttgggactagaaaagtcttcaccaagaataaataatttaagtaaacctttaaggatgagtagaagttcactaaatgaaaaagtgtgggtggcctctctagggagagactgatgggtcaaaattctagagccacagtagaacttgatatgttcaggaagtgatgaacaggctgcatttgatttgaaagggtactggaattttattctctagggcataggggataatcaaatttgtcttttttggcagactagtggtataacaagaattagttttaaagttgcccctaaattatcatgtgaatattatcatgtgaatatacatgagtagcatcatatgaaattagaagcacctggcttcaaaccccatctgtcacttagtgacttctctttcctgaaaatataaataataatacttaatttggagacctttcacttaaaagagacatttttagactcccatcatgtggcaggcactctgtggtgcttttctatatatatggtgataagtatataagatttttatattataaaagtgtcagacaatatgattactaatgtgttaatatccattttaaagttttttggtttaattaataaacatcaggcttggttacactcattaatgaaagaaaatatgaagcataacataagcaattaaaatagtataacaataggataataaagcacatcatccatcttcaacagccatcaactcacaccaaccttggttcatctgttgctccacttacctcctctactttctggattaaattgaagcaagttccaaagaactattaattcatttgtaaataattaaatatgcatctccaagagataatgactccttgaaaatatcctaatatcacatctaataaggaattaacaataattatgtaatattttcaaatatccagattctgctcaaaattatattaaatttatttgtctgaatcaagattcaagtaagattcatatggtagttggctgacattgctaaagtctttcttgatcttttcatctcttgtttctgtgaaatttttattttgttgttgtattgttgaagacacgaggttgtgtgtccggcagtttcaccaagtgcagattttgcttattatatctttgaggtgtctttaacaagatcttctagccccaatactttctgtcagttgttggttagatctagaggtaggatcaaagttagatatgtctttttaaacaggagtacttcacaggctttgctgtgtatgtttatcaggaggcacactatgttatttgatctttaatcttgagatgattggtaattatcatttaggactgacaaaaaagcaatattttaattctatcatttcttcttcttttaagttgaagtacttctatgaacagaaatcttcccttatcagctacttggttgagatacaacaggtaaattattgataattaccctttatttataagcttttaaaatcgtatgttgatacctcaatagtctccaaaggtaatcaaagagccttttaaaatatcattatgaatgaataaattgagaaatatctgagaacaccaagcttactagagctcagatatttttcatctttgggcagtgaaagctaagtcaggtaggctcttgaatacttttgggaagtttcttgtcaacatataagatattccagactcatgtcatatatttccttctgcagacctagaattcattatttctccaagaagccctgggtttccttttagtggaaaatagaacctatctagagaccaaaatctaggagtgcagaatgcttattgctattgggttgttcattatttctaggtctttacattgacagagcagaggatactttttttttttagaaaataaaatatattataaatttatactgatgactacaattcaaatttagggttacagtattttaatttaccctcatcaatccttcatttttttttttacttctatgtcaaaaatcttggttttcagcaacataaatgtgattactcatttgccttaatccacactacatataaaacactcactacaaaattaccaccaccaatataattatcaaaaacacagtttatggtttatagttcctgaagtttattttgtccttagggtatatctcagtgtagatatacagtgaaaatactgtgctttataatcatttgcaatagttcttccttctatagtaattccaccaactggatatttaatgaagtttatctgttttctttactttcagaatttagatattgtttttcaaatctaaattacatttaataatcacataaactatatatgtgaactcagagtcaaatcttcaaagactattgagacatgaaaaatgttggttgagctgccacgtttcaccaagggaatttggcggggtggtcactaaattcatgcatttttgaaatttctagttttagaaaaagactgagggctcacccatctagaagcagatctagtttgagaatgaagaaagttggctggcaccaagcaccaagggacagtagcaatgtgaaaacacttcagaaactgctcagatcatttttgctggaagaaaaagtacactaccaagtaatattttaataggtatttatttcatcggaaattttaaaaaatcagccacaattttcttctacctttgtgaaattttgcgtgtgatttacgagttggcattaagagatcacttaatacttgctgttctgccctattctttggcattctatcataaacattttccgtgtggtagcatattcttcctattttcattttaatggctgcatactatttcatggggtgaatggaccttaatttaattagtctgcactaccgtaaaatatttaggcagttttcccttttcttttttttctgttacaattatcttccagtgaacacacgaagctccataaaagtaattttaagcgctttgctttagctgtggcagcagtcgcaagtcgtatttttgatcatctgggtgcacaatactttaccaggtcttgctcaccagttagataaaatatttgctagttatgatgcaaggaagagcaaaaatagtaaatattattttgaaccagctgccaagagaacagatggaatcccacagtatccaaaacatttgacctgaagttgtcctctgtgaccagatccatttcttctcaaaatacatttttcaagcagtagttccctgaccagtagaaaatgctgcttttatctttctcttcttttgtaaatcatactgtatgctatcttgttaaaacaccccatgccagagaagtatgaatgaataaatcttcctgcagatctaggtttccttcaggcataactaaacctggcaaacacactgttaaaatgaccagccacagcactggaccccaagagagctctatggtcttacataataactgcacaacaatcaaagaggccaatagagggggtgagctgggattttttttaggtagggggagggagcggaagtaaaaacagaagaaaatatgagctgcagggctaattggatgtaatttggagatttcaaagaacactgactacaaggtttgaagaggtgcagtatttttgaatgatgaggcaccagaaactccctaggtagcattttgaatttaatttaaatgagaatccagtatttgtgcaaacctggggctgttaggatgcaagactatcttgggattggcattggcaaaccatgcacagagctgtgatgaagaaaccctgtcagaagacggtgcattatggctttagagagtgaatttctagacagtcaaggttgtgtgaaatggggtactttcagcatccctagagatgatgtcttggttggttggatcttggattttgcagattactgatgaaaacattttttggagatataagggactgaaggcataatatgaaatcttactttcaaaaatttctatcagttaagttcaaagagtcattttggggcttatggggatttataatataagtttgtgacaggtgacattattttcttatactgggccttgaattagattgaataattaactgtgatttaagatttgaagaggccagtattttctaaatactaaaacagtggttttggacgttttatgcttcagagatttaattcctgcaagattaatttctttgtaaaacccaaaaagtatctatattttgaatcagacatccagattctttaggaagcaatttttcaccaaagataattgctgctgagatttaaatggatagaatcctagtcaccttggagcatgaaacatgtctaattgtcccatcattttattagaatattattttatttaaaattttgccaacttcattaagacataaagaccaagtgagaaagagcaattcatctaaaataattagctggaatttttcattcatgggtcttttgccaaccttaatcattaacctggactttaacaacttgtgcattcttgctgacagcctgactctcatcttgaactctccaacccaactgaagtttttttcttgagataaactgcacactgactcttcaagtatctgaacggcgggggaaagcttagacaaatagattagtaacaatgctcaggtgtgttgagaaatgggcgaacgaacggctgtccttgactaactctctggatgctcagagagacatttttattgtttcgtgcagtccttgtttaataccatgttttgaaatacactgcaaagttgacaagacgaacagtggagaggtggaggtcttcttatttctttgtctttgtggcaagtgtcaaatctcactttttccctaagattcctagaatgcacagctaagaggaaacatgagaatttatctagaataatggcttaacaattatttcatcatgacacatgagacagctggtggatcatgttgtgcacctcccatgggttattttaaatagttcctcaggtgtttggaatgcgcagccaaatttgtgaataactggctggtggaaagaagatggcaccatatcctcgttgataagataaaagctttagagtagaaaattgctatcattaattttccttcaaactttctctgccccctcttgcctctaagtcagatcaattgtcagcctgcttctctgccttcgctgaattgacagttgctaacacactgctaatggctaactgggacttattgattacagaaaaacgtttggctcattcaaaatcaaagtgataacatgtttgaaaagatgcttaatatatgtatttaaaaacagctctcacaaaagattggttaagggctttaagatacaaagagctgttattaacaaataaagtggacttgggtcgttaacgggtaatgtataagaaaattaaaatgggtgataacattttaaaagaagtttgcctttattaataataagataaatataatttcaaactataacagcatagcactgtgcattaaatctcatttaattggcaaaagggcaaaaatgatgcctggcagtagtgaaatagtgaggtttctacattgcagaggtgttgctaattggcacagccactctaaagaaagattagacgatatggacctaaattcattaaaatgtgtataccgttgaagcagcatttctagtagttagcataagaaaataatttgtcaaatattcaaagatgtttatacacaaatgttcatagtaactttttaaaatattcaaaataaaaaaaaccctcagtggacaccaatgaataagttttgaatatcctttcaaaagactatgagatagccatgaaaatcaatgatacagatgcaagtgtatctatataaataaatctttaataaatatacagtgttaagtaaaaacaccatactataagaccatatgtatgtacgtatgtgtacatatatacaaatatacatacatatctatgtaacttgataaaatttggacgattataaatgaacatattagcaatatgctccctgagatgatcgttttttctctctctagtgctctatattttataattcacttctaaaattttaaaagaacacattattaaatttctgaaaatgaaaaattcctttactttagacaaatgtaacaagaaattatactatttcaaaacttactggtcgtgacctcttaagagtttatttcagtgtctttgaaaagctcagaaagacaactggaactagaaatataggcaggggttttttattctgtccagttcaggataatactaataaactaaaataattccaacgttataggacaagcaaagtctgatttggaaaggtcagtttatgaaatgagagtcgagttaatagcaattctcttccccctcaccccattccattataatttgatcatttaaatgagaagacaaatatattattattacgaaagatgttattaggattcttcccatctcaagcttggtttaaaccccaagagaatagctgccaaccacatccagattccaaagagaggcctgtgggtgccagattaccaaagcaaggtttaccaatgagatagccaagagccagttttacaacccttaaacccttagctgactgtccacctctgatctatagaagggatttgacagattgagagaatgtggtgtagattacaaaagagttttagaaaagatttgtaaggatactgtgtgcccccaacctctctgcccttctggtccccacccctccctaccatgtgggagggatgaagatgcttctccctgatttcaagtctaaaaatgggagtctcgattgaactatctggaacatttgatatgtgtctccctagagctagggtgctgttgcattggtatctagttgatgcctgagagatcaaaaggcttgagattatggctggccagttattctcattcaggacaaagatttgctgcaaggaaaactgcttaaatgcccagagtttatcagcatatagtttatgttttttagggaccaaatgtgaccaagatgggaggtggggaaggagattctggagttgttttaaagggggtgagaaaacctcaacagaaagagacctgtgttgaatgcctacggctgctgagcagagagtgaggagctggaagaggtcatttgccagctcgcaagtaagatgctggagtttccgacaaacccacacatttgacccactgtgagtcccctctaaaagcatgcctccttccgagacagcaccactcactgcaggccacgttcccctgctctaccccgcctctatcctgaagaaacctgtgaatgagggaggagttaacaggagaaaatgaggagtttttcctcaaggccagagctaaaggaagagacatggtttcactttaaactaagttgagcatttggatgactctgttaatgatctgagagtacttttggggactaaagggactggagaaatctttatgatctgagaatgaccagaaaactcacagggcctgcctgcgtgtccagtgtcaggaaaaagactagcgaaagactctctctcctttatttgtatttatcatttaaactaaatcatacatatcaagacacttcacttctaaaatgtaccatgcacctcttaagaatagggacaattgctttcaggaccacactaccattattgggactaaaaaaaaatcaattatcaataatttccaatcatctagtgtctggtatatatgcaaaatttcccaaatgttgcaccagtgtctttgtagctgttgtcatttattcacttatgtatttaattagtatctaatctggttctaattatgtttctttagtctcttttggtctagaatattccattcgttgctttttattccactccattttttaaaaatccaggatattctttttatagaatatcccataatttgtatttggttgattgtttcatcttgttgcaattaaatatcttcttctatcccttatattttctgtaagcttaaataagttagcttcgggttaaatattttttctctgtcttttttgcaagaatagataattgggaatgctttcttattatgtcatatcagattgttctgatattagatatctaagtgtatccacttggctaatattgttactttacagtttttcctttgtagttcataagaaatctaattctgtggttggggaattgtgagtactctgctcccgaaccatttctcaactaatggttttagcactcattaatgatacattcttaataaattacaatactatggacttgaaaaatggtaattttataagtactatatatatatatttgtatttatcagagagtttttctctaaaagaagtttcctttttgttttccttttcttttgtttgagcataactgtgtaactatggacttagggttttttttttttttttttttttttttggagaaggagtcttgctctgtcacccaggctggagtgtagtggtgcgatctcggctcactgcaagctctgcgtcctgggttcatgccattctcctgcctcagcctcccgaatagctgggactacaggctcccaccaccatgcccagctaattttttgtatttttagtagagacagagtttcaccgtgttagccaggatggtctcgatctcctgaccttgtgatccacctgcctgggcctcccaaagtgctgggattacaggcgtgagccactgtgcccggccagggggttttaatttatatcaatgggtttcaattaattaccattgtgattacttttgctgctaaaattatcccaaatttgacaaggaatgttccttcaggctggctcttacatccatttttgagaggcctaataaatacttgctctctcacttattccaggatctccttaccttacaaacctcagacatagaattagctatttctccatatagctctggttcttttcatgggcaatcatatttagaaaacaaaatctgggtgctagatgtgcttactgctattgggatgtcattgcttctaagtctttttagtgggcagaactagaagatatattaaaatggaaatcaattactttgcattgatattttcattaaaaatttaacattatagatttgttttctcctaactttatttatttcatattggtttttctttctttttttttttttttttttttttgacagagtctcgctctatcacccaggctggagtgcagtggcacgatctcggttcactgcaacctccacctcccagattcaagtgattctcctgccttagcctctcaagtagctgggattataggcatgcaccatcacatccagcaaattttttgtatttttttagtagagacagggtttctccatgttggccaggcagtctcaaactcttgacctcaggtgatctgcctgccttggcctcccaaagtgctcggattacaggcatgagccaccgcacctggccagctggtttttctttttattacactgaagatctaactttttgtggattttattttattttttatttattattattttttgagatggagtctcatgtgtcacccagactagagtgcaatggtgggaccttggctcactgcaacctccgcctcctgagttgaagcaattctcctgcctcagcctcccgattagctggattacaggtgcacaccaccatgtctggctaatttttttgtatttttagtacagatggggtttccttatgttagccagactggtcttgaactcctgacctcaagtgatccgctggccttagcctcacaaagtgctaggattacagtcatgagctgccaagcccggcctttttgtggattttaattgtcttaatgggttacaatttgctttatcctaattgtttatatgtgtgtattactattaaatttactgagtgaaatttagatacaacatcttcttggaatacaagctttgcagatagatttaaaaatataccccactaaaatgtagaggtaatactgtcttcaacagatatttgaaacaattctttaatctgcatggtcttatcaattaagttcatttggtaaaccaaatgaattgataaaaccatgcagattttggcacttctgcctgtgttttatcatctgctatctttttcttttaggtaagattttgtttctcaaatatgaaaagcttttacatagttcaaaagttaaatgaatataaaaagtatattcagagaggtctcattcctatcctgtcctttctacccaagtccctatccttatacagagccatttttttaagtttttttttatttgtcttttcctattaccctatcattaattggtgaatgaggcagaggagttatttgcctgaacacacatggccacagagtggaggagataggatttaacccagagcagtctggttgcagaagtaaacccttagctactttgcaaacggcctattaaagtaagactgtgggggaagacaggctttgaaattagcaggttttatcacttgctatctgggtgactttgagcaaattccttaacttctctgaggtttattttacccacttatgaattagggataataatgtttactttgcagagcgtaacaaagaatagagataacttaagcaaattaagttgtagattgtcaggcacatagtaattactcagtgaatgttacccattattataactagtaaaactataatagtacgactcatacagaagaacactagaaacttttattgttcagttgtcactgaagtatgtgttgatctgatctatgttatttagtaagattaaaattttctaagagttgatgaacttgaacaaaaagcaaacaagcctgggtttgataatttatggtttcaaaaatgttaaaataatctcagagggctttgctgattttggttcatttttcaaaatagaagtttcaatattttagtggaaaagaatgttttactactactagaagtcatatagaaacaataaggtaatttctagctgaagtgagttttacgtaaacttgtttaacttcctcattgttttttttttctgtttgcaatataagatattcttatgctcctcatgttttaaagaatttttattctgtgttgaacacaaagaagtttgaaccatgcagaggttgaatttaatttgtataaaatcctcttaatagcatggtctaattaagacacccattacattcatggaatgctaatttaatttggagggaaatgtagttgagcactattgggtttaccataaaattaacacagtggacataaaatggatgtgcttattagatattgttatcagaaatattatatgaatgaaaatcacaatactgctatcttgatggaaataattgttttacagaataaggcatactgtgtgattaactagctaatttatatgaagctatatgagcaagactgttagtgaccgcttttctgaagacaaagattattcaatcgtttttttctgacattagtaaatgccttggcccctgccttagagagtttgttatattggtgaaatttatcatggtagattgaacacattgacttgtattaaggcagcagatctcaaactttttatctcaaaatctttatacccttaaaaattgttcaggactccaaagactttttattgatgtgagttatatccattgctacttacataaaaaattaaaatgaagacattttaaaaatatttttaatttatttaaaatagcaacaataaaatctcatatgttagcataagtagcatagttttttaaaacatgaggatattccaaatgttgacagacttcattgcaaattgtaagaaaattacatttgttaatatcacattcttgaacatctataattactgagaagctttcaatgtgttggtgaaagacacacgtttcagaatttgactttttgcttaaaagctgccagttattttcttcaaagtgacagattcactcattcatttttttaagaaagtgtctgctgagtacttgagtctaaccatagtttattagtcattctttcaataaaaatcatgttaatgtaaaaagcagatagttcatttcacaagtcaaacatttgcacaaatatttttccttgaaataatcactgtgctttgatatgcagcagaactgctttatataaacttcccattttgtcacagagaatattaaaaagatgtgcaacaagtagttgatatgtaaataaacctaataatttttatagcttcaacaagaacattcttatataacattggcattttctcctgcctgcaggcgagtggccttgaaaaataccttgattgctggaagagttcagtgccaaatattcggtgccaaagacactagcagttctacccaaaattccttttgcatcattggcaccaatgccaatacagtgaaaaagtcaaataatgtcctagaattattaggaaaactgtttagaccttgaggaacactacaaagtgtcttggagatccccagggctctgtggactatactctgggaacgctgtagtaagatccatgtttgctcagatgtccttgaatcaggacagagaaagcatttacaaagaaaggtggctctgtttctgctacggatgcagactactctccatgctccctgagaatttggggtactatgagcctttgtaggaagatgcaaaacttttctggccccaaatcccaacagtatacctccttagatggtttttgatataagacttttgtgtcacaaacagtccataaagagggattcactttgaatatttggatggtggaggaagtgagggtgggtagaatatgtaaagaggctcaaatcacaaatcacacaatggtggaacttttgctatcgccacatacttggaaagatgactggagatacaaatatagaaggaaccatttgcaaactaacatagtacaaattgtacttttcttaattctttggattttattatttactttttgaagaacattgttttactttggctaatttgaacaagatatttgttacaaatgggatgagattctaatatcttgtattttaagatccctaaataagcaaggttttgtttcaaatatttagccttggaataaaacgttaacacagtataatataaataattatatttcgttaatgctttttaccacataggtgatgattaagggatgaaaagggattttcattcaggataagctgtttacaagattgaagactttaggaggatcatctgatctgttaccctcactattgtcctccaatccacacaggaattggttgagcataattcagagcaggctgtcaggggaacgactggggcccagaagctaattaatacaaatcacacttaagattttatttcaagtgctgtgcagaagctctttagtttaattaggtcctacttgtcagtttttgtttttgtttcagttgcttttgaggacttagccaaaaattctttgccaaggctgatgtcaagaagggtattttctaggttttcttctagaatttttatagtttgaggtctcacatttaaatctttaatccatcttgagttaatttttatatgtgctgacaggtgggggtctagttttattctcttgcatatggctagcctgctatcccagcaccatttattaaatagggagtccttttcacattgctcatttttgtcaactttgtcaaagatcagatggctgtatgtgtgcggtcttatttctaggttttccgttctgttccattggtctgtatgtctgtttttgtaccagtgccatgctgttttggttactgtagcgctgtagtatagtttgaagttgggtagggtgatgtctccagctttgctctttttgcttaggaatactttggctattcaggttcctttctggttccatataaattttagaatagtttttcttattctgagaaaaatcatattggtagtttgataggaataatgttaagtctgtaaattgctttgggcagtatggccattttaataatattcttctaatcaatgagcatggaatgttttccatttatttgcatcatttctgatttttttcagcagtgttttgtagttctccttgtagagatccttcatctccttggttagctgtattcttaggtatgtccatttttttgcagctattgtaaatgagatgtgttcttgatttgaatctcagtttgaacattattcgtctaaagaaatgctactgatttctgcacaacaaaagaaactgtcaacagagtaaacaacctacagaataggagaaaatatttgcaaaccatacatctaacgaaggactaaaatccagaatctataagaaacgtaggcaaaaaacaaataatcccatcaaaaaaatgggcaaagggcatgaacagacacttctctaaagaagacatataagtggccaacaaaagtgaagcaaaatgttcatcatcactaattatcagagaaatgcaactcagaaccacagtgtgataccatctcccactagtcagagtgacttttattaaaaagccaaataataacagatgctggtaaggctgtggggaaaagggaatgcttatacacagtggtgggaatgtaaattagttcagccactgtgaactaatttgtaaactccagtttggagttttctcaaagaacttaaaacagaagtacggttagacccagaaatccaattactgtgtatatatccaaaataacataaatttttgtaccaaaaaggaacatgcaccactttgttcatcgtagcactatttacaatagcaaaaccataggagcaagttaggcgcccatgagtggattggataatgaaaatatggtaaatatattaccatggaatactacacagccataaaaagtaataaaatcatgctctttgaagcaacatggatgtgctggagaccctaatcctaaacaatttagtgtaggaacacaaaaccaaatactgcgtgttctcacttatagtgtatattagtctgttctcacactgctaataaagacatacataagactgggtaatttataaaggaaagaggtttaattgactcacagttccacatggctgcagaggcctcacaatcatagctgaaggtgaatgaggagcaaagtcatgtcttacatggcggcaggcaagagagtgtgtgcagagaaacgctcctttataaaaccatcagatctcatgacacttactccccatcgtgaaaacagcatgggaaagatctgtccccatgattcagttaccttccactgggtccctcccatgacatgtgggaattatgggagctagtcaagataagatttgggtggggacacagccaaactatatcacagtagaagctaaacattgggtactcatggacataaacatgggaacaatagacattagagacacctagagtagggagagagggagggggacatgggttgaaaaactacttattgagtactgtgcttagcacctgggtgacagtttccataccccaaacctcagcatcatgcaatatacgcatttaacaaacctgcacatgtacccctttatctaaaataaaagttgaaattatattaaaaattatttcataaaacaagcaagttgtcaatttgcaaagaatatttcaagtttaaggcctttattctgtactaggatcttcaaaagatactagacaatttattttttcttttatcaagttattaccttaacatagattgttttcttagttgtgaaataattgtaaattccatgtatttcttttgggggataaatgaaatttcaaatggatttctattggaatcagttgacatctggaattaaaatcttgctgaagtttctgtgattccatctaagatactagattttctttgattttttttgttcttcactgtttctaaagcaattatggtagaaacaagactaaatgatagaagataaatgagacaaataggatgtagttaccagaacattggattgtgcaaaatggaacatttcagctgctatttctatcactagaacattatgacttcatgtggattttagaaaagtaataggtaaacgattccctagctcaagaatctctgaggacagctgaaggcctggagaccaacaataactagagggattcagatgggtgctgggcttgcttgctgaagcgtgcttggctgtgtcctggaacgctgagtagagtctgaagctggtcagagaaggtcataccctatttggcttttgctgttgtaatcttagaatcatgttttcccttattctaacagcttatcttccttgcccattttattagatgccaaactcatataatttttttaacctctaaatatctacttgtataggacaaaaataaactttcagcagccatagtgtatgaaggagtatctgtgattcttccatagtgtagataaagagaactagagaggatacacctcgtcatgcctcaggtcaagtcagcctcccctaaggctctagcggccatcagattgtagtggttatttcctgttccctcctgtctctgtcctccctccccttcatcagggcagcctgctgttcctcgacatcatggatgttgatggtagccccagctttgattgtctttctaccagtcaaccacgcaaagaaggagggagaaaactcttttggagaattccttggcccaatggaccaggcatctcttttcctcagctaagctttccttcttggtatgttacagggaaaggggaagcagtttgccagacagcaagtcaacccggtcttggaatgaggggaaggaggtttccctcggtcccagtaacactctagcagggccaagcattgaaggagtctgcattcaacttgcagaatctgtttagcactttctacacctccatcaggatgtattttattctctggttttagtttcctatctggtttgaagaggagaaaaataaaagtcatgaaacatatagcaagcacctgctccctttgacataagtcagcttgttcaattctcacaacaatcctataaaagagctgctattattcccatttaataacaataaaacggtggctcagagaaggtaaacatttttctaagttcttatacttaataaatctaaatccaaatttgtttttcattcttctttccatatcacactgctatatagttactatgttatcatctcacaatcactgatcaactccgacctttgtcttttttcctgataagtcaccttgttcttggcattgctttccatattcgtggctagcagtgtccttcccagggttagaggcaatgatgagttctttttcttgtgattgctcagtagaaaaggcacgaatggtgctgcaaacctaagacacctccaaacgttatacacttttgctaatagcaggaaaaatgacctctggatgctgccaaagtgagcactgcctttacgtatgatagaaaatacaattatacattttaaaatgatctcacagtcttgctttctaacttgaattcactgtcatttaactgatttataaggattcttggccacaactaaagtatattttaaacttataagtattctctaatgaggaacttttaaaagtccagataaaagcccactattcagtagttagaataattcagtgaaattaaccatgtaaatgctcaatgaagcaaatgattaaagaaggaatgaataaaaataaagattaaagtggatcaaattatattttgtctttttttatactgcttatagatcataattaaatagtggtggctcaaaagcacaaaaccaacctcatcacttaccaggtgtgaaaataatgttgatgtgtatgcttagttttagcgtgacaaagcagatacactttttcacttttaaaaaaaatcactcaatgcatcattctttaatgtttgcttttgtgatgatcactgaatatagaaagtcttttgattttagaataattttaagtctttgcctgctgataacctcagacacagacctgcagccagaattggttgagagttctgctatcttctccaatgagggatatttgagtatatactaaataatcatatttatatactggcatttaaaaaaccaaatattctcatagttctcttcaacctcctgagctccttaatatagataatatagatggccacatttttgtcattatacagtcatgaaaagaagcctatgtaggtcttatccacatttacaagacaggaactgaagatcaaagaggttaagtgactttcttaagttcctcagataaacattttgaaacagctgagatgaaatacaggtgcgctgacttcaaagcacaagttcttttctctagagtgcactacccccaatgagttgacaaaattaaacaaaaactaagcagaattatattttcttacacatacttcatacaagtaatcattaagcagctacttggtactaaagtttctcccaggaggttgcagtgcagatgggtaagtaagctgctgtatgtgcccccaggccataggcatgtcagcagctatggataccacagtaaaataaatgactatcgagaaagcaggaggaacagctcaccaggggagcacagtgatgaagtgaaagcttcacctttcaggaattctacacagcccataaaaaaaaaaactctatcccctccctttcagagtgtttcttaacaactgcttaacacagaaatcatcaacgtattgttgtagatactgggattaatatgtgcagaacttcaaacagaacccagatctcatgactccaagtagaggacctgttccaataacccatgaaaataatcacaacatcctaatcatgttttcatccctgttttactttattagttgttaataggtccattggtcactgggacacccacatgggggttatatacctgttcatacacaagctatgagtctttgaagacagaagcatatgaggtcctgattttgctctagtatgaactcaaacaaattttttttcagactagtcaccctcatctttcaaaacatcagatcatttcagagctgcttctaggacatgtgaacttgggcagagagaattgctttttcttcactgtgttactgtagtgtaccagtcatatggctattctaagatctttaatcctcacttccttgtcaccctcatgaagggtccttcaaacttcttgatgacagccaggggcagggagggcactccaggcagcaagctgacacaatttacaaaagcagttatcttctctcccgtgaagcaatgccgcctggtagaacaaatggtgcaacccatgcacacttagtttatccaccttgataatctaagtgtcaaggacagagcaagtaccattcataagactctctggagcatgcaggatactgacaagctttttatttatgacccagggtttaacccatgtgagctcatactttgtcttctgctaagccttccatagctccatctcaagtcctcctttaaggtgagggtcactggactgcatatcattcagttcccagctagttttctcttcatttatttgtgattttactcagattatgatattattagtttagaaggggttgctgtagtcaggacaatcagtaatgcacttctaaatactaggtagatcctccattctttgtggttaaactccttccaggttctagtttgtttgtttatttatttattggaagattcatacactttgcctttcttttcaccaccttggtttggtttacaagaaccaaagctagtttctctaaacccacttgattagtgtgtgtttgtgtgtgtgtgtatgtgtgtgtgtgtatgtgtgtatatatatatgtgtgtgtatatatatatatatatttttttttttttttttgagacagagtcttgcgttgtcatccaggctggagtgcagtggcatgatctcggctcactgcaacctccacctcccaggttccagcgattctcctgcctcagcctcccaagtagctgggattacaggtgcccgccaccatgcccagctatttttttttttttttgtatttttagtagagatggggttttactatgttggccaggctggtctcaaactcctgacttcgtgaactgcctgcctcggcctcccaaagtgctgggattacaggtgtgagccagcgcgcctggcttgattaatatattttatttctactacatcagacacagattctttttgcccaacatacataaccatgtagtcctacctaatatagtttcctctgtgtgtgtctgtgtgtgtgtgtgtgtgtgtgtctgtgtgtgtgtgtattatatatacaactagtaggaaaccccacatatccacatatctttctagatatcttatctccctattacaaaactcctctctcttgattattacactttataattttactccctatgtcatccaaagtgggactctcattgctgatggtctaagtcagtgagaccctgttgccttggccatatcagagtctctggatgcagggccctggaatcaccattttttaaaagctatgcagtgatgttactgtgaagccaggttcacattttcagcctttagaaaaggcctgttgacctaagttggagaatgctagccttgtccccaaaattgcctgtcttctgtagttattcagtcaatatttattggcaacaatcatgcaataagcaactcaaatgaaatatcctggctaatgtgggaccactctggcacctctgaagttagaggacgtgctactaacatttatcatttcagatctttctgatcgagtgggtaaaaaaagatactggaccattttagttgctatttcactgattttctgagactaggcaaacaaatacacaaagttttctccctccttctgctgttcagtcatcacaaagaaaaattaaggcctttgtatatactgagcaaactgttggggtaaagttataaaaatggcagacagatcttactttgccaaattaagacatttagcaagtattgtaagtgtgatgagtgacgggaataagtgcgggacacacttgctttgtctgacagatgtactaacctgattttgatctgccagagtacaggattcattccttccaggtgcattattccaaagtgcttttggctaaaaggcctcttaaaacctcaatttattgttctctatatagtatatttctatttgccatctctccattattttcacagctatcttgtgtcctaagttgggccctaagaaaaacaaactgtcctaaaccataggccaagatacctgaagaactgaggtggtagggcatggattttgggaaaacttttttatggaaatctctgtcttggaatttctctcaattagcagttcttgtactgtttacagcacgagaactgaaagcataacctgcttctcttatgaggtaaactgcatattctgggtgaatgttttctctccacaaaagccatttcacatgtttccagatcaattttgaagttgttttgacactttacacactttattttaaccttttgtttctgagtgtagtatcctcacctgtctacagcatgaggaattgaaggctctaccctgtctgtttgcctggcagagctggggtgactctgctgcttacacaccagccttcccactagactgaagcttgccaaggcaagggctctgaatgtggaagtgtttccctttccagggccctaaatatttctaacttgtatggcacctgggaacaaatcaaattatcttcttgactccaaatgaacctccaggccttcttagaaaagctgaaagaggaattaaagggggataatggctcatgcctgtaatctcagcactttgggaggcaaggcaggcggatcatgaggtcaggagtttgagaccagcctgaccaacatggtgaaaccctgtctctactaaaaatacaaaaactagctgggcgtggtggcatgcacctgtaatcccagctactcaggaggccgaggcaggagaattgcttgaacccaggaggcggaggttgcagtgagctgagattgtgtcactgcactccagcctgggtgacagagcaagcctcagtctcaaataaataaataaataaataaataaataaataaataaaaagggggagaggggatcaaaagcactagtctgcatccattcagagctatgtgtgcaatggggagtaaagccagcctagaacctgtgcatcatcccaggtgtgtttccagtcctcccttcccaccatgagacaaaatgaatggagacaaatttagatcctctaaaatgagaacaggaggccaaaatggtgggaatatataaacgacaagggcacatatcacttgctttactttagtcctgagatgcccaaggccagactccatggatgagtcttggggcacttttggtcccactctcttagccgtctcccagttcctgcaattcagaggaactccccaaattaattaatctgatgaactctgttctcgagatgacagtatctccatattatctgttcccaagtttcctttcaaaagggacaaatgaacaaggaggagacagcactaagtcctactcatttccaagtaaagcatatatatgctatttcccagcttgggggcaggctgggcaccctttcagtattttatgtctgcatctttgaatgagtctggttgttctctcaagggagttttactttatggctgaaaggaaacctgaagctgatttcttggcctttctctttaactcattcctctttctcccaccaaggtgtctgtaaagattctctctggaattgcctcgcttcctaaaagatattttaaacactaggagtagtgaatgcctactcattttatcaaggaggaaactgaaattcaaatcagaggagggccttgactaaagtcccatggacagttagtcacagttcacacaatggaagtccaagcccagttcactttctgctacactgccttgcttgccataacatcatctttcaattagccgtggtcgttgcctcctatgtatattcaacagaatcctgaagaaagcaagctgaacacgtttccaaattagcgagagcagctctgaataagaagaaaattcatggtaagtttatgggatggctccaggtgtccatctttctatcttcccttgttatcactttccctgttttgggtgtagggggagaaagaatttcccattggctgtctcctggggtgagcaaaaactgaatgtgtttaatctaggttttcctcagattccacgacttgtaataagcacatctttatactcttacctctccagctgttctctgtgcaaagctgaactaactaaaactgctgaaaataccagagctatttagggaatttccctaactgcttcaacattcttaaagtgactaatttaattggatttatagggcactacataataatgatatcctttggctatgttcttagtgggttctacacctgtaatgaaatccataatgaaaaggaaaacagaagtacatttgggatgcaaaaccacttaatttcctggacagccattaaaaatgtggcatccagtgcaataccttaactttgattttaccttcagacacctatgatgatgattctggttgttggttgtgggacattagaataattgtgtcagaagaattcccatcgcatcctagattcacacagcatttctcttactggaaacccaattcattagtcatctgagttggaaaactgggactctaacactggatgttgattttatttatttaatcttttgtgttctggtcttatttctgttgtatttggggggtcctgtctgctatctcctgttcctggtgttgaggtgtagtgttctatggcatttctgcatgtccttggactattttccaaggaatatttgtttaacaaacatccttcaaagatagaggcagtataaccatgaaatgtctccctccagggcaaggttagacaggtttgcttgaagctcccttcatagattgttttctagctttgggatttcttggttttggcaaaatatctatcctgtgagttgtatcaccctgagtccacttctacgtgactcccactctcgtcctccccatgacacttgagtgacaagggcaactgatcaaaacagaaagctcatgctgcctcctgtgttctccttaataaagttcattgtctctgatccaggagtctcatgtcttctgagatcatctatgaaactagcaggttaacttgttggctagcaagtagggttaaatctcagacccttcacagttcttgacacccaatttcttcttttttggagccttagccttagatctagatgattaagtcctgctacatgatcttcatcccagtatttctcccttgcttaagtggctcagcccatatttccagtaccagttcccactaaattacccactaaatgtggttccctccctgtggtcacaaggaaatagagaatttttgtagttctctagaatgggcaggacagacatatttgaatgtatttgcccattctaattatttgatagtgacagtctagggcttatgatggagggattcagtcgttgtatctaaattcagggtgaaaggattgcatgatcaataggtaggtataagaaatggtctagatacttaaagtccaaaacatctgcatcagggctccagagtcaggtgcacccaatgctaaatgatatgaagaactggtaattagagtggtacatacatacaaagtgagctatttttgatgatagtgaagccactatccatttaagtaggtaactactctggttatcacagaggaaaatgtgggaaaatatgccaaattttctccaatcctttctgtaattcctctgtagacgtgcaagtatgatccttctcatgaggtttaagggtggaaaagcacaactaacgtgggcattagtgctataaagccactgttaatttaacaagtttatagaatgtgctggtaatttacaaagtttaaaatggtgacatttctgtctattttccagtaccaggaaaatctgtaagtctcctgaacatttaactttttaaaaataaaaactgtggtacttgttattaacatattctttgctttgcctgttagaaaacctaggaggaattttttctattaaccagaaacagttctcaaactctgatacacattagaaacaccagaaaaatcttaaaattactgatacttgggtttcgccaccccagattctcacttaattggtatgtaatggatcctgagattttttttttcttttttttttgagatggagtcttgctctgtcacccaggctggagtgcagtggcgagatctcggctcactgcaacctccgcctcccgggttcacgccattctcctgcctgattctcccgagtagctgggactacaggcacccgccaccatgcccggctaattttttttctgtatttttagtagagacggggtttcactgtgttagccaggatggtctcgatctcctgacctcatgatcggcccgcctcggcctcccaaagtgctgggatggatcctgagattttttgaaagttcatcatacaattaaaatatgaagcaatgatttgaaaaacactattttataggattttaaactgtctagaattcagttttggactagtatatagtagggatcaaacttttattttcccaaatagccaacttttccaatgttatttatatcttctacttttatttagtagtttttttttcatcattgatctttaaaatgatatccttataaattccatatatctgaatctgtttctggattctctatgttttccacttggtttatttgacaactttttaaccagtatcacaccatttaaattactgcagatttatggagtgttataataactaggagaacaagttttgccttattgcactattttttcaaaatattattggccatgttatacattttatttttcagagaaaaatgtaggagatttcgatcaagtttcatcgtctgatgttttgggccatagggaaccagtcagtctctgtattccagtttgtgaagtacggtgttttgattggtcacacctgagtcttatgatctaaccttggagcaccgtctgagagcacacgatgtgagaacaagaaaggtggttttgggagatagaatgtggtgtcagaactatagagtgagaaaaattagagatggggatcctgttaccttgaagggcagggatgcctgttttgatgcctgaagcatccaaacccagcaatatccctaattttattttgcttttatggtaccaagaatgagtccaggagataattttaaatggtagtgctccaaaaagtgatacatgtacgctacatgaagtggttacaaatgaactattgttgttcatgaactccacatacccatcattaagtgtgcttttcaatactgcattactgtggctgccttcaagattgtgctgtaaaatttccctacattaacttttcacttattcagagcatcccattagtttacatgagagaaaaggaattagaaagataaggagtctaagaaaccttaatagatgggagaattctattaagtaagcataatcaggcaaggagtctcttggaattgaattggaatttcaaggtcacaagtcctatcaatccgctccctctaaaatcaccttctcatcatcctagcagatgagtcctccatccccacatcctacataactgcttcaataaactctcattaaggattccattgaagataccatgttttttcctatctcagggccttggtacatactctttttactgcctaaaaattccctcaccttctttttttccttttgtctagctaactataactcatacattcaatattttcctggtagtattttcttagaaatacttagggagcttagagtgacattcaagctccttcatagtttgactaccacctatgtattgttttggtctatctcctagtaagccaggctagtcacctaaatgccctcctttctcctattgtttatggttgtgtcacttgcatacattacctgcttgtagagcagccctcccactcaggagtaataggttttattcctacgaactaacatgcacttgacttgtacttagtcacattttgactagaattacagggacttgaaggtatgtgttgtgtctggatctgcccatatgttcaaggtatttcttccaagtaagtctgcattactccagggtaagcgccagacttcctcatttttctacctttcatggaacttttgcgtgagtggcaaggaatactcaatggcagtgtttctcaagctttaccctcatcaaaatgacctggagaccttgctaaaacacgattgttgcaaccacccctcataccctgtacccaccaagcctaaatccatctcagatggagcccaagaatttgcatttcttataagctccagtgatatttaggctgccagtgctaaaatcacactttgaaaaccactattccgtgacactgttttaaaaactggttgcatgttaaaatctcctagaaacggttaattaagattttttttttaaagactgtgcttgggctcccctctagacaaatcaagatctctgaggatgccacttttctcatgaaaagaaaaaaattcaacaatccgcaactgttaggagattttaatatgcagctagtgttgaaaatcactgttcatacaaatggcagatgagtaagcagagtcatgaacaagagagcaggcttgctgggagcctaggccagagcaaatgtcataacctcctgaggcagcgtgagttagggcatgcatctcacattttaatgtgcttgcccggaagatgacgatagtaaatctgggatgtctctgaaatgctgctggtctaacaagctcccagatgattcctatccgtgaaccccactctgattagcaaagttgggatatccatgaagaaaaaagggtcagtgcgtgcaagggatgacaaaggcaggtgagtgaaatggggcttgagagcccacatccggtaatcctttagaatttcaaacataagaaagaaggggaagtgctggggggtgggttcccctgtggaggaagttacttctaagccatcagtttaagactttaagtgaatttctggggaaagcatccagttttgataagtctggcccagactaaatatataatttctacctaattaaggaggcaggcacacaggcaaaaaggtaaatgcagcttctggaggcacatcctaacagaaccccagagaaattttatcaaagtctgtgggctttctccatcttcttagctgccttcattgagaagtaaatttccatgggagaaaattagggttttgcttcattcccagtagctggcattaaattagtcctgtagaatgtgtttggagatcatgttgatgagcagagattgtctaagcagcaggtgttacgaattcatttaatcatttaaccacacaccctgcacatatttcagctttcttaggttgacttttatttgcaaaacacctatctgaaggtgtgttatagtggatgtataattgatggtgcttgtcgaattttatgctctataaatgccagatacattttccccaagtatgctctttcttgatccatttctctaaagtaaacatttgaaacaaatttaactcttgagggattctggcaggactcactttctcactgattttagagcttgtgttcaggttggggagagagcattatagtttccagactcagctcagtgtaaaaccatcgtgcccagacaactcacttaaaaggaacaggaaagtgcagttagagagcctttactccacccatctagatgccaggctaccaccaatgggcatcttgttttccctcttttctctctcattggaagagagagagagagagagagaaagagagagagagagagagtgtgtgtgtgtgtgtgtgtgtgtgtgtgtgttttactacctgtagtagtttgaatggtgacctggtgaccctcaaaaaggtatgtctgcatcttgaaacctgtgactatgaccttatttggaaaaagtgtcttttgcagacgtaattagagatcttaagacaagatcatcttagattatccaggtggattctaattccaaggctaactgtccttataagacacaaaagaggagaaggccacatgatgctggaggcagagatgagagtgatgcacctgtagccctagaagcctccagacctggaagaggcaagggacggaatttccctggagcctctggagaaggaaactttgtggagcctgtggaaaccgattttggacttctatcctccaggattgtgacagaataaatttccatttttctaaaagtcacccagtttgtagtaatttgttatagcaaacccaagaaaatgaatatactatgcatcagcttggggtcgggaggtggggcacagaaaaagaaaacaagttcccaggccctcctaaaagtcattttgtttaacatttgatccatgcatttgtcatgccctccaaaggggacttctgcagaaaagttctcagtgtccttcaataagatagagcctttctttgctcctaccctaaccttgaatcaaatacagcttggtgggccctgacgctagaggaattctcagtggctgggctggcggagagctatctatttgtgtatagggttgcagccaaagtctttaaactaaaactaaaactctgtggattaaataaaatactggacatgcaaaagaagattctcttcgggaatccctgtgtactagcccctctgtgtagtgaatgctatcactttttcttctcgcttttctagataggcatctagaaaggtgttcaatctcttgggggtaatccataggcctccagggttatttccaaaagtcttgttgatgttatcagtgttaacacagaacctcttctgattagtgttcaatcttactatggaatagcttttttctctcaaatattattagaaaattagtaaaacataaaaatgatcaggtttggccagttttacccctactgtcctactgctattcaaagacctagcacttctgtacatacgagtaaactgcactcgaaatggtattctctgtttctgcttctacttaggttccaaggcaggtaagcagtctaaccagatgacaggtgagcaatctgaggtgaagtgacttcccattacatgacttttgacccccatcgttgtcttggaaatactttatgctaagtattagaaagaaggaaaacctactggctgttgcaaacaatttaaaataacttaaagtggaagaaagaagaaaaaagcagagtgaaattttatagggtggggaaaacctggaggaaactttcctttgaaagccaggagtccaaactatagataggatagtacagaaattcagcaatccccaagtgttctagcagaatttaaaacagaggatgaaacttggagaactctgggctagttgtgaccttcagatatactttaaaaaaatcaactaatattttaaaatcagtattttcacataagattatgactttttttttcttttgaaaattttgtaagatctggcagcattgggcctttattgctgcattgtcaggaactgggctatgggtgttccttccagttgagggctgtttgaggtctactctgtcatctacctggccagtcccagcaaagctggatgtagttaaacatggaaggcacaactggactaggggaattggataagtccttgaacaagtacctgagttaaaacatcataagttaaaaggaggggatactggtgtgagttctgtttctcaaaaatgggtgtggagttctaaaattaatgttaatttgggttccattttttccaatttccccactctctgccatattgtattctttgacttagcattagacttagataagttagttaatattcctgtaacttcggtgcttcatacacaaaatgggaacaattataactacctcctaagattttagtaagactgaataagacaatggataacaacgacacagcataatgcctgaagcatcataagcacttaaatgttggttgctattatgattggtattctttaaaaagtgctattacttgccattattgacttttgaaactggagggttcaaacaaacaagatgttgagaggctcaggcaaccagtatggttggaaataataagaaagttagttacctaccgtgatactacactaacccttgaaaaaacgtgtggcgtttaaagaaatttctgctaaatttctgtttggcttcagcaaaacctcgtgttccactttcagagcatgaaagaggcagttaaggcaagaaaagcgcatttagaagtttaaagaatgcaagtatcctatgggttgagaaatgagattaatccttccttgactagtgctctttttactggcaggataaattctttaggaaaaagagttatgctggctgtggaagtaaatagtgacaggtgttcttttgtttattttctatgtatttttcaaccccaggtccattttattctcaaatgtaacttcttttcttagtcaacctgctttttggtaaaattgttcttaaagcattcagcttacataattaaatatggttgtgtggttaccttttatatccgaatgtaaggacctccatataatctaattattttttccattaaaaaaagatatttcacagacacaagctataggtaaggattcattacaaaggaatctcattgttttaaatgagcaattccattatttttgattctgccgagagtgggacctaattctgtcaaagagagaaggttgttaagatttggtggtcagaaacacatgacttccaatcaaatttagcagtcctaactatcgaattaggtgttgtaagtttatgtgggctttcctaaggtgaattgactacagggggcatagttctatctaaggaataattagttatgttgagattcaatgttatttgcatatttgtgtctttgaaattcctctgaaaatgagtaatttttagcaattattcttggtgtttgagtccattgagctagtcaaaaatttataattgcaaaaactttggccaaattatcagatagagctaagattcggtttggggtcttaggaattcctattatctccttgaactttgggatgtatcagttattagaatttagacagtcaacgagcttgttgaaattttttttggaacaagatcagtggaatgaatggaaacaaagaagggcatatatttgtagaggaggaaaaggagtgatttgcagaagataaaaaaggaagaagataaaggagaggacggaagggggaaataaaattcacataaattgcttatcactgatattatagaagtaaactattttataacagtatctgcaatttattgttcacatagccttcaaagaaagaaagaaatgaagcagtaaatcaccttgcctcaaattataattttccttacttgtgcaatatttattgagcaattttatgcacagtgttgtgtttagtggtgaggatatgtagcaaataggacaaaacttccgtttatactggtatagtatgtttgtgcacatgtgtggtgatggtgccaagtgactgttgtagaagaatagtgaagaatgaacaaattagaaagtagagaattacaatagagaaggaaggcacatgagcctctcaggagagcttaattctattgctactttcaatggacaataatattttcaaaaggtattaataacttcaatacaaggagtctttcagcctaagtggtcaaaccaagttaagagaaaaggaaaactaaaaataaaaataaaaaataagatcaactttataagcaccgttttgatctcagatctttgtggtaaggcttgggaaacaggactttgcatatgggaagatcataaatctgggcctgtcagggatttgaagagcccataaaagtcagtactaggtgtctctgctgtgctccgaatctggaagattaatgggtaatttcgacttcctgctaattctttatacaaccaggcctatatcttttaagatccaaaagatatattaccataaaaagtttctaagaaaatgtgtaatataacctattctccttctattttcacgttctttctttttctcctgtagtcatcatcagacagttaaaaagaaatggatttttgtcaacttgaaactcaagcttgaataaccagaaataggaatcttccccattatgtttcaaaatgattttcagtgtaccctttcctaactagtcataatttagcttgagaatttcaaatattaacatattagtcattagttggtattatttcaatttttcattcttgtttaaataaattcagcttgtcagctccatatactaattactgtcaatggttttcttttctctataatttaaagtcataaagtagtaataatttagttctttatacatagtttgagcataacccatcgtgagaaggcaagatgtaatcatcactaaacatatttgtttttactaaataacagtttctaaatttgaaaaacttctctgtgggtgatatgtgaggctgacacattgagcaacaccatgagcagatgtagtagcatacgtgaaaaaattggttaagcttcttgatgtttaatgaaatttaagcacaaaaaatatattcatgtataactacttttggcttaataattcatgcatttatttgcctgtaaatactctttaaacttctgttatgtgcaagatatcatcctaactgctataaagcttataaaggtgaatcaggttcaacttctttccttaaataatttacagtccaacctacgcatgtgtataaataatctaccaccagaaaatgctaaataatctaaatggggcatttttaaagtgttgtgtgatttaaatacgtatttgtgtgtgtgagagaatatgatatatgcattcatatatttgagttgaaaatatatacacatttgtgagacagattagatataagcttaaaatgtgtatgtgtgtgcacatgtgcataggagtatatgtgtgtaagggggtaacaaggcgttcacaaatttcattaagagactaccatttgagttgactttgaagcacagataagatttggaagtatggagataaaggatatttgacaatttgacatggtggagagagtatatgaaggtatgagcagagtccagcaggctgacaaattgggacctgttgagaggacaatgataagctgtcttggctaaaagataggagattaatgagaaagaatagtggcaaataagtttcaaaagtaagtgtgtttcagatgttaagtttttattatagatattttgatcttcagtttattgaaatggagttctgagtaggagcaaaggaataccataaaggctacaaaaatgctcttagttaaaagcaggatccactagggttgggttggaactgaaataggtgtttaaattttcagtatcttcagttttgtttgtttttactgtgcttagactgttggatcacacatataagactgcaaagcgctcattaaagtgaaaatatatgcagacgtttatacccggtataacagataaattgagcatctctctacaggtgtatcccaattttttgctatgtatacccttagtggatacctgtgattgaatgtaattattatatcttctggaatgtgagcatacactgattgatgtcagacatttagactgtgctatggtttggctctgtatccccacccaaatctcatcctgaattgtaatccctgtaacccccacatgtcgagggtgaaacctggtgggaggtgattagatcatggggtttctcccatgccgttctcgtgatggtgagtaagttctcatgacatctgatggttttttaacgtttgacatttcctcctacacactctctcttctctctcacgcttctgctgccatgtaagacatgccttcttccccttctgccatgactgtaagtttcctgaggtctccccagcaataagccaggtgtaactgtgaaccaattaaacttctttccttcataaattacccagtctcaggtatttccctattgcagcatgaaaacgtactaatacagactgtggctaacaataaattgtatgtggcaggagggtttcagagtcttgtcatataaacagatatgagaagaggccgtggataatttaaaattccatagcaagcaatttttttttttaaagattcaaaaatgaattgtaagaaggggtgataaaaggaccacctcactggggactattgcttaatctttgcattggctgcacattgcctcatgcattggagacagagcattatttctgactttaaaaaaatccccacacaaagccaagtaatggggtttagtattaggcctacttctattttttttttcctcagagtttgccaaatatttgattttttcagaaaacaatcacccaagagtgcattcattgcttcctgcagaaatgtgccctttattaaaaatagtttatctgggacctgcagtgtgttgaattgtgtcctctagaaatacatgttgaagccctaacctctggtacctctgaatgtaatctttttggaaatggattttgcaatgttaaaaaatgaagttatacttaattaaaatgggccctaaatccaatgtctagttttgttataaggagggggaaatttggagacacttagatgtacatacacacagagggaagagagctgtataaagacagagggagaaactgatgcagctaccagccacgtaatatcaagtgttgccagcaaccacctgaagccagcaaagaggcatggaacagattctctctcacagtcttcagaaagagcatggccatcaacaccttcatttcagacttctaggctccagagctgtgagagaataaatgtatgtggttttaagccaccttgtctgtgctactttgttacagcacaaagaaagatggtacaggaaggaagctggtagagcacagaagaagctggtataggaagctggtacaggagccaagaaacagggaaggaaataggtgggctatatcgtgtttcctgcctgatcattatctccaataaacagatgtgtacattaagagcctttgtaacaaatatgcttaatatttacaggatgcatatattagctggaaaaaaaattacacttttttttctaaaaatattatgttctatccttgacacctgctcagagcttctgcagagagagatttgtgggaaccctgtgtcttaccaaaaatcagcaatcacacaagaggtgtagtgtcctccacaaccctagtttgtgggcttaagaccaggtgccctgattagatcttggacatataatactagaaagactcactcagtacttagtatggcttgttcaagtgttttataggaagtgcaaagggcttagaaacaatagaacttacttgattcctgactttgaaactcattagaaagtgaccttgcactgctgaggaaactctccagacgtcattggtaataggagagtttttaggaggtgaactttaatgtcccttttagctctgtgattcaatgacttaatagatgaataattttcctaaaataagttataaagaatccaaataatagaactagaatttacagtttacttggcagtaagtactggctctcaaataattttaattagttcttgttgaattatgaagtttattttatttgtattttattataaatgaactgcaactcttacttttagatgattttgctaagaataaaggaaaaggaagtaatttgaatttcaaatttttagcccatcaaatgtgaaatgaatatttaaaggtgaacaataaaattaggctgcatttttgaaaaatatttctgcttgctaaaatcagaattatacagccacgacctttaaaataaaagacagaatttcagataaatgcagtggttgtagattatagtttctggagaattctgccccaaatgatatatgctcattcatctttcctttcaaagaacaacaattaaaaaaaaatctttcagtcagttgagtgttctggaatgctaaaataatatgaatggcttccactcttccatgttaaagtgagtcccccaaaggtttacaatctttgatgtccagccatgcttgacttgacatttgaaaattctctagtaaggaatcaaggtaaatggagcataagtttctcttagcaaatttggttttgtagatgtcatactacatgcatgtaatatacatgacaattactccacagattggggcacatgtgttaatgtcacgagagcatcagtgggaaagaacctaaattttgtaatgtaatcgtagtgggatggcagaattatcacataatttatatgataaagcaaaaggaaggccgtgtccctgtaaggattcaggcaatacaagtccacacagagcatttctccatcttagacatctttgcacatcttatttcatccacattcattagctaagtaactcagggatctctgtcttttttgttgctgtttgtatgttctattctgctgccccaatctttagctgatacaacaaaagtatgagtaagaaacagggcatttataacgcactgtagactccatggcatttggacactcagtaatgtgttcttggtactttatgagaatgtgcacagtgatggggtttttgcttagccaaggttttcttcattcagcaacatcatgaaaacgtcttctccttaataaaataataacacaggaatgaagatttctgatacacaatgagcccaggggttgacaaaggaacttaatctttatgaacttgggctctccgggatcgcgccgttgcactccagcctgagcaacaagagggaaactccgtctccaaaaaaaaaaaaacaacccgggctctccaggccgcgccccgaggcctcaggtcggccggctgcccctccctctgctctgttcctagcagggctggaaaggcctctgccgctcagtggggacccagcaaagccaaaaatcaggtccgggggaagagcgaacggtgcgtgatggaggctccgagggggagcgagaggcggaggtcgcacagtgtcctgaggggggagactggaaaagcagacacgcaaccgtgggaagaaacccgaaggagtaaagaactcagagcgaaagtccaaaatctcctcggcacgcgggcctccctgcgggggcgcgggcaccgctgcgcggggagctccggagctgcagagaagcttccactctgcccgcgccgccctgagcacaggcgatgggcctcggagggagtccgcggagcgggacgcctgctgcttggacctcggcgtgagacttcgcgggacgcagacaacttgaatgcgtgtgtcagacccgcgaccactacaagacaacgtccagagacccagccccggaaatgaagaaagacacttccggttctcagagggcgccgttcttccctgagaacacggtccagggaggctggatggccaccgcgtccacggagagagcaccccaggagctccagaaagaacgtgaccacaacgcgcagaaaccaagctgtgaggccaaggtccagcctttcccgcatggcgctttggctcctggggttctgcttgcagcccacaggggccctgaagtgccagggggggaccttgggccaccaggagcgaggcaggccacgatttgagggcttaggtccagagcacctgctgctttgatgctgtttccctcgtagccgggtcctgaatgcccagagactcggcagaacatcagctggtgctactcgccttaaggcacttttgattgagttcttgtcagtttagctactgttcattagtttatgcggaaattgttcttattgaagtttgatgaatggtgttaggtttgtaaggtactgtttttcaaataaagacacatatatgtgtatacatgtacatatccatatatatggtacaggaaggaagctggtacagcacaaaggaagctggtataggaagctggtacaggagccaagaaatagggaaggaaataggtgggctatatcgtgtttcctgcgtaatcactatctccagtaaacagatgtgtatattaagagccttgtgtgtgtatatatatatatatctatatatatatacacacacatatatgtatacatatacatatatacatacacatatatgtatgaaatgagtgagctctggtttattgattatccgatgactggcagttattgaataatccatcttccccttgtctatttgaaatacttgctttctcatattttagttgtcaatgtgtcttggatatatttagacttttgaaaattattttccagtgatttattctagccctgccccaacaggacccgctgtaattttggttgttttattatacatttcaatgttatttaggacaagtccctgtcattattcttcttttgtatacatcatatacgtgtatgtacatatgtatatacatatatgtctatatatacatgtacagatatatatatatatatatatatatatatagagagagagagagagagagagagagagaaactgactgacttgggctctctagagccaccctacttggatgcaactcccagatctgccacttgctagctgtgtgaccatgagcgatttacttagtctctctgtatactgcatgccataaaaagtagaattggaatggcaagaggatcttcctctgaggactgagttaatacatataaagtatgtagaacatcacccttaacataataagcactcgataaatcatagatattattattaatgagagcttaaagatgggtaactagagagacaatctggggaaggagcgtaagtgtgcatcatctgcagacatcacagggagcaattgtataaaatgctacagttgaatcctcacagtttgaatattttaaacttgagatacccagattgagattctcattgtggttggccaatccagagcatgagaaactgaatttcaattattcatatttttgcactcaaagctagctctttcagagctgctctctggaactcaggcaaaacattacagttaaattctgaactcctttcccttcttctcactgaagagaaaattaacaagaagcatgtggataaatgtaaagcaagcagaagagtcataacccttggagagactcaagagtatagttcagtagaaagtcgtcatgtctggccaggcgtggtggctcatgcctgtcatcccaacactttgggaggccgaggcggatggatcacctgaagtcaggagtttgagaccagcctgaccaacatggtgaaaccccgtctctactaaaaatacaaaacttagccgggtgtggtggtgcgcacctgttatcccagctactcaggaggctgaggcaggagaatcacttaaaccagggaggcggaggttgcagtgagccgagattgtggcactacactccaacctgggtgacagcgagactccgtctcaaaaaaaaaaaaaaaaaaaaaagaaagaaagaaattcatctttctttttttgccacgagtagccacaggcacaatcggggatggagaggaacacagatggcatagagcatccaaaagatggcatagagcatccaaaagatggcatagagcatccaaaagatggcagagagcatccaaaaggtggcagagagcatccaaaagatggcagagagcatccaaaagatgggatagagcatccaaaagatggcatagagcatccaaaagatggcagagagcatccaaaagatggcagagagcatccaaaagatggcacagagcatccaaaagatggcatagagcatccaaaagatggcagagagcatccaaaagatggcacagagcatacaaaagatggcacagagcatacaaaagatggtatgggggttgctgaggggactctggagtcccctgaaatcgcataggtctcctataaattcatcagtaccttatattacaacatagtggtcaaggaaaaaaatgtatgctgaaaagtatatttgaatgttgccacagtaagttgctttcctggacctagccctgtgactggaccccagtaaccagagaacaccgcacccaagttaaagaagtgagatagtacaatcagtccaccattcttgagctacctgcctaacagcctggcctatgcagctttttctacatccctgcacatccttctcacctacacattatctctgccagaagggaaatcagcttgttctttgcatgcacccttttttctcttatcattttttttcttgtaatgccgcctatgactgctacaagagaaaacacgacatgaagctgctgtgtccattgcaggttccttgattttgagcaaaggtggaagggacccatggcttcttcacattcgtcaaaggagggaaaggaagctgtcattggaatgtcagacctaaatgtaaacagatttcacagaaaatctttcatacttctcatttaggggaattagtttggattgtctgaataatagatatactaatattgttattgtaaactgaaattttatagaaatataagccctacaattccagatgacccccaagagaaaaatgtgttgtccatgggaagaaaaacagatcaatgaactggaggaatggtgtgacccaaccaccttcactcatagaaattactgtgcttcattcagtacatagtatatatttacattgcaggaaaacaaggtctgggatggttagttttgctccagtagcctggaaaaagcagacttgcctatacttgcagttctggctatgatagactctgtatgtctctaagcttgaatgtaattagaaatcttaatatacagcccatcgggtcagaacctcgaaagggatggatggagacacaccaagtaccatcatttttttctgagttttatcttatatatactagttattggtacttactttatatcttcagaacttagagttttacccatcactgaacacttcatcaaaatgtaagatgttatcttactccctattcctaatgcatagctcagtgctaggtacatagtagtcatttaacactgttttaatgagtagatgaatgaatatgtggatataaaatgtgtgttctacttatataaacatctcaatgcacaggttaaaaactttcaaagtaggaaaatttaaacacatttattttccattctattttatttctaacactgatataatatggcttctataaaaaagaataccaaagggatgaaaatgtagtattatctccttttcacatagctgaacagccactcatttctttttcatatgaaaacatgaagacctagacctattagtaggagccatatcatgggtatttagcaaacgccattttcatctgaaggaggaaaatttagaatttgatctctcagctgccctcagccatgttagaattaaataagtgatcatataggcaacctctaaagtcccatgtatatgcaagactgagacagagagacatagaaccagatagggcaagaggttgaggcaccttagaggttatctagaggagttttcttaggtcttaaatatagaaacttggacccagaaggggcagacagacaacatatttactcaaaataatactgttatagctgttagactaggaatgatgacctggtctcatcgtagaaaaaggcatatgatggtaaatacatagtataatactaaatgttttatatgtcttaatcgtaactatataataacatgctcattaaaacatgactagttactttttacttttttctattttcaagcattctcttgtctaggagttagggaacattttctgtaaagggacagatagtaatttgtttaagtaattggtaatttctttactggcaaagaggccacatactttgcctttgtagcgtgagagtagccatagacactatgcaaatgtgtgagtgtggctgtgttcatgggctccaaaataaggcctggctggatttggttcaatggcctcaattggactacccatgcttcatgcttttaattaatgttcatcgattaaacaaatattatgtaccagacattgtgttatttgctgggatacaaaggtgaataaaagctaattttcatttcattatatcatgccttaaactatagtcattgccttttttttaattaaaagttattcgtgaattattagctctctaaggtaagaaaaatattactttgttggtatctttctagttgatgtaacctgaaggataagctccttcttctaacatgccttaaccaagggaagaaagaaatgcaaatgaattaggtatgctttgagtttatatgaatataactgaccttcttaatatacagggcttaatattattgcttagctctacaaaggaagaacaaaactcagtgtttctgttgaaatttgccttcaaagaaaatggagtcagtgaactacagaatccttgagatcctttgtggaatattcatgcttggcaaatccccctcgggtgtactaatattgctcaaatagagctcaagggatattgagtaaatgctgctacagaggggataagacttcagaaaagaagagtacaaacagaaacttacgtttttacaaagaactaaattgtgtgagtgctaataagaatgcaatctaagtttaatcaggagtggcttgtagaagttaggtaagtacaaatctgaaacattctgataactgtaacagagaatgttctacatgcttggacttggaaaaaaattcttatcaaatgaagttttgagttttacaaatattcaataagtatagactgattgaatgtcctttgtatctttaggtcagtgacctcttgaggcttaagagaaagaaaacatttttttttttgctaagaggtggcccagtggaaatttaacaatctagcttataaagtattggtcctgagttctccagagaaacagaattaacatatgaagagatttgttatgggaatgggctcatgtgatcgctgaggccaagaagtttcataatctgccatctacaagctgaagaaacaggaaagctggtggtgtgattcagcctgagcctgaagctctgggaacttgtgtataactggggaggctggcagtggaggatggaactggtataaatgccaaagtttaaaaatgtgagaaccaggagctgtgttatccaagagaagaagaagatgaatgtcctagcgcagaaagaaagagagatcttcctccacctttttattctcttcaggcctttaaagattggataatgcctgcctacatttgggaggaaggatttttgccttctcagtctactgattcaaatgctaacttctttccaaaaccctctgatagacacaaccagaaatattatcttaccagctatctgagcagccttagcccagtaaagttggcacataaaattaacatcacacactatgaatgaaaaacctcaaaattaaacccacactcagcaaaaatgaaaagtagcctaaggtaaaacctgatacttgtttataattttcaccaccaactgttgatatgggcagaactaatgtattttgctatggaacatggctttccttatatgtgtgaaaataagaaagttgtctttgctgaccctttctttctctgtggaatgttccctcctctattctctgataggagactttttattgcatttcaagcttcagaagttatgccctttattattttctctctctcctgtattttcatcattttttacatacatgtaatgaatcagttatgttctctcgtaaatgtcgtgttctcatgtaaatatcatgttctcttgtctatttccctgtcttctgcaagactccatccaggacgagggccatttcttaacattgcttgagtctgatcatccacttagtattacttaaagcatagtgattagctcaaaacacgtttgtttaataaacatcaaggttgcatctactttcttgttgttacaactgttccccactcatctctagtgattgctattttaaaattctgattcatgtttaatatcaaaaagcctatacattttagtgtaatacttggattcctagtatccctagcttgagataacaacagtatcaaaggctaccctaatttcagcaatgcttttaataaatgcatatgcaaaaagcatttgtgtaattttgaaaagctaataatatatgtaggtgtatgtgtgattgttcagcctacagtagtcagtgtacatgtatgtttctataataaaaacctgggaattaagctgttgcacttaatggggcctttggtactgtggatggggaagactcccttatgtcaatgaaggagttacgtctttctgtagaaattttgtctctttctttctcactacagatcatcaggttgacagtattgaattgatggcaccctaataaggaatagcaattttcatgtaaataattttataaaatactttctttttgctgcttactacttacacaagagaacaaatcagttctattacctaaaagacatactaatattatttagtaatttgtcatttgggctaccttaaattgccagcagttttggtaagtgatatcagctttctctcataaaaatggccattttttttattattacaaataacatgactcatttcagggagaaaaaatataaatttaagtcacctcctttcatcaacattaggcttttcctagtcagggaccccatttaatgtctgcaaaatttaaaattatttttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggagattcctcagggatctagaaccagaaataccatttgacccagccatcccattactgggtatatacccaaaggactataaatcatgctgctataaagacacatgcacacgtatgtttattgtggcactattcacaatagcaaagacttggaaccaacccaaatgtcccacagtgatagacaatgatagactggattaagaaaatgtggtacatatacaccacggaatactatgcagccataaaaaaggatgagttcatgtcctttgtagggacatggatgaaattggaaatcatcattctcagtaaactatcgcaaggacaaaaaaccaaacaccgcatgttctcactcatagatggaaattgaacaatgagaacacatggacacaggaaggggaacatcacactctggggactgttgtggggtggggggagtggggagggatagcattaggagatatacctaatgctaaatgacgagttaatgggtgcagcacaccagcatgacacatgtatacatatgtaactaacctgcacattgtgcacatgcaccctaaaacttaaagtataataataataagaaaaattatttttatctaatcataaaatctacatatgccaacatacagatcataaagaacaagttgtatttatatttcaagggaaaattatgtttactctattacctatcataataatgcttgtctgttgttgtaagccatccatcatcttagaagtaaataattgttgtgctgtaggaaaacacatcaatatagagaatgatgatggtgtgattataataattatcacacatatcataggtagttactaccatttaattctgttttaacatattatagagctagtaaggtcacattaaggagaagacacaagatgaaagacccttaaagaattcttgttcactggaaattacaagaataaaagtctgaagcaaatttggttgacaagtctttttctggctaaactatagttattgatatctagttattgatattatgggtttaagaaggattaaaataactttcagttgggaagaatgttttaagtagtcatctaaaagatgagaaagttgaaaagactaaagacttaggaggctataccatctagatttgtgtaagtacgttctatgaagtttgcacgatgtctaaattgcctaaagatgcattcctcacaatgtaacactgttgttaagtgtcatgtgactctataatacctaggagatatagtttggatattcgtctcctcctaacctcatgttgaaatgtgatctccgatgttggaggtgaggccagtgagaggtgtttgagtctgcttgtttctgcctcaccagaagcagatgctggcactatgcttcatgtacaacctgcagaaccatgagccaaataaacctcttttctttataaattacccagcctcacgtattcctttatagaaacacaaaactgactaacataataggatttggtaatatcatggtgccaagcatccactgggggtcttggaacacatcccccttggataaagggggaattactatctctgtatcttatacctgacttagatggcagggctttcaggattttgccagtaaacataatatgtaagggctgctgggttgtgttacaggtattttatcagttgtgttgtgtgcgtttattcgtacagaatccattggtttctagtttcttgtttctgttatttaaaaaaaatatattaagcatctactaaaactttccaaatacttttctttcttttttcacttttttggagggaaaataatcatattttctcacattctactgttgttttaataaggtactagaattgatttgctaagactttgtttagaatatttgcatattgtaagtgggatatacttgtaatttttttcttcagtcctatattctaagttttcctcatggtgctattatgattttgtaagaaagaattgcatatatttctttcttaatttatataattgattcccaacatgggctgcatatcagaattttaaaagctagaaatgcaagaaattactaaagccagggccctaccctagatcaattacatggatgtagagtgtctgtgatttcagtttaatacagtctaagatttcttctcttttaacttttcaaaagaagtagacaaaaaagagcacttggaagaaaacagggttaatggaaataatgtcatattttctttctgcaagttatccctttttctgtctttctctttctccccccatttccttcccattctcctacaaagaagtgtttgggcaataaattaggtggcagtactctgcatgagtgaatagtttgcactgatactcagtgcttacctatttgtgtcaatactttctgagtatgttccatctgtaaaatttgaaatcacaagttccttctcagctccaggagataacagatgaaatatcaggcaagaaatgagaaggatgtgatgctgattgctttctggaagactcaatttgtaagctgctgggaatccatatctttcccagttgacctttcttgttataccttctgtacatttttttcctctaacataaaaattatcatggggattcgtaggagattgtctgattcttgaaactgcatttgttactttgtgcaatttatagcagctttccacaagtaatttatcagtgcttgttgtttagtgccctgtgacagatctaccagttcacactctcacgagagcactgagacccttcttccatatgcagattttctttcttgattacatttaattctggttctgggatattgctaacagtgatgtcaaggagcatggcatggtgtctcccccatgttctaaggccgtctcagctctaataacatctttctgttgtattaacctgctgttcagtgaattcttagccatctgcttctggcttaggactgtgatttgagtattgtatctagtggatgcaaagggtaagaagatagatgttaaacattctctttctctgtgtgctacttaatttgcttgacatattacaaattgtaagttcctgtgtctgtcaacacatcctcaccacctccagactaacttgcacaagcttcagtgtgttgttggcttaaatccttgctccctccatagttccacccagtgcctaagacgagcgaatagtttccagttcacatgctgattaataaacatcacatttgattagtcatagtaaatggttgtgttagaaagaaccccgaagccatgtatttcctactcagatctcatccaacaggaaagatttagtggctatttttattacctttttcttttttcttttctttttttattttttgtttgtttgttagtttgagatggagtcttgctctgtcacctaggctagagtgcagtagcagtggttcaatcttggctcactgcaacctctgcctcccaggttcaagcagttttcctgcctcagcctcccaagaagatgggtctacagatgcacaccacctcatctggctaatttttgtatttttagtagagatcgggtttcaccatgttggccaggctggtctcaaactcctgacctcaggtaatctgcctgtctcggcctcccaaagtgctggaattcattacctttttctaagtgttatgaaaaacactacttttcatatatataacattttcttattctatgaaatacactaatttacttataacaacattagattttttttaaatctgcactaaaactaaattcattagtgagtttattgtgtattaatactgcaacttatggatactcgaacctgaatttcttgaatctgttactttccactgtaatgtctcaggaaacaagggattttcatgaattatttatactctataagactgaaaacaaaaggtgtcttgccttagtttgaatttaaacttaaaaatcttttcattttatgtttctaataattaaagttagttatgagatatattggaaaatttggaaaacattgaaggaaactttaaatggaagaaaaaagactttacatgatcctatcctcattgttaaaatatttatatacattcttccaggtttttgttataatacatgtttttgtaatgtaattaaaattatcctaagtaaataatatatacatatatatcctatttgtttcacttatcattataacgtaagtattctctaatatttaaaaactatcacattatttttaggggctcataatattccattaaatgattttgtttacttcatctaaccattcctaatattgtttattttcattgatttcttgattttaccataattagcaatgccacaatgatatattttggattattttattttaccagaaattgaattctcaaaacgaaggaaaaagacattatttcaaggctgttactaaattaaacctctttttaaataaacaactgaatattataagatatgtctgtgcaatgtagcttttaaactttgtcattttcctaaaaacgtgagtcacggaggatggtagcaatgatgaccccatcctggcaggtaataaatttttaagtggctttgcactggaaagatggactagatgcgctattgagatctgttgtacgatatgtgctatgaagaagagaaaaatacaggaaatcttcagagggtcgttgatcccagtgaagtactgcatcagaccacatgctgtgtaaatgtgcccactgggatttcatctaaaaacggaggaactaaaaattaccaaaatagtttaacttgaaatttagaaagtttagattacagttaagactatatatgattatcagaagcttactaaaaacatatctcacttttttagtatatttttctgacaaagttcaaagttagtgtaacccttcacttcatgggtgacctgcattgtgttcataaaaagagtctttttggcagaaatcttgcagtatgccagcagttttcccaacggcctgtcttaatgttttgaaattcaaatttttcttctttgaactgtcattttatgaacctcctcatcagtttcctgatctcttcctcttgttaactggtctaactctgccaggaagacattcatgagtggctttgtatgtggttcttcagcatcacttttatgaaatcctggataatttgcagaaaagtagtttcataattcgacccacttgcacttgtgtcttaaagatctgattttttaaaaaaatgacagaatggaaagaaatagatgtcttttgtaaaaagagagaaatgtttgagtgaggattgatttgataaattgtcagtcaattagcaaatattttgtattttgagttctaactaatgttacaacctcaagattgtggctaataaacacgtgggtaaaaaggccatctatgtgctctgctccttctgctcagtcctgtcttccaaacacatgtaagtgtttacatttcacgataacaaatgaaccacataatgaagataatttcacactaaccatgaagcttagctctgcaaagaacaatggttcccagtattggcttcatattagaattgccttggaagcttttaaaaaatgtccatgcccaagccttactcagataaatcagaacttctgaaagagagtcccagataccagtattttttaatgttctttttaaaaggaaagtataaatatgtatttaccattttctgcatctcccatctttaataatttttttttttttgatggggtcttgccctgtcacccaggctggagttcagtggtgtgatctcagctcactgcaacctccacctccaggttcaagtgattctcctacctcagcctccagagtagctgggattacaagtgtgcaccaccatgcctggctaatttttgtatttttagtagagacagggtttcaccatgttggtcaggctggtctcaaactcctgacctcaggtgatccgcccacctcagcttcccaaagtgctgggattactggcatgagccaccatgcccagcccatctctaagaatgcttattaactgtatctgaagatttagtgcctgagattctgcacttataattaatccctatatgactgtaatataagttattctggggaacaatttgagacaatgctgatacatgcagataaaaagtagtagaaaaaaatggtggattaatcttattctatggactagcaattctcaattatttcatttcagtttttacttttcatttcccaatgaatatcataaatgcctattttcaactctccataggacagtggctacttctgtatattaaaaacgaaaactagcatatcaattgtatctgttttgtggtgagcattattggtagtataaggattttaattcagctaatcaaacattggcacatcggtgtgtgatactttatgtttttttccaaaatacagtgtcacaaccatacttatggaacaattgccattaaagtaatgtctagaccagtgcttctaaaacttggttgtgcattcatattatctggggagatcgctgtatgtcagattccgattcatatgactggaacaaggcttaagaaacagcatttctaacaagcacctatattttgataatgttcctaaatcttggaccacaatttgagtagaaagtctgcagcctacactatataaatatacatatatgtatatatgtgtatgtattaatatgtattctttcccgcaagactagatcgtgtaggatagattcttctctggaaattgagcccttataacttccccataattgaattcaattgaaaaatatatttaactactatttattaagggccttttatggacagagcactttaaacatcaaacacgtgatgttattttgtcatactcacttaacttatactcaaggagaagcagtaatttgcccaagtccgcatcatttgaattgacagaactaaagtttatgctcatactggtgtggccccagagtcaataatcttagctactaagcaatgttatcctccccggctcatcagcttcctaccgcctccttcagcccagtgttttcactttcttttgtttatttccgataatgatgaaagattgtttcagcttcatcacaggccatgtagtgcaaattgaagacggctgtctaggcaaggctcttaactattaacattgtggaatacgcacacaagaaaaatccacagttgtgattgtacatttagcacctccacccatactcaagttattattttatacttaaagaatttggatttcctatagggaaaatgacatagccatcatctccatttctgaatgaaaaagtagaggaaataaatgtctcattactggggggctgaaatacatctcatagcagctcctgtaaaggaaaaataactaacatttattgatctgcttttctatgctgagtgttgtgctagccacttcacacatagatcaccctactcagtcctcacaacggtccactgaattattatcttccacacgttacagatgaagaaactgacaagcagggattaaagaaagacttgcctgcagttaacagctgctaaatgatggaggcaatgtttgccttttcagcgaatcaatatagttaaaggaatatagtgtttgtttctctacacgctgcagataacaattttgaatgcattagatgaatttgtaatatattgtgctaaaatagatgtttttattttagaacaaaagaaaacatgtttaatctgatgatcactgcaataactctagcctgattgagattcatgagagtagttatttatatgaggaagataaactaacatttctcaaaaggcacacccaaccaccaatatgttttacatgtgatttataaaataaatattccacaaagtgaaagatatggagtgttttcattattcttgcattttaacatttgtaatatactataacatgataaatgaattaggttatattgattaggtttttgctgcagtcagtaatcattttactttcttatcacttatgcctgagagtagaaattaaacaaatggcttaattacaatgagaggaaatatctttttctattccaagtagtagctctgaagataaaaacagacatatttcactgatgtctaacttctaattgatgataaaaccatgagtatgtcattaagtctgtgtttgtcttgagctatttctggattaggtgagtttttcaaatatctgagtggttgtttctttttcattgctattgtttgattttccctaaatattgctttcactctaaccctatatttccataggagtttttgttctgtgggaaaagttctatggggaagttttattgttctatggaaaagtttgccactttactaatcctgccttcccttgccttaccaactaaagatgagtttaccaaagtctggactccggcacatgtgctggtcttgtctctttttattctccctctctctgcctttattttatttctgttcctatactgtgattatttatttacaaaagttctctattacatgtaagctcttgagggcaaccattatttttttttaatcttttaaattccagctataatacagggtttagcactgaataagctcagtaaacattggtggaattaatgattattaaacgcccaggcagaaaattaattgattgaatattactaacaaactttctctaatttgagctagacaatattaaaatggcaattaacttttcttctctacttatactctcaaatttatcatcatgattgtatattctctaagaaaattaactccataaaattagtcattttaagaggaattccttacattttcatttggatcagacacacggatgcgtctctttgaaggaagtcttcttttctcagcaggttgtttctgactagaatccatttgtatccaaacaatttgagaccctcgttctgctttagcgcacagactttcctaggagcagtcgccattccaatattgtccacggagctggaatgtaattttcagacaagttctgattacaccccagtggttcatgaaactctaatgcatggcagttgtttgagaggattttactagtgaacacctcaaacaagatttcaaaattttatttttgtggggtagagagtgaaatacagagaggtggtgctgagctctgttgtaatacaaaaaagcctcttggcttctaatgcagagagtacttccagaaagaatgataatttagtgtgtgtaaaatcatttctacctagtgtaatactagaataattgttttataaaagaccctgctgttattgtaatggcacaaactggtatgcattaggcccctcttgtttatattagaatatttatttagaactaaatattagaggactcttaggctagagatgcaatccaggaggtgagttgcctgtattttttgcccagttagctttctaagaaagtagaaaaaaaatctttattgtgtactaggaaaaacctgatgtggaagaataagggtctgaaatctcatacagctgccccacatgcaagttgtgtgtccttaggtaattttcataatccctttgataattagaactacaagagaaatttagataatctatcataaattacttattgaagatatttctgctggaatacatttttgagaaggatttattaaatgtcaccttagggctttctcactgattacaagaatgcttcaaactaatattatacagtcttaaaatttttaagaattgagatggcaaacttctactacagtacccttatggagcaaggactggagcttcagcatagaaaacctctagctaaataagctcaccgtattcaaatgtgttgacaaagtgcaggatataggaaaccattctgcaagtcatgacaggattctccgcaggtattttcccctaggatatttaaaataggatgtaattgatggaaatcaatttgcagaatcttatctcgaacacttctgttggcacatctgtacttttatagaatcgtctcttgaggcttatctatttcagtaaagtttctaaatactgtaacgtcagtgtctaggctaaagatatgatggagagcatctaaatttaaaataagagagagtgctaatacgcaggtattaataaaaacttttcatgttcctgctagtgatgtcccttatgggaaactcatgcaacgttatttcatgatgtttatgattttgtaatcactctaaactacagagccattttctcactttctgaatgtgtttattatcaaaacaacattatctgatcttataagactgggtcctgtatttttttaagagctttgagagtagatggcaataataggttctctcaccactctggtttcacattgttccttctgtcttagaagtgtaatttattccctagattcctactttttaagaattcagtattttgcctttcttctttaaaagctaattgtgcatctcttcactctgtacaatgttttcaattgaataaaaacgtgttaaaaggttagtacaacctgatgtttaggagacctacgaatatagtgaaataattcttcataagtgtaaagtacaaatggcctaatgaatatagtcctgaagaaaatgtagtaaattgacttttgaaaataagttcactcttttcaaggttgttttcataggctattcagacatgtattcagggaatcagccaatcaaccagattacaactgaactaaaatgatgaaacaagcatggtgtcaggacctagaaaaaccatgtgactaatacgtggtcccataatcaaaggcacttatttagaaaagagatgattttgactattacctgatagagtcctccatgtaacatgtacctattccatgttttctcatttaagattctcttttcatattgtccatattataaatgatataccattttgttctgtatttaggtcataataattagtttttaattaagctgatcttctccaaaaatatcctacccaattctgctccaactattccagttctaccccttttgcaaattccaacctaaatcttgctttttctgaagtctttttcaatgttcaatcatattagcctatcatgttgcttactttgaattgctctgacataatttgtttttaaacaccatcatgccatacagtgcatagtccattacagtctaatttatggatacgttttgctttaccagtgattctcctgattcacttagattcttctactaccaagagtctggaaaggaaatccgcaactctcaagccagttttcaattccctttgctttatcttgtgaacatgataaagtttcctccttctctgattcttgatattttctactcttaaaatagcatttatcatctatttcatagggaccagatagagccataagtttacatgaggaaaaaaaagaattgactttgtgttagcttcccagttcagagattctcattacaactgtattcctgattgccaaaaggccctttaaatgaaatgcctcctgtaacaaagggaggctctatgtgggctgactttattatccaacagcagggaatatctgtgcattgaaaaaaagaagaaaatgctttgaaagaatacattttacaaagccggtagtaggtcaggggagcctttgcctgactctacgttagagtttttaaattgcttttggatgaggacagcctatttttatttctttgtcatccaacattgttatgataaataattaatttgctatattttatgtttctatcataatccatgttgtgagatcactgtggcattttgctgtaatgataagaagaaataaatggtgctacaatgcttaggaaagattgtgtaatttccagtgatggacagtctgggaaacttagcaaatggctggcctgggtctcacctagtagaaaaagctcagaagagatgagttaaagcgttgtcaattgttcagtcccatcccttcaatggaagtgctgaaaattaaggcacaagtcctaagccctgctgtaagattgtacaattcacaacatttcctagacccggcaacatgactcacagattggtgctgtctctgtctctgtctctctcaccacttgctctctctccccatcctctctctgaaggggaagactccttcagaactgtttttctgtgtagcatggatggaactggagatcattatgaatttgaaattagccaaatccattcttaaatacctcagactgacatacatcttccaaggattcaagttccagctggcatttgaaaacatggctttagaggctcattcaaccctgagattctgtgattgcatgatattctagtttaccttcatcttttccattttttcttttaaatgtaataatgcttccagtgtatattagtcactgacaactaatgaactgtaaaacattttcttatgctttccatagacccatagctagagatgttgacccagtgattaattctaaattgcaatcgatgggtaattattattattattattattattattaggcttttgaataatattgaatatgtccctgaagttagaaatttttccccactttcaaagtgaaagcctggaaaaatagttaagttggttcaaaagagccaaggattttattctttcttatgatactatcctcccaggtaagattttatatctatctatctatctatctgtctgtctatctatctatctatctatctatctatctatctatctatctagatatagaatcacatatagatatagatttaatatctccaattacttgcagaaattcatggagtgctgacgtgctgagagtatgtaaatagtacaccctaccgctgtttaaccttgtggtgaaatcatgtgcactcttcaggtcatgttccagtactttaatcaagttttccatttggtaaactgaaagaccctgtatttctaatgctttgctaatcactataggagcaaacatttattgaatgtgtcttatggaccagacactggtgatgataagaacaattgtatttattctgtttccttgaatcgtcttggccataccttatcgaggtacaatatttgctttcattttgcagatgaggaaacgtagattatgaaatgttaatcaactgactcaatgtatggtaaattctttctatcttactttctcccatttagtttttttctttcatttattgaacaaatatttatttagtttccattatgtaccagatgctgtgctaaacatgaggaatataaggatgaataaaacagaagtggtcttgtcaaaaagtaagtgacggaaatggaattctcacccaggcccactttattccaaggataaactcttcaccacccagtgtgccttcctcccttccttccagccttcctcccttccttccaacctcctttccttcccttcccttccctttccttccctctcccttccctctcccttccttccttccttcctccctctctctctccctccctccctccctctctctctctttttctttttttctttctttcttgcttgcttgctttctctgtgtgattcttcctatatcacaacaaagaatgcaatcatgacagtgaatatgagagaaggttttcttcgtatctgattgactaactcccttctactacttgaggacagtgcagctcagcccttctcccctcccgtcttggattttctttcccctgccatcctagctgcagaaagctcagggacatcagcccattcaaatggtgatatcccatctttcaagatttaaccccctgtatcttgcaaaccatctcactttccaaagccccttattaaattgtccaaactcgctgtttaagtaagacatggccatttccacatgacagaatataaactgctgatagtttttgtattgtattatggggtaaagggacaaatctactgtgaccagtgataatacactcaaagattctcactgcctcaggcactttctgaccaccctgctcagggacaatccatgtctccatacccagtaagtcatgcacagcattccagatagggaagattctttgtgttaattccagtgatggctggctgtagtgggttttatttttcaggtaaccctgagccaggccctgtgggaactgaaatacaagtagaccttcctgtgagttccatacagagatctctcaggaacttgctcttttacctcccggccactctatgataagtggaagttaaaggagttggtttcactctaccactacttcactgtggtgctcagtgtgacatgttcacctggtgttcagaggtctaaaagaaatgaattctgcagtacagagagaaattttaaaagggagagacaaaaggggaaaaaacaggatgaggttagcatatgaaagtgttttctttccctccctttgggctggttttacaatgctagtgtgctagtagaatggctgctttcttcagcactttgttaaaggtccctggttgggtaagaaacttgactgcactaggacacatcaaacaaccagccaggctttggtcttacccaggcactgaaaagctgagccctgtgctctgctctcccatttgccacattttgccggatgagtctggtatgcttcagacaagcagttacacatttcacgaaggaaagaggtcggtggatggaaaattactgtcatttttagtgggtgaaggcaaagaagacctaccttctcttccattgtgagatactgtacagcaccttcgattcatgtgcgtaggtctgaattctgttttcaggatacttagtgttgtgtttgtagaattgaggagatgctacctaggggagaccatggagatccactgaagtggctgcggctgattgtgattgaatttttaagcatttactgaacattcctaatttgtctgtatggaggttaacaacaatttcctacaaactgagtcaaaaggacatattttatttttgtttgtacatgaactttctgcatcgtctgatgaagaccattatcccctctttccagatatcctcattttctttcttctaaatgtctggttgccctttctgagaatttttcattgattcctctttctcttcctagctgtgaaatattataccaggttcctttctcaccctgctcaccaactcactccttccaacttgtgtgttaatttcctcactcccgtaactcatgagaaaaacaacaacaaacaacaagatttgaatgtgttaagctgtaccccatgctgggatagttattttgccactgactcttaggaatcactgcctgatccctgctactctaaattcctgtctcagtttttgtcaataattaaataattaacttttggttatagaaaaacatagacctaagacctatgtttaccccaaaagggaactaacggcgtccatttctctctctgaagcctgagacaattttccggaactccagaattagctatgtgcttgctagtgtttcccatttgatatcctataatcaaatgtgcaaaattgaactcatcttttcttcaccctaaactcgcaattctgcttatatttccatgtttagcaaatgtcactattagctatacacatgctctaattaaaatatggaagtctttcctgatttgtttcttttcctaatacattttctacccagtgattgtgctcctggtaattagtttattgactttggctctgtcctctccatcacttgccaccttattaagaccccattattccttgtccgtgtgatcacagaagtttcctatccggtcttcttgcttacactgttggattcttctaatgcattattcccacagcagctgccagacttgcttttctaaggcataaatatagcctatttatcccttgattttgttctttaatattgttctcataagcaattattacagctggctctaccagtacactgtattttcttccctgagtgctacttccagtttccagtataggacatgagcatgctcttctgacctggaacacatgcaggctgcttgctttctctacctcactaactgctaatcatcttcagaaggcaaggtgatgcaaggaaaagagaatgcactctgattatagcctcagactgaatttccaatcccagttctaaaacttctgagctaagtgactgaaaaattacctaaccttgtttagtatcaatttttgtatctgtttttcagataataataataatagtagctactttaaaaggttagtggattgaggtacatatgtaaagttatctattggtttgacttcttcaagcagccacaactaagttccagcaaaccaaaacaaacaatttattaacaaaactctatgatacttcacaaaattaaagaaaagaatggcaaaaccagaatatatctatagatgtaaagagctaaaactgaggacatcataaccctaggaatcctagggtttttatctctgcttctaagttgcttttaattcttcatctccatggctccaagagataccatatacctagttagccccatcagaaaaactaggggcaatgactctgaatggccgagcttaagttatgtggctaacattagactcatccctatgacagataggataaggagcattaattatctcattttggatcacatgtctatctgtgtggtagaagacctgagccaggaaaaaacgcaataattgtagtcaagagcttctttgtccaatgtacaatacattcttcccatacaaaaaattacaagagtcgttctatttaacataattcaagtatcacacatgcattcatcctcttccaagtagtagaaaacttaaagtcatatccaactattgcaaccagaaccaagtttatagtatctctgggatgtgcattccttttaattatttgctcatatgttgctcattaccttgcaatatatgaacaaaatctatatgtttaaccacatctcagacatgcattatacaacaatgttgagaaaaacaagaaaacagctataaaaattcccacgtaggatagggttacagtggaatccccatatatctgttactggttgaagaaaataatatatgcatggacaagaatagtaaggagcagacattggttggcttgaacctttccagttgagtcaccattgcttattttccccatctgacctttatggtacttcttctgagcattattctttctggctgcacctgagggggtctttaggaaagactccctggggactgtacatttttctgtgcttctctagtgtagtcacaaggtgctaacagttactttagaagttagcagatgtatcttagaaacatgttggatttacttgggaattcaattacataaaagtcaaattggccacctaatttggatgtttttatgtgggtagatctggtttgtttaaaaatcaaacaaccagaattattattcagttgtaaactttaaatctgaaccctgaccttgcaaattctaaccttaataaggctcttcatgttttgcccatttcactaggacttattttaaagctttcaaccacagaatcctagattggatactaagaaaggatgaacagctgttctgaagctgggaatccctgagaactgggcatttcagttgaaggagttataatctctttctgataagtcacatcccaagaaaagataatgagagcctggagcaaggcttccaccatttctgtggctgctgtcatgtgctagactctggtcgttttcacggcatagactcgagttcaggtactaggccattcctacaacctcacctggtgacacacagagtcccgtctcttcagaatgccctttcctttcttgtctgttattcatctgtcatgaattcttcttccaggtagaacattagtttttctgtaatgaaaacatttcttctaattctatctaaaacaaaacatttctccacttatagatgataaatttagcactttgtcactcaatatcttgtgccactctttgttcctatgtgtgagtcatgctacatcaaagaaattcaaagggaagaacatgttacacaattctattttctatagcacccagttcaaggttgaatatttattaattcactttgatctagcatataaaaactaaaaaatgattagtcacgtggagaagagggtggggctagcctgtggaaagtcacagagatacaatatactcataacaaacctgcacttgtatctcctgaatctaaaatataaaaaacatttgaaaaaatctataatgcaattctgtaaaagtagagtaataattctcttctattttttctacctagatgtacctgagtacatctcccttttgctgccttgtacagtgactcaggcagtggtgattaatccaagaggggtggtggaagaggctgtgcattcatgtagaaatgcaacaaaaccaccaagcctgtgtttggctagaaaagcttcttaggatgttctgatgcttggtcctaggagacagcacttttcccttctatactaagctaaatggctggattagcatggaaaactgaaagttagaactacaaagtacctcccttgcattctggaaatgcggaagaaagcaagctgtaatcttggcatgtgaggaatccacagtctaagtgactgacaagtgcgcatgtgaggacaaaccatgatagagatgggcacagagtgttatggactagaatagaggagttaggtaagatttcccagaggaagtcatgtgtgggatgagtttaatcaaggatgctacatgaatcattaccatcgtcaacaaaggagaagttaggaggacatatttttcattgatatttttacatggttaacagtgattggatgtgggaagtgtgtgtatgtgtgtatgtgtgtgtgtctgtgtctgtctgtgtctgcatgtatcccgagatgtcattaacattccaggttaatactcattcatgtatttattgctcagtccagcttcccctccgtggtttgtttttttttaatttctagtttttttttcttcaactgttattttaagttcagcggtacatgtgcaggatgtgcaggtttgttacataggtaaacatgtgccatggtgtcttgctgcacaaatcatcccatcacctaggtattaagcctgttagctcttcttcctaatgctctccctctcccatgccccttaccaccctgcgacagaccccagagtgtgttattcccccccaacattccatgtgttcctgtcactcagctcccacttataagtgagagcatgtggcgtttggtttcctgttcctgcattagtttgctgagaataatggcttctagctccatccatgtccctgcaaaggacatgatctcattcatttttgtggctgtacagcatttccatggtgtatatgtaccacatattccttattcaatctatcattgatgggcatttaggttgattccctgtctttgatattgtgaatagtgctgcaatgaacatatgtgtacatacatcttcatatagtataatttatattcctttgtgtacatactcagtaataggattgctgggtcaaatagtatttctgcctctaggtctttgaggaattgctccactgtcttccacaatgattgaactaatttacactcccaccaacagtgtgaaagcattcctttttgtctgcaacctcactagcatttgttgtttttttggctttttaataataaccattctgactagcatggtacctcattgaggttttgatttgcgtttctctaatgatcagtgatgctgagctttttttttcatatgttggttggccgcgtgtatgtcttcttttgagaagtgtctgttcatgtcctttgcccactttttttaatggggttgtttgtttatttcttgtaaatttgtgtaagtaccttgtagactctggatattagtcctttgttagatggatagattgcaaaattttctcccattctttaggttgtctgttcactctgatgacagtttcttttgctgtgaagatgctctttagtttaattagatcccatttgtcaatttttgtttttgttgcaattgcttttgttgatatcattataaaatctttgcccatgcctatatactgaatggtattgcctagactttcttctagggtttttatagttttgagttttacatttaagtcttttgtatgtcttgagttaatttttgtattctgtgtaaggaactggtttagtttcagttttctgcatatcgctagccagcactcccagcaccattgattaaatggggagtcctttccccattgcttatttttattaattttgtcaaatatcagatgggtgtaggtgtgcagtcttatttctgagttcttcattctgttccattgttctgtgtgtctgttcttgtacccgtaccatgctgttttggttacagtagccttgtaataatatagtttgaagccaggtagcatgatgcctccagctttgttcttttgcttaggattgtcttggctatttgggatctttttggttccatgtgaatatacaaatattttttctaattctgtgaagaatgtaaatggtagtttaatgggaaaagcattaaatctataaattactttgggtagtatgtccattttcacagtattgattcttcctatctacgagcatggaatgtttctccatttatttgtgtcctgtctgatttccttgagcagtggtttgtagttctccttgaagagttccttcatttccttgttagctgtattctttttgtagcagttttgaatgggagttcattcatgatttggctctctgcttgcctgttgtcagtgcataggaatgctagcaatttttgcacatagattttgtatcctgagactttgctgaagttgcttatcagtttaagaaacttttgggctgagatgaggaggtattctaaatataggatcatgtcatctttaaataaagataatctgacttcctctcttcctatctgaatactgtttattcctttctcttgcctaattgccctggccagaaccaataccatgttgaataagagtggtgagaaagggcatccttgccttgtactggtttttcaggagaatgctttcagcttttgcccattaagtgtgatattagctgtgggtttgttatatatggcttttattattttgatgtatgttccttcaatacctagtttactgagagttttaaacataaagggatgttgaattttattgaaggctttttctgtgtctgttgaggtaatcatgtggtttttgtctatagttctgttgatgtgaggaatcacagttattgatttgtgtacatttaactaaccttgtatcctggggatgaagccaacttgatcatggtggaaaagctttttgatgtgctgctggatttggtttgccagtattttattgaggatttttgcatcagcgttcatcaagtatattggcctgaagttttcatttttggttgtgtctctgccaggtttttgtatccggatgatgctgacctcatagaatgagttaggaagaagtcattcaattttttgagaatcattttcaattttttggaatagtttcagtagaagtggtggcagctcttctttgtacctctggtagaattcacctgtgaatctgtctagtcctgggctttttttggttggtagactatttattactgtctcaatttcaaactcattattattgatctattcagggattcagtttctttgtggttcagttttgggaggatatatgtgtccaggaatttgtctacctattctagattttctattttatgtgcgtagagatgtttatagtattctctgatggttgtctgtatttctgtggggtcagtggtgatatcatttcttatcatttctgattgtgtttatttgattcttctctcttttcttctttattagtatagctagtggtctatctattttgttaattgtctccaaaaaccagctcctggattcgtttattttttgaagggttttttgtgtttctatctccttcagttctgctttgatcttggttatttcttgtcttttccagctgtggggtttgtttgctcttgcttctctagttcttttagtcgagatgttaggttgttaacttgagatctttctagctttttgatgtgggcatttagtgctattaagttccctcttaacactgctttagctgcatcccagagattctggtacattgtttctttgttctcattagtttcaaagatcttgttgatgtctgcctaaatttcattgtttacccaagagtcattcaggagcaggttgttcaatttccatttgatggtgtggctttgagtgaatttcttgatcttgagttctaatttggttgtgctgctgtctaagagactgtttgttatgattttagttcttttgcatttgctgaggagtgttttacttctgattatgtgatcaattttaaagtgccatgtggtgatgaaaagaatgtatactctgttgtttgggggtggagagctctgtaggtatatatcaggtctgcttgatccagagctgagttcaggtcctgaatatctttgttagttttctgtctcaatgatctgtctaatattgtcagtgaggtattaaagtcttccactattattgtgtgggagtctaagtctctttttaggtctctaagcacttgctttatgaatctgggtgctcctgtattgggtgcatatatattttagtatagttagctgttcttgcttaattgaaccctttacaattatgtaatgcccttctttgtcttttgtgatctttttggtttaaagtctgttttgtcagaaactaggattgcaaccccttcttctctgatttctatttgcttggtaaattttcctccatccctttattttaagtctatgtgtgtctttgcacgtgagatgggtcttttgaagacagcatagtgatgggtcttggccatttatccagcttgcctttctgtgtcttttaattggggcattaagcccatttacatttaagattagtattgttatgggtgaatttgatcctatcatcatgatgctggctggtcattttgcagaattgtgtatgtggttgcttcatagtgtcactggtctgtgtatttcagtgtggttttttagtggctggtaacaattttttctttcaattttcagtgattctttcaggagctcttacaaggcagtcctgagggtgacaaattccctcaggatttgcttgtctgtaaaggatcttatttctctttcacttatgaagcttagtttcaccagatatgaagttctaggctggaaattattttcttcaagaacgttgaatattggcccccaatctcttctggcttatagggtttccactgagaagtccactgttagtctgatggcttttcctttgtaggtgatctggactttctctctggctgcccttaacattttttctttcatttcgattttggagaatctgaggattatgtgtcctggggttgatcttctcatggagtatcctactggagttctctgaatttcctgaatttaaatgttggcctgtcttgctaggtttgggaagttctcctggatgatatcctgaaatatgttttccaactttattccattctccccatctctttgaggtaccccaatcagtcgtaggttctgtctctttacataatcccatatttcttggaggtttcgtttgctcttttttattcttttatctctattcttttctgcctgtcttatttcagaaagatagtcttcaagctctgagattctttcccctacttgtctccatttttctcaggaggtattttaacaaaatttaaagggatgtaccacactgtttacaattactgtgtatatttgtgtttacgtgtgcacgtgtgtgtacgatgaacccaaggaaagcatattctaaaataaggaccaataatattattttctatgatttcttcttagtactgaacccaataaaggaatatcaagaatgtttcagacagtagggtaagatagagataaatcctacaattgccacttataatctgggtaactttgggaaaattacctttctttgaacttattttattaatttttagaatgagaataataaaaataccctcctcataggactgtggtgaagattaagagaattaattaatataaaacagcatggagccaagcatatggtaagaccttaaggaattttatttcattaattataaaagacacatttctcccctacattttaacatctccgtagagaaaatatgtcttacaatttatgttcttatagttgatgaagcaagtattcttatttaaatatgatttataatcgaaacatagttttttgttttaaaatgttagaaatcaacactatgaactcagataccaattctctcagtggggatagtttgcagtgaaggaaataaaatggagaaatttgcaaattaggacaaaattaatatgtgttctctttgagtttattcatatttattccacaaacatttgaatggataaccatgtgccaaattctgtgtaggacaaatttcacaagatgaataaaacgtaatatttgtcttcaaagatctaacacatgttcatggaagacaacagaaccgtataagtacagcatcagttataagtacctaagctaattgtttacatagaagaaagacctaattcataggagaggagagggtggggaaagacaaaatgaaagatgtgatttctaaattaagtctcaacagactggtaaagtgagccaggtaaaaggtgaagggaagtaagctctagaaggaggtaatacaaaaggacttgggagaagaagagagaagaatctttcttgtccaagaaactacatgatatttaatttggatgaaatatttgcagaaggagtaaaaaatctcagctagaagttaagaagggtcagctcacggaggaccttgcctagttatgctgatgagcttgaactttagcaggagttaaatgaaaatactctgaaacagtttaaaatggagggggtgatatactcacaattttatttccaaactgttgttcagagtgaattaaagtggataggatcaaagacaaagagggcagttaggcgcttattgtgatcattattaatagtggtattggagatgtagtgaaatgggcgattatgaaagtgatagaatctataggacttgatgattaatggaatgtgaaatagagagaagttaagttgtaataaccacatctcagttcaaatgataaacaaatgccatgcagatctagagcgggggccatttgcctgagccattgtgcctaacacagtgctgagtccacaataaaccaatgctaaacagttgtacattgacatatcatcgattcctctggaaattctttgagtacttcacacacagatgtccatattgaattaatacataattatcaagagaaaaaatatccctgagtcaacattctagaaatgttcaagtgtctagattggattttctcattgtccttttccataacaacacagtgacttggaacataacatgacactaagaaatagaagaataaaaaggatcttgaagcaattcccttttatcttgctttattcttaacagcatttctctggtctaattcttttatggttccagggagaattacatttcaaattccataattgcacaggagaattggagtcttgtaaaaatttagagtacttcattcaaaggcaatttttattatcaactgaacctatgctgtgatgcagccaaagaaattgtttagagcatcattaaaataacctttttaatatgactgctttctcttgaaaaaatgtagcaccctcttatttaatattaccatattacaatggactatatatttgttgaaagtcttatagtatggtatttagtatattgaaccagcacaaaatatacatgaactttatcagttttcattttccctttacaaaccaagaacaatattaaatgacattttatgacatttgataggtatttaaaatttgttattgaggttcttcagtgagccataaaatacaagtgtaacagtatggctgtgctttcattatgagaaatgcaagcaggaagcatttaaatcagcaccattttccatcaatgtcttgctcctgattctctgccaagttcattatctcttctgtccctaaatttgtccatatgaaaaattaggagaaaaaagaataaattaatacctgcctctaaaatgatctgaaatccaggtatggaaaatcttatacaagtttaaaagactggtttattcactactgtcctcatttgtttgaacacactacaatgttctgtgggatagtagctgagagacaagcaatagtccttttcacaccttccatccgtaaagacaattcttttatttgcagctgaagctattatatccagagcctatggctgtttggctcttttaacaatggaaattttaaaagagaaacagcaggtaaaatgtgaaaatgtcctctgggatattattttattactacatgtcccttatcatttagcaaactagatgcaatataaaaaattaagtcagtttgtttggtgcctggttggcaaaaaatcaaataacagttactaaagaaataatggtgagctaacctaaactctgcgtgtgtgtgtgcgcgcgtgccataaagccaaggtggagaggtgaatgaaaaagtcattagaggagaggcaaaagccatatcgcttgaaaaaagcaccatggtatcatggtcgaagaatgggctttagacgctggcaagcttgggtttcaattatggcattttgcagtgtgctatttatttccgagcattaatttctacaatgaaaaaatacataattaatatctcataggatttgaaggatcaagtgagatgactgaaataaagtatgaatccagatgtctgtcatattaattctctcttttaatcatgggagctattgacaatgcaaaaggtactcagtatagcactagaatgatagtgtacctcccgagataatgtgtaaggtccttcactaacacctttttcataggaatattgttgagctgccttcacacagatagaatatctgggttacaaccactttgcagaaaagttaccagatatagctttttgaaattttctgcctgggttaaaattacagtcttgtagtaactctttggtgcatattagtaactgctgaactgtgtggtgttgagccaatcacattgatgggaaaggaaatttaatgcatcagacaagggaaagttaccacggttagttagtagacatagaatgctctaagttagtaaattcatggtaagttatgcaatagaagagatcataaataactaaataacagggaaactgcaaaaagactagcagaagttggctgggcacagtggctcatgtctgtaatcccagcactttgggaggccgaggagggtggatcatgaggtcagcaattcaagaacagcctgtccaacatgatgaaaccccgtctctaccaaaaatataataaattagccaggcatggtggcaggcacttgtaatcccagctacttgagaggctaaggcaggagaattgcttgaacccaggaggcagaggttgcagtgagctgagatcgcgcaactgcactccagcctaggcaacagagtgagactctgtctcaaaaaaaaaaaaaaaaaaagactagcagaagcacatcagttattattattctgtaggaggttcaaccagaatctatctctttgctctctattatctataagtcaccttctagatcttacaacaggggcagaagtacacctctctgaaatatccttcttacaactgtaacttatagatttggtttggtgtctacattgccaacattacttaaatgtttacaattccactgtgacctgttgtcactattacatttcagagatgtataaaagaaatgtcctcttctatgcaggaatatttgtatttcatgttggaattaaaacccaggcatgttttagtgtacagataggtacccttctaaaatattaaatcattaccccacagcatgaattaacctttgtgcctctgctcttataacatcattaacataatcatgataggatataaaacactcatagttaccctcacccctgctcttggctctctctgagggaagccagcttccatatcataaaaagaggcccataaggaaaaaaaatggaggcctcttgcctggagctaggagaattagctgtctgggaagtggatgtttcagtgtcagtaaagccttcagctgactgctgccccatctgccatcttgactgcaacctcatgagagaccacgagccagaacaatcccagccaagactccccagggtgcctcacctcagaaattgtgtgagataaatttgtcatttttagctattaacttttaacattatctgttatgcagcaataaataatcaatacaggagggtcaaggggtcaagtgtttcttgttgatacccagaacacgtgagatcagggagtaagtaacagaccttctagaacaagggttgattaaatctaagtcaggagaacaaggctcaatcagtcaagggatcttggaaagcaagtgaaagtttggagagttgagaacaaggcccttagaagtgactcatggtgtgaataaattccagagagcaagagcaactgcctgcctggcttcttgcattttcacagcttgcatttggaaaggggggcttggtgcattcaaatgaataaaaacaagatggtcataacatattatgaatactgtctgtatagtcaggcacctttcccaaagtaataatttgaaataaagattccattggtcagtaacaggcaattcccatttttgagtgctttcgtgatgtgttcaatattcccagttattacttcccaggcattatgctttatagaaaagtacctattttttaatgactggataagctgggccttacaatccacttcaaacctgttgttctatttgtccatgagtacacaggctgctctaggcaggaggacatgaaactacaaaccattaaatggtgataatctaaaaaacgttaagtaattgtcttgcagacgtaaactcagaataacatgctatatacatcttggaggtaccatgaaggcatggcccaagctgtatatatgtatgcgtttgtataaatatacatatgcatgcaatcatatatacatatgcgtgtgtgtgtgtgtgtgttgagagaaagagaaaggagagatacctagcacaagaacatattttgataatttaattcacagacataaaaaggaaatgtgggcacttaagagactttcacttgaacgatatcgctccacagtgaggcctttggggaaatctctgcacacactgcaaacactgttatggtagaaggaagctttcttctccctgttactattagagagtttgtcacctatctttgaggctcttggcccatatctaagtatgaggaaagaaaccttagcagtctttgataggcagaggataacattgtaaaccctagagctgtgttttaagaggaagttagaacaccagtaagaggaaggtttacatgttaagacaaacagatgaaccagctgagtaaatgtgggacttgaaggtttcccaatactctccagctccaagaagaatggacttaattaactgagagctgagaccacacagtgtgggaagagcagaggaaccagaaggggcaaggtcaagggagtgaatggaaaggagagatgctgctggactctgttgaacaaatgggagagtatgtgtctatttttgtaatctattagttacgatactcttagatacaacaaggaaagtcaaattcgggtttgttgaaagacataggaactttactggctaccgtgaaaggagagccccgtggtagatggacattaaggctgtactgattctgtggctcaaaagtatcactaagagccatattcattttcgtgtctttgtcctgctcctgcctgctatggaaccagcttaatcctaaagcctggatccccatcagagtcacagaatacaaagcatttgtatgttgtatggaggaggagtaactgttcaaataaaaactggggaagtctccaggcaggggggaaagcaactgtttttgttggagaatcaatcacctccccacaccaccctccaccttctcctgcccctgtcccaatggctgtatcatcctatggagataccatctgcatatccaatagacagagtaaaacaaacaaactcctaggtgtagattacttcccacctttccaggtattaaaggtattttatagaaatatgtgtgtatgtatattttcctgaaagagagtaaaaatatttgtcaggaattgaaagaaatcggtgatcctaaaatgtcaaaaatcacaaaattttaggtaaagtttcaagataaattggttcttacttctcttctattgtttccccaatttacatccacatcacaaacacaagaacaactcaaaccttttccttttgtcatcctacaccatgtcatgcctcgggttatttgaccacgtcacttcctctgcctcttctgcctggtaagccttaactctgcctttatgacggaattcatgtacagcctcttcactggagcttttctttattgctttctctttgtgaacagcagatccagctcttttgtaccataaacgtcccctaacaataagcacatactccacaacattggtactttttgtttgcctgtcctactccctaatgagactgtgaggaatttacacacaggatttgtgcctttcctattcgtcttttggtgagctgtgctggcttatgaagctgttgttcagtgaacacacaaccattgataggtgtgattttcagcaaagtgacaatagagaacgtgtaggagctttgtgatggtgtactagtatcattgttattattattattattcaatttaagagaggtttttctccttggttaggacctgaaaacctacagggcaatatgataaaaataaatctctagataaatgatgtgatcttctttaatcttggggattcacacatcatggccctgaagcaagctagtgaatgtaattcttaagtgctaacatttgtggagtgctttctatatgccaggtgccatgcttaatgctccacattcatcattccatttgatctttacaaaaatctcaggagatgggttccattattattggtcccattttatagatgagaatgctaggatttgcagagagtatgtacatcatccatgtcacactatctgttcattagatgaggcaggatttgaattcagggccctctagctataattaagcccttcagaccagttaaagattatgctttaaggtgctctgtgtgcaaggcaaagcgctatataatttattataaaatattctttaactcttaaccataatcttgcaaggtagaaattattgctctcattttaaaggtggggaaactgagttttaaagaagataactacatttgcctaaaaagtataatcagtaatgttagtgccaccctttgacagaagtttatttaattcctgaattcatgtacctttcaatcgaaacccaggaaaaacgagtgccaactacatccaaggaattgttgatgggaatggggggtgggcagtccaggaaagctgaggctgttatgagaaaatgtctctgccttgtggggacttataacactgtcaagatggtaaaatctggtattataaaacaggaatagcatttgaggtcatctatgaaaataatgtgaaaagctagctacaaatgaaaaatttaaataacaaatcagcgcaagcctagagagatacctctggatagaaggtgattaattctctagtaaattagatgaataattattgatatagccactagaggaagggggatttgggctccaaatttactcactgtctttgaagaagctggtcctctgagcatctgtaagttacctcactgcagtgtaatgtgattgtcaatgtatttatagatcaaccacattagactgtaagttacatgagggaaggtggggccatgtattgtatttttgttctcagaatttgacctaatttgttgtacttagtaggtattcagtacaaatatattgcatgagtctaccatcacttcaaccaggggggcatggtcagaagaaccatcatacaggaagcaagttttgaagtgaggaaattttttttttttgacagtttaagatggtatgggaagtccctttaggtggatgaaatggtgtgagccacttgatgttgttgggagagcatcacagtgggcgatctctattcctagcatctgcctggtccactggtagtgggtggccattgctctctggaaatggacctgcagagagggcacaggcaccaggagatatcagagtggcattatataatttaagatatttagccttgatcttgaaagatcacatgctgccctgttacctcgtatacttggctccttctccctggtccatgaggccatttgaagacacttaaaatgcctatttcattcctcactgcacctatggctttatattgccttgtcatattcaacgctgatgctgtggtctgcacacgtataagtcacaaggatgccttctggcatttatcaggcacaggtttcttggatccatcctggattctgcctctttcctaagaacagagtatggctctgaaatggatgctaacctcagaccaaccagctgagtggatggaaaggagccaaaggaaaaccccagaagatagtccagaaagaagatggaggctcttatgtctgtgttgttcacatcaaaatcttcactttctttgtaccttgaacaatttggagtccactttatcttgaacctacatccaaatacctctgtattagggtgagcagggtgggaagaaggggaggggatatacattggcagagagatgatcttctcctggaggttgtagtgtgtcaccaagaaagtcattgcattgccggtgagattcaaataattaaagtatatgtgaaatcactttcaaaaaattctatatggaaagttatatgttgtaattaaatggttttattgacatagagttttacattaacgaagcattctttttcaaaaaaaataatatatctaaatctttttctcagttaagaactatgcttcttgttctggggaaaacaaaccacttttatttacaggagaaacaaatatactttttaaaaatccagaaaattgtaaataggctagcagagctgctaaacacgcataagatcacaattgtgattttacaatacatcttaataaaaagagtaaattacttttcattttcacagacataagtttgtttttaggctttcccaagtggattgatacacttgtttgaatgtgatttccatttacctttatattaaaataaatggaagtgaaaaggtcaagtttattcagaaaattgttagctatccttgggaaaaactaattcagcatgtgtgattttaatcaattttcattcattgttaaagttcacacaaagtttagcttgatgtccataggaaatggaagtggtgactggtatatcaggcacgataagtataccaaatctgaagtcctctagatagtatggttaataaagcatatttgtctggttccataaaatagaaatgttgaaactagaagagctgctgggttaataggagcattttcaattctcaatcttcattattctcaatgccaagagggaaaatttgactcaaacacactgtttgggctgtaaatcagagtagttacagggtgacttgggaccagctatgaaagaaagaacccagaagtgggtgatatgaggaaatatatgccccaaagaagggatttgggcctttttcctactgcctcccacagagccgggctgtaccacatgcttttccaaattttcatttagctccctttatgtgctagggatcatcagggcaacagggcaaggctggatgatgttatggtgttataaaggttaggaataaggcaatgctcagaatgatgtatttcagaaaggactacatgcccataaatgcaatctagataaagatgggattaggcactgaagctgtaattgtgctggtgatagacatgccagcaatagcagtggtgttggtgatagacaatcaaagatggaaaggatccgtgtggcctgaaataagatagattggggagaaggaaggtcttagtctgatagtgaagtaaggagagggattgaacaggctgattgaatgatcattccaggcctcagtagggatgcagagatagggacgctatgtgatagatgtgtgtagatactagcctattctgctacagccagtaggaatgttatgttttgacatatttgattgacagatgcaagttgtaccagactacacaaaccaaatagttaatagttatctcaaaagaggatgttgacagatttcaaccatttgcagggtcattatggcccaacctttggaaaattaccattggtatccctcaataatattattttgcaatttggtttttaaacactctctctcccttttaggtaagtgtgtacaggtgcatatgatagatttcaaatgtgaagtatacctacagggtgagaaatgtaatggacaaaatggggggttatggactgaattgtatcccctgaataatttatatgttgaagctctaacctctgatatgattgaatttggagatagggtctttaaggaggtaattaaggttaaatgaggctatagtggtggaatcctaactctatagactggtgtccttataagaaaaggaagagagagtgcacatctataggaaagactatctgaggacacagtgagaaggtagccatctacaagccaatgagggagcccctccccaaaaccaaccctgccaatgccttgctcttggacttccagcctccagaatcttgaaaaatgtaatttatgctgtttaagtcacccagtatatggtattatgttatggtagcctgagcagactagaacaaggggccatggtcaaatagtaattctacaatggaagaaaattgaaagccacattgagctggacctcttcatagacccaactggagagccatgactttgtcaagagaatggagaaaattcttatcctaatatgacataatcttttagcccagtaccttttaaatagccttgttatactggatgtactataaatttatcttaaatttatcacttttgggggaggatgttctaaactacattttttcataagtttatgagaacaaaaggagtagaatatgtagataagtatatattcataagatgtatattatgtatatatacataagaatatgtatgtgtatatatttgttccatcttaacttttccataaagaatttataactcacatctgtcttaatttactttccttgatcaccgtgtctattagttgccaaaaggaaatggaaaacaccaatatatcttgttatgtttatactgagaatattctgtcaaattggttggaaaaaaactagaaaatacaaagtcctacagtatcaaggatttaataactattgaatgtataaatgataaaaataaaaagagaccatgaggacaaaaaagggagaggagagtataccagctaggatgctatcagtggcaagtaataaaatatccagtataagcagacttaaataatataaggctatattgccctaattaccaagaagattgaaactatgcttcaggtgtgggttgatcatggtggcaattccttatctatattatttgcccaggtccatgtatcagcttcatcctaaggctggcttctctcatggtagcaaagtagctctatttgttccaagggttcatatgaatattccacactgacaggaggagagagtgtcattgtttagtaggtttatggagttaactatgctgcccccatgggccatttttctactttatgcagactagccttctaaagaacctagcatatttgaggagtaacttaaattacagtgcaagttctaagtcagtgaaagagctgcctggccatatcttttgattccaaagttctgtaggacagaaccagcacattttacaaattggtttagaattatacaagcctgtctggtgtattatggggagaggtgtccctgatggggcctaactggaaagagagacaataagatcttgtattggcacccaagttgctgaaataaatgaccaaaaccttgattgtttaaaataacagtaatttacgctttcacagttctggaagccagaattcaaaaataaaggtgtgaacagggttggtttcttctgaagactctaaaggagaatatattccatgcctctatcttagcttatgggtgattttggtaacacttggcattttttgacttgcagacacatccctgcaatttctgccttcatcttcacatggcctttccctctaggtctctgtcttcttttatatctcttataagaacatttcactggatttaaagcccattctaaatctagaaccacatcaccttgtgatcgttaacctaattatatctgcaaagaccctattgcaaagtaatctcacattcacaggtattgaggggttaggaattggatctatcttctagtatccactgttcaacccactacagatctcttggagaaaattagcatgagtgaaggtccaggcagtggaggagcagagtttctaggcacatcttaattctggcaaaaagaagagtgtcatttaaagcagcattctcccaaggagggggatgtgaaaatatgttggaacttctctttataattttcttcatctaaggaaataagaaataaataatttttctaatattgggcatatagatggataccatggccctccctgggtctgtgggtcatgcaggtacatgtcaggtacaagaggcatcctgactttgggagggggatgccacacagatgtggggctgaccgtcacacgctttttcatccttttgttttctgtgtttcaggatccattgctgtttacatgggcccattaaatggagttatgactattttctagtttatgtaagttgaccttcacaagacgaacaattacctttaaatattgtttctgactaaagacaatactaagaatgcattagtaatagagaaaaaataggaagagctgacacttctacacttaagtggactcttatcagcccaagtaggaggtaaaattatggtaatctaatcagatataagaagcatttagataaccaaatttcaaattattagacagctaatatttgtattatgaatttatatccactgttgttagttgttaccatcactaaagtccatgatatgtatcgagacagtagttattaaaagtacatatttggggaatgtgaacttaaacatattttattaatggagcaaaatttttaaactttggaggccattggtttcatggaaataaccgtgcatcacttggggctcaatagctttacttgaaaatcccactaaaaagtgagtcatgagagtcttgctagccctttgggtgacaagagaacagaaccataggttagcaatgcaaggtaggtcagaaattaggtgcccagcttaatttctgttctgcttagctgctgtctgttctgctatccaatgccaatcaagtagagcaatggccagagtagtggagcgacagattctacttatatgtgataattcaccatctccagcctcttaagcagaattctatgcaccagtgtcagttatggaaaggggaacactgtatacaaatttccaatcccagggggactctaaaacctcaccagtttctacaaaggtttctaagtgtggaaggaggtttttcacaaacccagctgccagaattctacaagagttcttgactctggcagggactcaaaggagacacggctgcttcaggggtcatacctctactacttgcattcttagctccagtttggtaagaaagaataatgataggagtcaggcaaagcaactttattattcaaggataggcagctaaaacaaacaaacctagaatccatgctgagtcagttccccgagtctcaggaaagttgcccagggcaggtggagccttatctgttcatgcccacttcatactgcagctgagggacaccaaaagcaatccactatgggttttacaccctggttgcccctgggttgctgagcacaagcattgcaggatatcctgttccaggagggatgacaaagcctgggctattctaggtggtttctccttatgtcaggacactgtatcctcagcacatgctacagttttcccaaaaactacagcagaagggggaagaactgggtcagccaaggctctctggggccctgtcttcctgcacacattcttcccctgttcccaccaccggcacttactaattgacactatagacagaaaactgagcaccttggtctggaaggagacagtgctccagaggaatgttttgtagtttggttgcaactgtggctcaggtgtacatcactgtggtaaaaaaaaggaggaaagaaaagcaagaaaacagaaaaggaagaacgtgaagctaatgttgggtgtcagaaaagtcctaacagcattcctttaactcgtttacttttgtttgtttttgttttttgttttttgttttttttgagatggagtctcactctgttgcccaggctagagtacagtggcacaatcttggctcattgcaacctctgactcctgggttcaagcgattctccggcctcagccttctgaacagctgggactacaggcacactccaccttacccagctaattttgtattttttagtagagacagtgtttcactatgtaaaccaggctgatctcgaactcctggcctcaagggacccacccgcctctgcctcccaaagtgctgggatttcaggcttgagccacagcgcccagccccattgcttactctttcactgctctacctcttatcacaagaagctggcccttcaagccaagccaattcccaggctcctatgtcagctgcttgcatttgaccaaagggaggcattggcaggagattggagggaagaaagacaggaggagcctgggtactttcttcccctctctgagtcttaggtggcagctacagtgctacatctcttccgtgatctacctattgacatccaggttcattttgatttcattggcctctttcctctctctctccagcctaggtgtggaagcagccttctgctatttctgatctctaagtgacttccctgactcatttttggcttgtcaacttcttaattccctgtgtaaaaaatgcccttaaatttcctttatttcaatacaataactaatttctgttttcctggttggacaccaacatatcctttaaggtagaagtagataggtgatcatcattcaaattttatattttattacttaattgcatggtgttttccatttgcctatgattttattttttagctaagatatgttctataccttttcccctttgccttatgaaactgccaagaactaatttcatttttgatgtcctgaagggatattattagaaaagggatggagctgattgataaagcaaaaatacaaatttataattggtgaattgcagatcgatctatatgatgggaatacgttctaataagatttttttctctcatttcctccttgcagatggatccctgaaagcctattatctttaatataaaattcttatttattatcttttaaaggtttggaaggatgagagctttaaggggaaattgagtagagaatgagattaggaaaggatttcatgcagagaaagaaagatatataatgcaaactatgctatggtctttgcatatgcaaacaaagcatctgacctactttcaggaggccacactcttttgagcttttccagtaattcattctctcttcccaccaactctaccctgttagaatgcaaatagttaggactgtaatgtggggcatggtatagaatagatgttgacaaactactaaggcctgtgggccaaatctagctcacagtctgtttttgtaaataaagtttcattagcacatacctatgcttaattcaagtgcttattttctacagcttcttacatgccacaaaggcggatttgagtagttgcaatagagacaatgaacctgcaatgttgaaggtatttgctatgtagatctttatgaaaaactttgctaatccctgctatacaataagttgcttgcttttaagaggattactatgatctttttgcttttcaggtgaaacatttctggagcacctactgtgtgctaagtactggctagatgctttatagaataaaagcacaggccgggcatagtggctcatgcctgtaatcccagcaatctgggaggccaaggtgggtggatcacttgaggtcaggaatttgagaccagcctggccaacatggcaaaaccccacctctactaaaaatacaaaaattagctgggtgtggtagcacatgcctgtagtcccagctacttgggaggctgagacaggagaatcccatgaacccaggagacggaggttgcagacagttgagatcatgacactgcactccagcctgggcaacagagcaagactccgtctaaaaaaataaaaaaaattaaaagcacagatatgaaatgcaattaaatttttcatgtagtaggataagaatgacacctgcaaatttaggttagacaagggaataacatggatgcttagaagatacagacaagggttgttccagatgacaaagaaactgctttcgactaagatagagaacacaacagcaggggttaggattttactttcttttcaaaccaggaaagacaagagaatgccatcctcctgtgtgtatggagaaaacaaaagctgaacacagttatttgtgctttaagttcagcctgttggacttcatacactttcaaggaaagcagggcaagaaaaaaaaagattaaggtcaggaaaaaggcagtttttggatgatcatcaattcatttacccatttacccatcaacgtttgagtgccctttcttccaggcatggtatgacatgctgggcatagacaataattgtagcagaggaggttcctgcccccagaaaacttttattctggtgggtggcacagggtgaatagatataatacatacttccagctcagcagactaacaaggatttttatctcagaagaagatttaggaggatctttaaataaaagtgcaaggagaatgtgttgaagattcaggggagtggagagtttgagaaaatgggttcaggatccagctgcctgggttacaatgggtggccctttagggtgtacagctcccctttttgggaagttactgagtacctctgtgtttcaggttcctcatctttaaactgggatgataatagaatgtactcataagactgttgtaagcattaaatgaggccatgtctgcaaaatgcttaaagtagtcagtgcttggcacatagtaggagctatgatgtttactaatagaagaaccaacctgaccctttgtttttactctgagactgtccacgttttaattattttttttttgtgatagttccaataggataagtgaacaagtctaagaagagagaactgttttgttcttttttatattttaaatgaaagtacttgagggtcataaaatgaagctagcaagaagttataatttaattagcatgccattgtttatctacttcatctggaataattaacttcatgtatacaagactgctgcttccaaagatctcaaaatattttctttgaaaaatgcaattttccactgaaatatgtagaatagaaagtcaaattataataattatcatcatcaaatatttatcaaatggttatgatataccagtcacagaaagtggtcttacacattctggctgggcacggtggctcacaactgtaatcccagcactatgggaggccaaggtgggcggatcacctgaggtcaggagttcgataacagcctagccaacatggtgaaaccctgtctctactaaaactacaaaaatcagctgggcgtgatggtgcatgcctgtaatcccagctactcgggaggccaaggcatgagaattgcttgaactcaggagatggaggttgcagtgagccgagatcatgccactgcactccagcctgggcgacacagtgagactgtgtctcaaaaaaataaaataaaataaagtagtcttatatattcattaactcttttccttaattttggaaatccataaagctgatattttatccccatttttcaaatgagaaagctcagatgggcaaatagctcagattctattcctaaatcacactagacatgaggtaggactccttcccagggctacctgactccaaagtgtgtggtccttcctctttcttatgtgatatggtctcaaggacacattgaaagttgacatttagaacacctacttcatcttctttcaaaaagaaagcattagtaggcaaaattgtaaaatgtatccatcattttatcaatcataaaagcattacatatttattacagaaattttgaaaagtttagaatactatgaaatagatatacatcagccattaccctagccactagaaatatccattttaattattttatatattttcaaaatttctttttatacaaacacatacacttctaaatggtttcctactacattatatggtaagtcagacttcaaatttaacatgccatttagagttgtataatattatttcaaagtctacatagaatatttgtatggctgtagtacaataacacttaagcagataccttgagtgcttctaagtttttacaattataaataattttgtaaccaaattctttttttttttttttttgagttttgctcttgttacccaggctggagtgcaatggtgtgatctcagctcactgcaacctctgcctcctgggttcaagcgattctcctgcctcagcctcctgagtagctgggattaccggtgtccaccaccacgcctggctaattttttgtatttttagtagagatggggtttcaccaggttggtcaggctggtttcaaacttctgacctcaggttatccaaccccttcagcttcccaaagtgctgggattacaggcgtgagccaccgtaccccgcctaattttgtaataaaattctgacgcagtctttcagtcttttattatttccttaaaataaaatgactgggttaaagggtaaaattattttagaattgctgatatgtatagacagactgttctccagaaagaatacaactaagtcaatgtcaacttagctaaagccctatcggaaaataaaaacatcgatatactttcctcacttaaccattaggcaccttactaattttcaggttatatttggcactgaactgaacaatacaaaaatactttgagcagtatgtcactcaccttctaactttcaatgatatatgatccaagataaaatcattcaatctatgattcccacactcaagaaatgtttgcttgcccatcattttcaaaaagaaaaataataaggatgggtgctaaaagtacaaatttggctgggcgcagtggctcatgcctgtaatcccaacccttagggaggcagaggtgggcggatcacctgaggagtttgagaccagcctggccaacatggtgaacccttgtctctactaataatacaaaaatagccgggcgtggtagcacatgcctgtaatcccaggtcctcgggaagctgaggtatgagaatctcttgaactcaggaggcggaggttgcagtgagccgagatcgcaccattgcactccagcctgggctgcagagagaatccgtctcaaaaaaaaaaaagaaaaaaataaaataataaataaataataaaagtaaaaattttagactttgcatgtgttcctgagtggatttgtgtttgtgtgtgtgtgtgtgtgtgtgtgtgtgtgtgtgtttgcgcgtgcgtgcgctcatgagtgtgtctgtgtgtgttggggaaggttgaggtgtagtgatgtggagtattctcgggagtttcctaaagtcatgaaatctatgaacatgacaagcatgctgggtataaaggcatctccagcaacatagtggcagccaaagttttttataggaaaaataatctgcttcccaaaaagtagaaattaatttcaaagcaacattttataattctacactttattaaattaatacttataccttggaaatagataatcaagttctgaaccatgtagcactgaaacactagtgagagctgatgatgacagaggagggcctttgccttctgtgacaacaaaagcaggaacaaagagaagcagacaaaagagtgagtgattcagtcacactgatggctctaaacggagaaaagcctaaacaacactcttaggaaggaaatgaggatgagctttcttggcccaaaaacctggtctggctccttgaaagttcttgaaccaagttctagtttctgaaaagctcatggcatatttagggtttggttatttttctgagactatttgtaaggttctctctgggtttctttgagacctagattatgttaaatctccattacttgacacaatccgagtaagtctatgattgttttttttgttataaaaataaactaatacagcaaaatgatttctgagggttctgaagtatcagacttttccacatcatgtgatattagatcattaggaagactggacaaataaacaaagaaagaaacaaaagaacagccactgagaatgaaaaagagaaaaacattgatcctgtttcataatggggttgctgtctccctagaaagacaaaagtcgcttgaaagaatccttttcaagttaaaatcatgagtgtattaatattatgtcacatttcctagtctctacctatctgagctcctgagaaccatatagagatttgacagcagaaacaaaaaattacaggaccataaatctttctgttatctgtgagcaggaaacaggctctatgaaaggatgacaagaggccctgatcccacttgaaattaagacagtaattaagcaccaaaataaaggtaacaattgagaagaaaatgtcctctagtggaaaattctcattaattcaatttgtattgatataaataatgttcctcaactttcttttgaatgatatatagtcttttaatggccaggttgtcagtggaaggaaaactaatactttattcgttgaagaggttcaaataagcaaggatcatcctccatggttgaaaatgaaaaaaaatcaatattgatgtgtttaagacactcttttccacagttgttgaaataactttgaatgtctcataaaagacaaatattttattctaggaaaaaattctaagaccttttactacaaataatctgaaaaatattaagcctaggtaccactatctgcctactgaacctccctgaaataaaaaaaaagtacatgttgaaaatgaaaatttattattagaataaagctactgttaatcagaatgcagctaatcagaatttttagttaatttaagaaattagtttgttccagtacaaaaaagctgggtacacagtcacacagagacacacacatccagacatcacctcccacacacaaaaagatatggctggtatattgattaatggatgactattaatatataactaaatatttatatgtatcactaaataatatacaaaatgaatcaaagtactttgtcttatgatatgatcaaggacataataaatatgagcgagtgagcaaaattaaaaaacaactcaagatgctaccagattaccaaataagtggtgtcaatacctggtttttatactggacttgaaacacatcaaaaatagtgtgctaatattagcaaaatttctaaaggaaatgattgtcttttttttaaaaaaaaaacaaacgcacttaagacttttagaaaatcagtcaatcagctggcctcccaaatatttaggaaaataaatttaaagtgaagacatgaatgctaggaaatataagaaagaaaatttaaaaggaaaaaataagaaattttaaaaaatgaaataaattagtattacagctagcctgcttaaaattgcataccgaaatgtttgatataaagactaagtttttggtcatgtatgacttggtgaaagtttaatgcctttaatataaacagcaaacactattccatgtgaagacgtgaactaaaacacatcctgtgtcaaccacatattgggttgtctctttcttagtcttccacatctaaacccgaaaacaataatgtaataccctatagcatctttttttatccaatagaactttatccatataccaaactgtacacaggaaactgggcttcgtaaaatactttatgtaggacaagaaggaaagtagaccacaactcagttatatagcagtttcacctaattgggcagtccttctttgggtgttctaagcaacatcttgctgtatacaaacaaaactacaatcttgattatgttcttaactggttgatcttccttgttcaaaagataaagtagataatttgtaagatctctaaaaaccatagtattttagaagtgtaaggttgatcttccctgttcaaaagagaatgggttaaagtggatagtttataaagtctctaaaaatcatagtattttagaagtgtaaggatccactatttgaggaagggtaaccagttattagcatcattaactccattttatacttgacccaatatattgaagacagttgcctacaatggcacaactatcacatttcttcaaatataagacgtacacagctttaaaacaaagaaacaaaactgccacttgaggagtggagaagactcgttacagagccagtgctgcctgtgcctttggaagtaagccttgcacagagggttcattcaatcatcaacgcagttaattttcctggcagaaccacagttatatcttaacttaaaattgtaatggaaatgtacattcccgttaagatttcttcaaaaacttccattaggagacgactttgcaataaaaggtgactgcatatggagaagacagcatgccacatgccagggaaaacaaaggccatagaaagtgtcagatccttcagagtaggtctgcgaattctcagagactgttttgtgattgatctatgtgtcacaaaagactctcacttagacacagagcatctacttgtcaaaagcattttgctgctataccagaaaagctatttaacttaatttttagaaatatatcattaaatcaaagaaagacaaatgaaagtaaaaattttaccaactaggaaatgaagaggaaaccctgaaattgttcaatacaacattacttttaaagcagttgaaaaggtaaagatttataatttaggagactcaaaaacagattggctccgtaaacctttaaaaataatgtataaggtttgctagattatattcttggagaatttttagatacttgatgttgctacagaaaataaaaatagtagccatgtaatgaatgccataatcagctaaagaaacacccagtacctccccaccagtacctcccttctactgatgctattattaaattgatggtgagttttacataaaatagtaatttaggattagagaaaacagtacttgatgataaagctggaactagaaattcagggcttcaaatttcacatccagtgaactgctaaagacttttataactactctgtatttacaaagaatcttatatacatatctcacacttctgatgagacatattgtaagaaactattgctattttttaacaaacttttgatatttgcttagttgtatttattactattctgatacatagaactagaattggagaaattatctctttctatgtttctggaaaggcttgtaccatctcagaatagtttgttatctaaaataataacaaaaaaaaaacagggactccatagttcaacataaaaatgaaagttagtggttttcaaatattacatctctctataatagctatcattaccttttgatttccctttgtcatttgtgtaatatatatctccagtcctatagccttcaatatgatagcaactagccatatgtggctgtataaatttaaataattgaaagtaaaaatttaattctagctgaggcaggagaatcgcttgatcctgggaggcggaggttgcagtgagctgagatcaccccactgcactccagcctgggcgagagtgagagactctgtttgaaaaaaaaaaaaaaaaaaaaaaaaattagttcctcagttgtgctagctgcactttcagtccctagtagtcacatgtggctagaggctattgtattggatagatatagattgtttccatcatcacagatagttagttctatggtactcttttatgacataagaaccaatgtttttggtcacaggtaacttggtaagagaagtttgacacctttagtagcagtaaacagtgccacagtttcgttaaacaaatctgttcaaggattcttggatgctatttaaaatgaatgttaaggaaaatgaccagcctcaggttgtaatcagtagatgtagatacatgtatgctaaatttgtaaggtgagctagtcatagaattgtatagctgtaaagaccctaggaggtaccataattcaactcgtcttattttatggttgtggaaactgaggtgcagagaggctaagtgttctttgtaatgtcacaggggattttgtgacaataatcatcagcattggtagtgacacacattctcaaatgttgaaataaagaaaacaaaattaattcttgcactgaaaccatgcagtgttcccatctgagcagatcaagcctggcttatatgcctcaaagagaccaaattcaaagttctagtctgagattggttgatgtattattttcatttggttgttcttactattcccatgtttgcctgattcaactaggaatatcctgtaaatgtgccataaaatacttgacttagctttagcaaaacatttgacttttgtgaggtttcaatttagctacacctgtggctggttgagggctgagcatctacagagtacaagattgttaaatctagtaagttccagcctaggcattccttcttcatttttcctcatttggcttgctactgaggtgtcaggaaattgtacactcaagtctcaccttgacatttagtagcattgtcacctggcacaagatgcgacatatccattgcaacctgcccacccacccccatttctgtggtaagttgctctgcccttgcttctgcaggagtagtgttcatgtccgctgcttctccaccttctctaaccaggacgaaagtggtttgcatgcaggtagatgcttgatccacagacagctgatccataagtgggcctttaacatagggcatacatggcctggttcacaagaatgagccaggtaaacagtattttgaaatttgcaactaagatgttgtagggaccaatttcccctttgtcttttgaagggtcactgaaaatcaaatgacaaaaggcatattaataggagaaaagacatataagtttgataatgtgaatgggaagaaaaatcacagagtgattatcccaccacacaatggggtataaatggctatatattcttcttcttagggaaaggagatgaagaagtgaagatcatttaaaggggttagcaaatgatttttaggagcattcaatagcaatggacttgaagaacatacagtggcctgggataaaatctattgggcctgcagagcagacaactgtttgtgacaaaagtctgtcaggtgtgttgacagacttcagtctttcttcctgcgatttgagtttggttaatgaaaactcagaggaggaacccagagtaattgtggggttttttgttgtttgttttgttttgttttgtttttggtaggttcagactttacacagataagggaacttcggagaacagcttcattcagtgctttaggagagacagaggattgagagacaggaggtggggaagatcagagagaacttgcgaaaattctgaaaattttgaatgaggcccagttccagtttgtcagaagtttggctttctgacgactttctattgagcttgcatgagcactaggtctctttaatatatttttgtctttttagttaaataacttattttctgtaatttgcaaattaaacatacatactgaaacaagagctagtagtgacagtcttaatagtttactgccacggttgaaggataaaataaagatatcatcccccagaaatctgtcaattcttcttaaggtcttcagttatatttggaaagaatgaagctaaataaaacacattttcctaaaattattggaaacaaaaaaatagagttaagataaatatttgagttttctgaaatgctcaatttgtcttctacaatttccaccacacatttaaaaaaatgctcagagaacatgagcctgtggaaagaacaattgtctaagtaccaggaaacctgggtgttagatccacttctgtagtagaaatgactagtgctcacccatatctggttctcctctactttctggacacatgaaatatacatttcttggacccttaataaggaccctattacacttctggctggtagactgtgagcagaacttatacatgtcatttttgagctgcagctataactggcctggcaacccattcacattctccacctatcacagtgattctgaaaggtacaggtagagatgatgaagctgcaagatggagaatgcaaagctgtataaagtcatgtcttggaaaagagctgccctagaaaactacccaaattgcagcagactttgcattaacaagaaacacttttgagggctaagcccctgtgtattacagtttatacgttacacagcataacctatcccaccctgacgaggtagacttccagtgcctagataaagaagtcactgcttttccctatgctctgacttcttcaagcatctaaatgaagaaattggacttcattgcctccagtgactcttttagggtgtgcattcattctatcattcttctctgatgcctgccctacttactttgcagatttgctgagagggtgctttgaaacacccattgcatgggccttcccattgcatccttataaacaaaagattttgtcaaagttgaccgcttccaaaagagatcttgctatttctgaattaagcatttggagtgacgtcaattttaatttttaatttggctatgtgcaaatctttatcctttttggtgggaaaatttgaatagacttttctctttgttttgccagtattcaaaagcacaattttgagagtgcaaagaagcataactgacttagcaagtctgttagctctgctctcattcttcttgacctgcttctcttcatcacccaattgtgaatcttacctcttggtccttagctactatcctgattctacagatcagccctgcccaaaagtgcctgctgatagtcactgccatgacttgtaggcatgcttctgtaataatgtacacatatggtcttgacaggaaagaatctgctagatccttcacactcagtatcacatgattccagatacagactaaagatcaaaatattaccttggaaatcacaggttagaaaataatagctggttggtgagaatatttaatggtttgcatccagacaacttgagactctagttctgaatctgccacttcctatctgggcgacttttggcaagttacttaattctgtaaacttcagctctcttctttgtagtatgagttaacagcaagtacattatagtgtagttgagaaaataaaataagacagcttatgtaaaggacccagaataatgcttagctccataactagctacaaatgccagttttttcatttatcttatatgagggaggtaagggaagattatagatgttactgaccaaagggaaaggcctggatagagggaattataggagtaaagctatcataaagaccctgaatacggagaggagaaaccaagaagaaaatgtataattctcttctaaataaaaatggtaattcttataaattatctatttataattttgccctagactagcactacactatttttgtcaagaatgatgattaaaatttcttccattggcctcatgctttttacagatttttcccagttgagtttcaggtagagaagatctgaagaatagagatggaaaatatcattctttttttaaagaggagttctagagaatctaaagtttttttttgattgttcaatagttagtatccaaaccattagaaaaactcagatcttaaaacagctaaccagtcgggcgcggtggctcacgcctgtaatcccagcactttgggaggccgaggcgggtggatcatgagatcaggagtttgagaccatcctggctaacacggcgaaaccccgtctctactaaaaatacaaaaaattagccgggcgtggtggcgggagcctgtagtcccagctgctcaggaggctgaggcaggagaatggcatgaacctgggaggtggagcttgcagtgagcagagattgagccaccgcactccagcctgggagacagagctaggctctgtctcaaaaaaaaaaaaaaaaaaaaaaaaagcaactagccaatagactattcccacctgtaaagccttctttttactaggtatggtggtgtgttggtcatcaagtacacagattaacaagacaattcctgccctcaaggggatgaaaactgggtaagaaaaaaaaatttttttcagtccagcttgttaaataccatattggagaaaagcaaagttgtcagtggaactcagacatggggcacttaagctatcaaggatggaagtgctccgtgcacattcatgagatggaggtgggaagtcagacaagttctggcagggacattccctagctctgtccaactagtttagtattagctggcttctcacatttgggtgaggtttatggtcatcgaacttcctagcctccattaggaaaggtatgaacaatcagtctgtgcttctaagcttgattcctttggattttaagtgttttctgtttcatgagaactttgttaaaatgcaaattcctcataaatgtttagccttatcagtcagcaccatattgggaatgaataagcactgtgggatgtctaaaggaagggagttaagagacaggctccagcaaggagatgatggtaattggaaagatgtacaacagttccaaagacaaactatattaacttctctttgtggaccaaggttaggcaagacttctgtcgaccagttcttggaatctttggctcacttcaaccgtaacttctctataataaaaagtaagaaaagtaaagagttcattggctcagagcaagttaatcagaaaggattaaagcacatcaatctattttcatgtttgatagtagccctcattgaggcttgtgggacaatgatcaggtccttattgagcccagcagagaaggaggacccaatcttgctttatttctccccctaccctctttagtgctattttttttctaaaattgccctttcctttgttcagttcttcatcttctttgacaaggaattcaaaaactctcagaaattttaataaataatttacagtaaatatttatgacttaatatgtcatatctaaataaataaattgttaatgactaaatcaacacaacaataatgttagtaattgaatgttggaagtcacagacttcagcccataggtaaatctcccctctgcacacccatataaaaggataggcccaacaaaagtaatgaaactgggcattataatgggatcttggccatgagacacgaggaaaagaaaatatattttttaaatgggttgatggatgtttctatttataccaagtcactgatgttggaaagccaaatgagaaaagagaagaaagtttttatctaagaaatgtgagcccctttaaattatcaggcccagagaggctttaaaatgtgacaacagtcacatcttacttcccctctatgctaaacgattacctcttgaagccacttgctccataggctctagattaactgatgccaagtagccataaaatgccacacactggacaccataacttataacctatagttcaataacgtataatcaatcactaatcaatgttatcgctgtattgtccaacagaccgccaggatggctaaatagtataaaggagagctttattggcaatatcagtttgcaaaccaggaagagacagtctctggcatgtacctaaagtgctttctcttcaaagaggtaaaaggcaggttgatttttatacctcacagtctgtattacacaatagactcatacatactcagccggtttggggggtatgaggagagtcaagcacatgcacaaggggtaaacatatatgtaacatacttcccatgttcactttgaggtagagttttagcattaaaacaagctggaatttggctctttacatcaaaggtgaactttaaggcacaaagacagtttgtgtgcagcctctgaaagctgactgaagctggattaaagtctggagttgcttaagaggaaagaatgtttgaaggccactcccctgtccaatcagagttgtagtgatctgggttataaataagaggtagaaagggagtaacaatttgcttgatagctcctattgttaggaagtttagcaagagtgtggggtttttttgtttgaagctgtaagaatttaggaagttgctatgccagctgagctctgaattctgcgcccatagataatatttattttcttaaccttggggtctgtcttagttgataaaggagcatctattttggtttctcagatcacatctgtaaaccaacaaaaattcctgtcaaacaacttcgtatcagcccactctttttttcccttttccctttgaaaacctgcttgtaacaagccaaatgcagcacttcccagggcaacttggaaatgtgtcccagccattgtcctcactttggctaaagtaaactcttccattaaaattatatctgatgcctcagcttctttctttaggtggacataagtcatttcgaactcctctctatccaccgcactacgcatattcacattttttccatgtttttccaattttgagtctgatatgcttcttgaatcagtttttcaccactttccatcacctaccacctctgctctgcatcaaattgtcttctgctcaaatcagtagactatttccttacatgaccttcttacctttagccttggctcccttagatccatcttccccaaagtttccaggtttcaaaggcaacatccgatgatgcaaattctctttcaatagctccacatcttctttggatgatgctcagagcttctctccagtgcatctgaagcttttcatataacgatgatgaagacggctgatttttactgagcattactatgttccagatacattggatcagatcttttcatggacattacttactctctcaaaatagtcccctagaatagatgtgattatcctccttatgtctcttttacagaagaagaaaccactttcagagtttatttgccaggctaggaagtattggagaagagatttggtccaatgccagtcattaagtcttcccctgaatatgtgctcacaactagtatattacacttccctgcatctcctaaaccgaaatgacaaaccaaaacattttagagacccaatgtgtaagaataattgaatggaagtgatttcagcaaaagttcttctataggctgggtgcagtggctcaagcctgtaatcccagcactttgggaggccgaggcgggcagatcacgaggtcaggagatcgagaccatcctggctaacatggtgaaaccccgtctctactaaaaatacaaaaaaaaatttagctgggcatagtggtgggcgcctgtagtcccagctactctggaggctgaggcaggagaatggcgtgaacccgggaggcggagcttgcagtgagccgagattgcaccactgcactccagcctgggaaacagagcgagactacgtctaaaaaaaaaaaaaaaaaaagttcttccataattcagttgggaagagctaaactagccagccatatggttcagatgaaccagtgatctcctcaaattgatgtccagtgcctcactccccaaggtaaatagcaatgaggaatggttctactgacctccttaacttgtcataaaattcacacttttattcgttgtggaatgacacttttaatatttcttttgtagaagaaatccaggtttccaaaaagccactgacaaacatttcaagttaggcctggtggcactgcacttaaatcagtagttgaatttaatcatattcatttttgcactgaaatatttgtttctgtaactattgaaaaatttcactttgctgtttttttctctaaatgatcttttatttcaattatggaaaaatagaaaataaagcttctgaaacctatatctgtcagaaataatcatggaaatcattgggcatgtcaatagccatgttttaacatcaactgaatgccctttaagcaggccacctgtagtttgaattgtgcaggaaaaagaaaattgcaaggataagctcattttttcctgggaatatttcatagaaagttgtgctcaaagatcaaagtatgattagaatttttaatattaagctctgggaatggaaattctctttttatcatacataaatatagtttgaattatgcatagtctatcttcatgcatgctttcagaaggacatttctcagagagaggaagatgcacatggctttctaggttttccacctggaaaaggaagaaattcaaatgtttggatcccaattttcccagcatcatccttttcatgtccttaaaatctcactcagagaagctatttctttttcactcctgatagcaacagcgtgctgttggcctggagcttgatttgctgtagaggcagtaggctggggcttctctggggaacactgattaagcaggaattctgggagcaggcgatggctggcagagtggtggaagtgagcctgtgagggcagcagcagcacacagaagctcagtgtgcttctggtgacaaggtcttcagagactcttcctcgaggctggtttgcagctgggaacatcaatctctctcctgaccaggggcttattaacattctgagtatcactttcaattaaatttctccaatgctcatttagtttctagttaataaggcaggactggatgtcatgtatgatccagcaggttgtttttaaaggataaaaataaaaggagccctgggataagttaaagcgtgaggcactgttcctgggccaacatgttgcccaaaccactggcctccattggctttgcaggtggtctcagggcatgttttttaatgtacttttccctaatggaggatttcaatcagatattcactcttaggaaaaccaacacattgttccccgatggctgcacaaattcaaccagcttttttagttcaaattattgtgtgttttgtgtagtaaagaactcctataaacaaagaatggaagtagtttctaggaggtaccacaaatagaattcgccagcctctgaacagcttttttgaggtgataacgctaataatgaaaataatagcagtgagagtcactacttattcagtgtctattatctgtctatcactgcggtcagcacatcacttaaaaaccctcatttaattattacaacaatgctaagaggattaatgtccaattttggatggggaaactgagatacagagcttaatatccccatgatcaaagggctcatttgtgctaatagagaagtggtaactgtgtaaataataatcagtgtttcatcttcaggcttttccttcttctcttttccatctacttgaaagacttagaacagtgtagaatagtctcagcttcaaaacaggtctccacagacttcttggcgaacagaccactaaggtagaagggtgataaagtgggaggcaggcagggagaaggaacatagccccctttcctatgggaggagccaggaggagaagatgcatacaatcagcactttctgctctaggtcaagatgccctgcttattcttctaacctgggacagcagagacttgtcaagggctccaagattttggagttaaaccctaatctgggccctactatgcccttttctagttatgtgaccctgggaaactgacattattctgagcctcgggtgtttgtaaaggcatgactctcccaccctctggttaaaaaccttaatcctaggtgacaggagtaggtacatgaaccaggattggtcattcatagtgtctgtcccattctcttggacacataaatgactcagaaatggacttttgacttctgcaagccaggtctgtccagagaagcggactgcatttggagagggttcactagataagtaagattttcaaccagcctttgaccctactctacagggtaaaattacagaatttgattagattacattctctctacgtccaatgagctctaatcgtctattattccatctgaaggaaaatacacatacagtgtctcattccgtatagttggattatataaaattacacgtatgggggtggtgcttgaggcaaaatctgttaggtagtaatgaataactaaaacaaagaaatgctttaaaaggagttttgcaaaatggctctctgcactagagtttggaggtctcttttgaaataatgtttgaaaaccaacccactcacaagaaactttgtaatttttggtgtttttctttggcatgtgattccagacccataatgggagggaggtttaacggagacagggtttataaaatgctgagcggctgtgattagagcacaacggctttgtatagaaatgtgctaacaagaaacaataagtggcatttgaaataagaggcccaagggagaataggaattcatgaagaaaagaatgttaaaataaatacttgctgagtacctaatgcattcaaccaaaagcaaaacttttaatacacatttccagttgaaaatcagaaggtggcagcactgcttactgaatagtttcagatgaagcctccagggaaacctggagacagaataagccattttgtaggttataagcgcagctaatttatagctaaaaatgaaatgactatggctcatatgcacccctgaaacctctgagcctcttcggggatttggcatattgactctgtcatgggtgggtttcacctccaaggatgcagtgaactcagaaacatgccaaaatgaagagcaaggccctggccaaatttctttccatctgaaatgaaaaaggaaaagcccaaagtttggtccccacaactgaaacatcaaagtcccctgggaatttgtcagcaatactagttttccagcctcccctcagatctactgaatcagaagttttgagagtgaggtccagaaatgtggattttctaaactttccagctgattccagtgctggcttacatctgagaaccataaggagaggtatagagactattgttgtgatctgtgtttcaaaatgtggaacacgtcctcaaacaatatcttgctatggatatgtggactaacttcgtggtcctatttatagcctcagtcatattgaacagaaagagtgggcaaaaacagacgacttgcaagaaagtaattccttaaaaatggaccagaacaggcagtaattgatgaaagcacaaactagaggttttccccacaacatattgaatttctgcctacttgtcaatagctcagaaatcttcagaaaaataacttgttttgctgtgtgtcgttctatcagacaaatttacaagttattaaagagaaataaaactttgaaaattatttttaagcattctctgaataaatgcataataaaaatattatttgttcttactgtccaaacagaaaaaaaaaatgctggaggtgagaagtcaattacacttaaaaagcataaagactcttagaagtaattttgccactttaataggcattgactaaagcctagtccagaataattcatgcctgttttattaattaactttgtggttatacagtggagagtagataatagggccatcatgtccattaaatgaaagaacaagaccacagagggcaagaccacagacaaaccacccaaagtggtggctggctattctcagaggccttcaggagggacagtactttggtgtggtcatgaatttccaaggttttattttaatttggcagatttataaagttcatttttgcctggcatgcagagttgatcagttttgcagagatagtctttgtaaagaaacccacaatagagtcatatcaatattatctaccatgggttttgttttttgtttttttgtttggttcgttgtttgtttgtttgtttgtctgagacagtcttgctctgtcatccaggctggagtgcagtggcaggatcttggctcactgcaacctccacctcctggattcaagcgattctcctgcctccgcctcccgagtagctgggactaccgacatgcaccaccaggcctggctaatttttgtatttttaatagagacagggtttcaccctgttaggctggtcttgagctcctgatctcaggcaatccaactgccttggcctcacaaagtgctgggattacaggcctgagcaactgcacctggtccagcttttttttttcttttttttttttttaaacttgctgtgagccacggaagagccagccagaaagtctgctagctgatccacacatagccttggcaaatctaaatggagggtcaaatctggattgggaatggatgtgaagaacacaatatcgggtcacaaaaaaattatctggggcatcttaatacactaattcattcatctccactgtggatagagacctgtctctctatttgggtttggaattcacagcctcgttactcctggacggtatgtactcagcttctctgactgatttgtccatgctctgtgccaaacctcccctctcacttgaggcttttttttttttgaagtatgttaatatcatttattgagatttagttatatgtcattaaatttccaagaatgcctggtcatgggcaatattttgtctttattgtccttgattaacagcactgtacttctactcctgctaataatagtgtcatatttttcttttaatttggtttcaaggtctctctcaggagagcagctgtaaactctagccctgccctgacagtgctcttggggaggtggttgtgggtgtttacagtgtaccttccgtgggatacttctttgttctggtggaaaacctgatgcctaagtgtccaacgtgtgaccagatatccctctcacaggaaacttacttacactggcagatgcttaaggtcttgtgtgacctatgtccaatttattcctacaaagatagccattctgtaggagaactgactgggaaataggttcaggtgtgttggtcataggaggtggcacaacaaaacacatgaaatagcagaagcagtatattactcacaggtcccagagaagaggagcaccaatgagcaccaatgagaaggttgtggggacaccatgcgcagccaacaggttgggatttctaattggtggacttagagcaagcagacaagggtcacatgcattcatgttataacttaggagtgatcactacagcctctgagcacattccatgtggagtatgggactcagtaggatgagcctggtcaattgttatctatttttcccatatgaaagtggatactaggaggtgattttatagggaagatatcacgtctggatggaatacaagaagaaactgggaggaggaagacagctggaaactgggtcaaaggtgactaagctctgcttctggtgtgacagttaatgctatatgtactaaaaatgaatgccgaggcaacataaaattacaagtattccctatacatagctatcatgagagctcctaggtgccagagcctgggaatattagactgcttagttctagacctcctgaagtttacattgcagttaagaaaacaggaaactggacacacgactacaatttagtcatatggagcatgcaaagaggggagaagttgtggatgccagcgcataagagggagagtggtccttaattttgaggtcagagaaagcttcctctggcaggtgctaaactccaaacattagcagaaaacaagagcttttacagaccaaatgagttcacatggctttggcacacactgtgtggggattgggggagagagtaaaatggggaaagatcatgctagagacataagcttgtgtgagatcaagaaggatttaaattaagttgccgaagagtattttatgttggtggtaattgtgagacaagtaatagttttgagcagaaaagtgactacacgtaatttgcattttagaaaactcattcttatggagaaattatactatggattgaaaaagggtaatgtttgagggaggaatgccttgggttttcttgttttatttgtttttcaatatagatggctaataatggccgatagtatactcttactatatgccaagcattttacttgcatgttctcatttaatttttataatgatgctgtaacatagattgcactaggaattatcctaatggcacagagaagaaaagaaatagcaataggaagtttatgtaactcccccaaggtcacaaaactggtatgagttagagctgagatagaaactctatctgacgtcagagtctatgctctatttcactgcacccactgctgccttcaagctagagagaagataagctgaattagggagctgcatccagaaagtaaagaagaggacacattgggagctattgcagagcgagaaagggcaggtcttgacgactgcttggaggtaggtggtgcgagaagggagctggtaagaagaagtcttaagtttggctcaagatcattactaattttgctcccaacttcagtaacttcctctatatccttggacagtcttttcacttatttcctggtcccatctcttttgcttcacagtagcaatccaaaaattcctgctttcttctgcagacaccatgctactccatccctcctcagcatcaatggatgattacaccttctgattgttttggatctttggctgggaatggtggtgatgttcttctttgtgccaggtctaaattaaagaattggctctttatcacaacatttagaacatactatgaaaagaaagaaatcaatgaaaaacaggacctctttatttcctactcataataatatcaagtaagaacatctatttccagaagtagtttttcagccttttgctagagagagtttgttcttttgtttaaaatgcctgagctgataaggttcccagcctcaggagggacagatagagaggagaaaagttattttcccagaaatggcaggatgcattctgaccccttcctttatgttttagatgactgatagtgacaacatctaatagcaacttttattttctcatttagggccagtaaggctagcttttgctgttttcaaatgtaattattatagagtattgaatataacgatccagagaaagatccagatgtttctattttcttccgtagaaataactcatctattagatataatagacagtgccttgtggtacagcagtttaggaatatcattttactaagctcatctcttcctagatgcaggaaagtgaggactaagctctgatttttttatttgcccaaatttctatctaaggggtctagggactaatgacctacaaaccataaattctcatcagataggttttatttaaccctatatatcatggcttactttccaatctgaccctggcataacactatgagacaaggaagaaaataaaaatatttaactccaaaatagatttccttgccataccttgaaattggcctgcaaagtcttttatgggaaaaacccacattctatagagaattcccttttgttttccttccttccttcccagatccaagagataatcaactaagagtcaggcacccttttaggtcccataagaaatattttgcaacctgctctctctctctctgaagtctgctacctgagagctccctctgcacaataaaacttggtctccacaacctttatcttgacctgaacattcctttctatcaatcacaggtctttaaacaaactcaaccaattgtccaccagaatatgtttaaatttacctatagcctggaaacccccactttgagaagtcccgcctttctgaacaaaaccaatgtatttcttaagtgtatttgattgatgtttcatgcctccctgaaatatataaaaccaaactgtgctctgaccaccttggacacatgttcttaggactcccctagggctgtgtcacaggccatggtcactcatatttggctcagaataaatttctaaaaatattttacagagtttgactctttttgtcggcaaaagattatcacagaaaagtgtctgaaatggtctcttaaaatagtctgtctctcagttctagttgttatttgcaacagatggaaatactagtctttgtggcatggttcaagtatgagtttgctagaactgccatagaaaactaccacagactagatgagttaaataacagaaatttattttctcaaagttctggatgttggaagtccaagaccaaggtgttggcaggtctggtttcttctgaggcctctctccttagctcatagctggccaccttctccctcatgttctcacatgcccttttctctgtatgtattcctgatatctcttcctttcttatatgggtaccgatcagattgcattagggcccaccttaatgatctcattaacctcatcacctttctgaaagccctatctccaaatacagtcaaattctaaagcactagggcttaggatttcaacatacgaattttagggagacacaattcaaagcacataattgtatttactttgctgttatccaaaagcaatagcaacagtgagaaaaagcagaaaaagagctctggcctagaaaaaatatagaagtattacaagaacaccacccagtctgataacatttccaagctttggcaccagcgaatttttactgcttgcaaaaaggcaggcgtgaatttcttctgttggggtagccctattttggtttccctaaaaaaagcaagagtttcaaagtttcaagactctagaaaatgtaaaaatctttcagatggtttttactgccattctttctctgtttcaagagctaataaacacactgttattatcatattagttttatccttccacttatgagattttctttcttttccttttttctaatgaccaagcaaatcccctttctatgagcataatgaaggattttgcttacaatcaggcgtcaccctcaaagaggtgaaatatcttggctctttgataatctttcatgatcacttccaagaggaactttgcaggcatttgagttgccagacgtaaaatttggctttctgaaaaagaagcacatgtaactagctcataagctgcagtttgttaattatttttttctaaataaagaaaaaatatcattgaccagagtgatgagtaggagactttaggactctaaagagggattttctcaatgttcactctcacttcaaccctccccctacgcagaaacttctctacatctacttgtatatttgtttcttcactactaccatctaagtatagtagaaactactactaagaagctactaagctacacttagcttctactatacttagatgctagtagtgaagaaataaatatacaagtagatctagagaagtttctgtgtagggggaggattgaagtgaaaatgagccttggaagaagcatctaagtcatttccaactcttcttccactactgtgaggaatccatgtcctcctttctctgggcctttgcatttccaactatcccctctctaagtaatgccatgctcctccctccactgctttcctcttctttaactctgtgcgtgctcatgcctcctcccagatatatgatattatgatacatctacctacattcgagttcaattctgagtttctcaagtgcaaagatatgtcatatctttgtgtttccactgcctagcatgattcctcgcttattgttatttcttgataagcatctgatgaatgaaggaatgaatggatggatttacatgcatacagggcaaaacaacagaagttgattagtcaagtaaacatattttaatgatggcaataattgtttattgtttagaaaaataaaataaaacattcaatttcataaaagacagaatctataaaatcagaaaaatttatagttaattatctggatagtaaattttctgaaaataggcaatgttgataatttaggtaaagcttactgtctccttcatttttctgaaacagaaatagaggtttgaatgattttcaaagatgatccaactttcctcttgctcttggctatgttctatacagtgcaaattgagaagataaaacctaaacatttcattgtagtttgtctgtgttcatgatcacctggatgttttgcatggtatagatgtactcaggccttaagagactctctcagaatattcaggattctacttagtaaccctaggcttgctagctatttagtgggttagttttttaactgctaaatattttctgagcccttactaaatgtacagtaattgtgtcaagtattaggaagaacatagaaacatgtataaatgtaccttctgtaattgttgccatctacggtattatccaagacaatagacactaaattaaaacgaaatagtagagaggaaatgcttatgatctttaggaattgttgctaattgaaaaaacaaacaaaagaaattcttaacgttggcatgtttagtggtaattaggacctgtttttattgcatgctggatattagttgttatgtgcttattctcagctcattggaatacaagcagacacatctccaaaaagcagaataatctcaggaagacgttgccctctcctgagctaggtagaaggtcttgagctgtagcctgaactggtgtctgattgaagaatgcgtgcaggtgcctcctccatcagtctggtcccagaagacatcttgcagtttactacaagtttttaagaaagatgcagcggtctgtgaaaaggctaacatttctgcaggagagagaaatctgcctgacagataaacatccctccagcctttcctaagccctatttgtaaagaaagcttgatggaaagggaattctgtacaacttcaaggaaaaacagtggagagattgaatcaataggaagcatcctccttactcccatttcaggaaatccagagatcagtgtgctcttatttcaaaaggctgtcatccaacagagtcacatggtgatctgaaatcaccaaagccccagaggatggcacagggcaatgcaaaaagcatgaggctgagagtcaagtgacatgggttctgttctcagttctgtcaaggtttagctacatgaccttgggcaagccacataagcctgcttcctcagctataggacccagattgttttacctttgtctggcaaagcttttacgagaatggaatgaggtataatatgtaagtggacctgtattattcaattcttacattgctatgaagaactacctgagactgggtgatttgtaaagaaaagaggtttaatgcgttcacggttctgcaggttgtagaggaagtatggctgggaagccttaggaaacttacaatcatgacggaaggtgaaggggaagcaggcatagtcttcacatggccagagcaggagagataaaaagagaagaggggagtgctacacactttgaaacaaccagatctcatgagaattcactatcacaagaacagcaaaaaggaagtctgctcctgtgattcaatcacctcccaccaggcccctctttcaacacatggggattacagttggacctgagatttgagtgggaacatggagccaaatcatatcagtactcaactcagtgcttggcatatggtaagaacaaaaccacaaccatagctagaggcctttctcgggcatgagcaggctgtctggttggaggatttcagggagcctgagtgcactttacccattattccttctctcactgctatgggacaccttccagatacatagcttctcagctgattgcttcagtgacttaataatggataaactgcttcttctatctctagtggaaaaaataaagcctgggacacagagtggctcaaaggggagcactagcctgtgtggggagcactagcctgtgtgaggagcaccggcctgtgtgagaatccctgctcaactcctgctcagctctatgaactttgggtgcattcattgtttaaagcctcagtttccttatctgtaaaacaagggggctagaaatatggggtagaacatttgaggtggactaagatggaaaaggagaatagtaacttcccactgacctgtggccctttcagtggctgctctgcccaagagccatatactcatgacttctgatggggacaaagacctaaagcgcttgtggtaattgtcctggaatccttccgcaattctattctttctcctcttcagtcgtttatttcttccagatatgtggggagagcttagggtgcctcatggaagcccagaagcccacccctgaaatgtctcccctatcctaattcaagacaggtatggcctgcagttcccagcactagaaatagagtttcccttcaactcatcccctatttactctgcccatttcctagtttgaggtttcaggatctgagtttgctatcaggattgaaacatcaaagtaccttagttttttgtcacatttgctaaatggttgtcattctacaaaatgttttgtacatgttaggaaaatgataatctaaataagggaattaccatggaggagtttctttgagagatttacgtgcaggggattttctaacacctctttcaaccccttttccacctatccataagccctcttaggaacaaggcaagccatcatttgtcaattcatataaatatgattaattgtatgaatgacgactgaaagctaaggtcaatttctgatgtagaatctatgttcttggaacggtggctcacacctgtaatcccagcactgtgggaggccaagatgggcagatcacctaaggtcaggagttcaagacaagccttcccaacatagcaaaaccccatctctactaaaaatacaaaaagtaaccaagtgtagtggcacgcacctgtaatcccagctacttgggaggctgagacaggagaatcgcttgaacctgggaggtagaggttgcagtgagccaagactgagccactgcactccagcctgggtgacagagcaagactccatcacacacacaaaaaaaagagagaaagatatctgtcagttttacctgccaggcattcatttacattcttctggtggcaacgtttagattttcctttagggaacttctccattgcatgcaatctcattgttattttcaaactaagagcccctcattcttaaggagtggaaggtaacccagtctaactcaatcagactatctcttctcaatacatgtgttttcagcaaagtggctcaaaagtgtaaactatcaccaggtcattcattcatcataaaaactgtggaagtcagtgttgcaattcctctgggatctagaactagaaatgccatttgacccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgtaaggacaaaaaaccaaacaccgcatgttctcactcacaggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtaataataaaataaaaattaaaaaaaaacttaaatgtacttctattcttgctccctagatattcagagatatcttgtttctatccttcgtatgatcaggttgttcaataattcctccaattctgtgggctatccccttccaataagtttatttttcactctaagccagatgcatttcaagtgcctgcaaccaactaaccagactaagtgaaaaatgaaaggaaaatatagcatatttttgaaggtctgatgttggaggcagaaacagactatggacaagtgattaggttgctttccaaaagtttggtcctatttcagtcgtttaaatttggggtccattttcttcatgggatagtttctgtagtatatactgtacctgaaatatagacttcatgataccatagtttagagtaattttgaataatgattattgtgaaatctgttgagagttccaaatttaaaaaacattactgggttccaaattaaatagtttatttcctgtgggatatgtggataacaggtactttatatttgtggcatttatgttattaaaataattttacaaggtaattttatcttcatttttctgttataaagaacttgaagctcaaatagggaagaatcattgagcttatagaagatttggatgggaacccagctgtcctttgttacaaagcctgcactcctacatctgtctaccaaagctacttaccaggcatgcataacctttctgtaccttatcccagaaccaaaggagaatatctgcctatcagaagaaagataaataatgtgagtttctttccactattattcttgcagttcagggtaatttctgtgcagcagcaaagactaagagagccacataagaggagagctggatgggtgctaatgatggagagagtgtcaaggagaaaggaggtgttgggagtaggtgctctggcttaaaattcttggaggagagttcactcctatcctctccttgtttctcatcttggcctataggaacaggaagagaaagcagtccggagtctagccccctattatatgttcaattgtgttccccaaaaagattttttgaaattctaacacttggtacctataaatatgaccttatttggaaataaggtctttgcagatgcactcaagttcagatgaggtcattagggagtctctaatccaatgtgattggtgttcttataagaagaggagaacaccacgtgaacatagaaacacacagggagaatatgatcacatgaagatggaggcagatgctggagttacgctgtcacaagccacggggtgcccaggaccaccagaaactgaaagaggcaagaaaggattcttttctggagacttcagagagaacatggctatgtagataacttgattttaagcttctttcctttagaaatgtcagagaataaatatgttactttaagccaccagtttgtggtactttgttccagcaggggatttacctaacaccacaaggagtcaacaaaccagttgcctaaagagccaacatctcaaaaattttacctttcataagtgcagatgtacaaaaaaggtatctcttctttactgagaaaattttaacatttttacatatgtgcacaatacttacacaaaaagtcaacattgtattaatttactttcatggagtcacatttgcaaagaaacatataaaactagaattctctaacagcctttccataatttatacctccagtacaggaaatgatgcaaagatgaaatacatagcacagcaaattgcaaaaactaatgttgactaatgttaaaatagtgaaaaaaaattaaaaaggaaaaagaaaaggagaagaagaaaaaactaaaaaatatttggcatatgaaaagtataatgcaggaatagattatgagcaatggcacgtagatagttcctaagagctggctgatttcacaatcattaactatattttgaaatcttgcatcacaattaatagctgcttttttttcttttaatacatgctttccttggagaatacattcacattcattttttatgtggcactgcttttttgaaattcttctttgattcagcatatactaatatgagcattccctattacattttcccatcttttgcaccttgtttctatgttgttttgggtatgcagaaatccattttgcatgcactcaaatacagaccacacatttgaaagaaacaatactggtgatcgaacagcaacactgtgtgtttaagtgttttcttatcccaccatgtacataatcatttttgaaccagtccatcagcaactttgctggcttcttcaggcaaatgcaactttaatacattaaaatctcctggaagtcatcagctagaagaaatgccaatgcaggcaaacgaggcatttttaaactgaagttttagtccttgccatatcgtgtggacaatgcacacatttgaattttttgacaaatgcattgagctaaatggaagaaaaaaattttagtaacaccttgaaattcacttttagaagtcttaatcacacctaattccaaatccatcactatggttcagagaatcaactgaaatccattttcttctgcgtaaagacaaaagcaaggtaatagctctgcctaacatgaagcaatattcctgtgactgtgatttttggaattcagatgttagagattttagattttagggattttgatctttagggattttggtctttcaggctttcaacatttataattatggtgttcaagagtacatcttttgggattatgattcaaatcctgattccccaactgtcttcgggaagaaggcaatatcatgttgtgagtttatggatgaatggaaaaggaccacagcaaagttgaatttgcttgaagtttctttttttttctttcatatccatacccttgcatggaaatagaaaaaaaaaaaagtagctcgtaaagttaagaatatggataaaggcaggtaaaatggaatttttaaattttgagaaatcacagatacaattattacaacctctataagtgaaaataagcaatattcccaaatctacaaaatgtgaatcctgtaaaagtgtatcaagagctcagcatccttagcctctctgttgattttgagtgtcaacgctgcagcccactgattgtgtgttctctttgtgactgttttctcacctataaaataaagattgtataatgaactgagtttgctcatctgtaaaaggtgaggttgtaaggattaaatgatttaatacttataaaatgtaaaacaagaagtttcatagagccacatgggaagtgcttaatacgtgttagctattgatagtggtatgtcctataaataagattgcctgtcttgtcttggtggtggatgtgatcgggttcaaaaataaattgggttttggtcttgtcctcaggtagtttgctaataagcaactttattacaagatcgaaggttataagtattctaagcaaaaccccaatttctaggccacagatactgaaaaggatacttcccagcaatggtggcatttgaagtggacttgaagcaaactgatatttaaccaagcagagttctgattacatggagggattggcacaatcaaagcacagaacagtgtaaagttcctgattcggttgagtagaggacacagtgattggacatgcaacatagctggacagatctgatgatggcatgccctgctgaggattctgaaccttatttctatgggcaacaaggagtcatagaagatgtttgagcaaagagtaataggattatagcttcagctgtaaaaaggcacacacaaaatcagtttatctaaggagactattggaagtgtgggaagttagagaagaaaaggccaatttggaagctattttcaacaatcgaataagagacaaaaatcagtgaagactgaacggtagttgaatttgtcattgggaggagttaatgatttgtatcagaagttaggatggcctgtgctaacattagaacatgaagatcagagagggagtgattctgagcaggaagtagaagagaatgctaaataaagtgagctatctacactgacaaataagtttgaaatagaggcagttatgcggagaatgcaggctacaaaatggtgttacatgtagaagagggataggcgagctatgacctggtggaatcttggttgatgcctgtgtttgtacagttctttggctgcttttgcactataagggcagagatgagaacctgtaacagtgaccatatggccacaatgcctaatttgtttttttttagacggagtctcactctgtcgcccaagctggagtgtagtggcacaatctcggcccactgcaacctccacatcccaggttcaagcgattctcctgcctcggcctcctgagtaactgggactacaggtgcccattaccacgtctggccaatttttgtatttttagtagagacggggtttcaccatattggccaggctggtctcgaactcctgaccttgtgatctgcccattttggcctcccaaagtgcttggatgacaggcgtgagccaccgtgcctggccacaatgcctgcaatattaattactgggccgtttacaaaaattgttgctgatccctgatcaagaatatcttgataattgaagtaatatttgaactcaaattagctaatataactgccttgttattccttttgaagtgttttgaaaacagcttcagaggtttcaaagactttactagaagcttgggaactagcaagcttctaaaagaaacatgtggatggaggaggtacctgcctcatgccagagtttactactttattgacaaaaggtcaccacacaaacatatgcaaacaatagattttgtttatttaatctatcaaacatatgcaatgatagattttgttgtatttctccaggaagaagaaaataaaaggaacatattatcagattattttaattcaaggtcagaatttttttaattaaaattggattctagtctgcaagtgagtgcacagagagcaaaaagaaatacatggtatgatggctgccctctagaaatttttaattttccacaaacaaatatccatatataaaaataaatgaaaataatataaggaaatgctgactgtactgaaggagaagtaatgtgataattgatttccatttctttcctgctttccgtctgtttatagagtcacggacaaagacaagtgtctacagaaactaaatgttttgaacatcaggacactttaaatacaaatccagagaaggggcttctctttaaatatcacaagaactggcaaaagttggcttgcagacctcccaagtcaggaggcctctggaactggccgtgtgagcctctgttcacgtagtccccactgtcctttctcatctcatgctgagtcagctttcctaatttttatttcccattggtctttcaaagcaattgacttgtaatccttgctttggaagtgctatcaacttcatcatggttaacagcagcagagaagggagcccctaacaatgtgccttgctgttagtttcttgactacttttgtgccatttcccactgcactttcattttgtctctccttttctttatttccatcactagttttccaccagcaggaaattgccagaaaagaattacacagctgaccctctttcctagtccctgtttccttttattcacctctctttcatcctattccctcttgtttcaatccttacccaaatgtcttttgaaatgccaatagaaataaccatagtgacactttgctcaatagatgtcccagtggttcaaagagcaatcctctttggcctcacccactgggttctatttctgctgagccaagtacatttaattcactcgttcatttgctctgaccctgttatcagtcttattttttctttccttcctctgctcccagatcagaaaaatcaatacatttgttaacaatgtaaaaaaattaaaaatcagtcaaagaaatcagggaactaaagtttcaaataggtaagtgacttgcccatagctgcggaattcagtcttgcatgatcagtcctcaggagatggaagtctggacttgatgtctctggagcctagggtgattgcagggatggaacatagggctatgaaaggttgacctgagaatgatgctagaaaaagtgagcttctttcttcctttgcatttgatgagcaaaccccaaaggagagccaggaaacagattgttgtttagaactctgaataaggaatcaaagcaagctgctctaggagttttccaatgacaaaatggaaatggaaacctgaatgagtaatcacaaggaacaagatgctattatctttcttcagctgcctcatgccccctcttcacttaagcataaaatggataaaaatcagaaaaacaaaacctgtcaatgaaacattgtttctgaaactcaggttgaaacataaaagagacttccctaggctagtcactatatatacactgatatatacatatatgtgtatacattcttagaatactctctaaatatcacttagttctgaatgatgtactgtgtcatcttagactaaaggtcaagtgaaggagagttctctgtttctctcattaagtaactcatatatagataagagaagaattgagggagaatgatgagtctgccctttcccatccccggttctccacatttagatgttagtcacacacacagtattattcctttaggatgcttcttacctgataactttcctttaagaataataaactgttgtccttcactattaaaaatgggactttggtctgtcttcctttttatcagtcttttatcctttgtaagtgtgataactataagatcctttatttaagggccgttgaaaggatttttagacacaaatactatacttttgaatataaatataccaaagtcacctccaatgtacattttccatcacttagctgcattcaactgtgttgatatagaagcatttgtcatatacagcattagcatacacatgtatgtatggcattttaaaatgataaaatatatagaaatacaaaaaatgtatgagcacagtttaacacatggctgtaaggggaaaacctgaaaccattcctaagtcagaaattagaacttttcagaaaaatatgaaatgcttcatgagtttcccattcttcacagtttgttctttcttctctggatcattccagttggagatcatgggcttctgtatttttagtattattcttggttactacagtcccacttggttatttcattcaattcctaaaaatacttatttgaactttgcacttctgttctaaattttctagggaacttttttttctcatgtaaacactagatcatctcatttagttaatgcattcctcggagaatgtgctctaaaccagtgccactcaaattacggtctatcagtgccaagctgtaaactgttggttactggccccccatgaaattgagtgtagagactgagagtaagctcttaaaatatttatagcaatttttcaaagaaattttatgacttgaatccagtaataaaaaaatagaaacttgcacattttatctgtcatttttattttatttttctagacatttatttttattccattttacagaagtatatatccatgaaaaactggaagtaaaacaaaattaaacaaaaatctgttttcgtttttgtttttttgttttaccagaatagtttgagaagtgctagtgtagggagcagaaactgcttgcaggctgcatttccctttatggacccgtgagaaacatgcatcttgagcatccaaatttgttcacgtaggacaaagggaattttcttttttttttttatttttttttattttatttatttatttatttatttatttatttatttattttaaattttttttttattatactttaagttttagggtacatgtgcacattgtgcaggttagttacatatgtttacatgtgccatgctggtgcactgcacccactaactcgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgcgtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagcccttaggacaaagggaattttctaacatgagctgaagatctggagttcccagccatgtcttttataaagactcaacttccagaacagaatgggttgctttacttctatgttttcaccagcacctttcttgcccaatgactgccagtcctgtgccatgtacctcttttcttacccatcaataatggttaaaaattattagatttagaaaaggtatataaacaaagacacttattctagcactgcttttattttattttattttattttattttattttattttattttattttattttttgagacagagtctcactctgtcgcccaggctagagtgcagcggcacgatcttggttcactgcaacctctgcctcctatcctcttgccttggtctcacaacaagccgggattacaggcatgagccaccacacgcagtccaagcactgcttttaaatatcaaaaaatacatgaacgccaaagagaaaagcgttagtacactaaatgatgctgcatacaatgatggcacaactgcaatcattccaaattatgttgtaaatttgtcctagatcctccacataatgctgtgttaaggaaataatttaggctacaaaggagtatatttagtgtgataagtttttgtaaagaaaatatatgtgttcagatgcagagaaacatgggcataaaaatgttctcaataattatcctttagtggtagaaatatgtgtattttctaagttttttcccttgtgcttttctgtgttttgtatcaaatacttttttatatgtttgtttaaagtacataaaagaaatgggaaagaataggagaactgtgaaaaaaatggagagtcaagtaatccaaggcaaaaatgtcatgaaggcaaagtatgttgaaggctgagtggaggacaggaaacaactccatgcaatggcaccagaattttggaagttgttaaaaaaaaaataagataaaaaactggtctcaccccagaccagattaatcagtattttagaggggagggaacagacatcaatatatttttttttttttgagatggagtcttgctgtgtcgcccaggctggagtgcagtggcacaatcttggctcactgcaaactctgcctcccaggttcacaccattctcctgcctcagcctcccgagtagctgggaccacaggcgcctgccaccacgcccagctaattttttgtacttttagtagagacggggtttcaccgtgttagccaagagggtctcgatctcctaacctcgtgatccgcccgcctcagcctcccaaagtgctgggaatacaggcgtgagccaccgctcccagccacatcaatacttttaacacttcctcaaggagcccagtgttcctccaggtttgagagtcgttgggtagatgccagccagcctattctaccaaattagtccatgctggctggctggctttcaggaataggagttacattattccaaacagaaggctaacaataaaaataacaggattcgtctctcacaaagcattttatcccctcagcattggtggcctaaagctgaggattatttgtatgtgattacaagttttggagacaccagttgaaattatctaaacattctgaatattaaaacctaagtatttaatgtgataaaactatgatctggaagttgaatggagtgattgctttgcgggtatacagagctgcatctaagtcaaccctcttgaaaatgttaattagcaccaaacaaagaacaatggaagatgtctgcttttttccttggagaccaagatagggacaagtcgttttgcatgtgcgcagaatgtggaaatggcaaagaggtttaaataacgaattttaataagtttcatcccactgggagagacacttctgattatctgtgacctatacaaattatcatgattctccccactggcctaccataattttaataagtaatcaaactaagcttgaaggttctgcaaaatgccaaatatatacaagtgcttttgctagttacaaagctagtacttgctacctgacctttttacaatttctccaactacttattcacaccccagccacaggtttaaatgctcagcgttcatttggtccttattgatcctaggctgctacctgtttgggctgagaaatgaccttctgtggacatctagggagtcttgccctgctgtgagaagaatttcaaaagaagtttggccagaaatttaatgcagatctgaaaaggttgctagcgaagctacatgtagtggaatgagatacaataagtccctagtgatggtccaggcccaggcaagtacctaagcacaatggcgttcaccaatgagctagcagaaggttaacgagggcagagcatatagaaacaggtgcttcgggctcctgggagatttctttacctctctccaggtttcaatctatttcctcactccagcctcactctccaaattgtaacttacatgttgggagcttaagctgaaaacctcattaaaatcttgttctcttctcctgccccgtgatttggcttttgcatccttgactctacaccagtactttttaaactttaatgtgcttaccagtcgcccgggattttattaaagtgcagattgtgaataggtcagtagatctggcatggggcctaagacatgaatttctaagaagctcccaggtgatgcttctgctattgtgccagaccacagcatgtgcagcatggccccagttactagttcctacccccagaatttatgaggcagttgtctggggtggggccaggaatttgcatttctacttagttcccaaatgatgccaatggtcagggtctacacactgagaaccactgccttagcctgctgctcccaactgatttgagctgtcactactcagaagggcaggttgctgccccttcccctgccatgtgctggttccccctactctcttggcagttttttcagggatgggagtcgaaagataatcatcttcttactcttcaggtatctgtaagatagaaaaagaaatcctgccaaagttgaagaacgtctcccaaccttttagacactgaaattctatagaaatagagaagaaaaaatgaaacaaagcaaaagaaaatgacccaactactcagattagagcctcgaattaaaaactgacagacaggctgctttacatcatcctgaaattacttgtgcctggtctcagactaaggctcctgcctatagctgtacagtaaagatatcagtttgttactcaccgccaagagcctgaggaggcaggactcaaggttctgttcatagcagagcttctcactgtgctcacacttgtgcaggcatcagactgtcctgcagggctgttaaaatgactcttggtccagggtggggccagagaacttgtgtttctaaaacgttctgttactcataggactggtaccagaccacacttagagaaccactcaaattgaatgacacccctgttttacttgcttccgttttccaccaattaagaaatggcagtcacaggaaaggaaagtaaaatcataggtttgctgatgaagctgaaatggggaaatatggtataggcagagattgtcaatggatttcttaaggctgaaccccagagttagacatacatgtgcacccactcacgggcagcactggatcctgtgagcatcccttgatggggacctgcccatggaaaatgtaagacatggagaaacagagtggggacacacacttcctgcaggcagctagctcctgaagagaatgaggaggggaaggggaggaggtgggcaagctcagttccttctgtcaaacccaacaatcaggtaaaacactccacactcccaaataatgcaggaaatgagggactcaagaaagatcaggtaggatgagctaggctaatggatgtccctcccttagaaacaggaatagtcaatcaatagccctcctcccaaagaaactaatgtccaagcttgccaaccccctcccacaccaaataccaggctttttgccccaatgagtttaatcagtaactaaattgagttcaaattctatcccagcttagactggttatttagcccgtatgagccttagtgttatgcctacaacattgggataatgtaagtcttatctccagtgatcgctgtgaggattaaacaagctatcactttgtatctaggagggactctccatataacaattttccttccttctctgtcttccttcatctcttagccttgtgacttgatatgataaaatatgttatattgtacttgctcttagaaaacctgcaatctcgagaaaaagtatagaaatatgaaaatgggctgggcgcggtggctcacgcctgtaatcccagcactttgggaggccgaggtgggcagatcacgaggtcaggagattgagaccatcctggctaacacggtgaaaccccatctatacttaaaatacaaaaaattagccaggcgtggtggcgggcgactgtactcccagctgcttcagaggctgaggcaggagaatggcatgaacccgggagggggagcttgcagtgagcccagatggcgccactgaactccagcctgggtgacagagtgagactccttctcaaaaaaaaaaaaaaaaaaaaaaaagaaaagaaatatgaaaatgttaaatacagcataaggcaatgttttgaaactatgaagagaaaatagtgtgaagactaaagcagatgatatgtaaaatgcttagtgattagtagttgcttagtttaacatttttctaaaaatcgcagttcaaactggaagattgggaaagaagctagagttttctatagtggctccataggaaatctgtggctttggttggcttcaggaggaaagccaactgctaatcatgggacagggtaaggatagttgagggatggggaacagcatgggccgaggcttagtacaagggacccgagagacaggcggacacacctggatgggtggtcacttgttctgttcacaatcagttcttgtcctgagccaatcaccagacttaaaaggtccccacgctgtagtcttttatatcattgcccattcagttcgcaggcattgagagcataactagtagcaatttctctgccttttatgtataatgattcgattgatttgaatgtcagggcatgtctctaagtctagagggtaagcagtccatcctgtgagggagcatagttatttttctttctttaagtcaatgactctctttgatggtggctgcacattcaaatcacctgggagcattaaaaatagtagcaaagctctaccttttatcaataaacttcaaatctcaaagggtggaggctggcatatatattttcttaagagctcttcagatgattctagcatgcggcctaggtcaggaaagtctgtggccaaggcagcctgttcactcgtgtggaaatggcatttctaagcattgatttttctcaggaacaattaggaagcaattaacaaacaattaaccagactgttagtatgctatagataagcaccaaacctgcatgggattttgaaataaaataaccaagaaaagcatgtttttcaaatgtaaactgggatactgttttacatgctaaataaatggcctggcaaacaaaggggctatatttatataaatggttaacttttagtcatgtttctaaatcacacgttattttgcaataaaataaagattatgaagacagaacaacttaataaaaacatgtacttgactatttgagttgagtaagatcatatttatcttttcttatgactaatagctagttggatattttgtttctgaagtggtaagctgtttaaacaagtataaaggagaaatcttatttggttagcaggaccaggaagtgaatctatgttagtgtccagtttccattcattaacttattcattcaataaatatttattgaatttcctccattgtgtacctagcattagactagaaagtggttacactgtttgttttgttgctgttgttatttttagagacagggtctcactctgttacccaggctggagtgcaatggcacaatcatggcttactgcaaactcatcctcctgggctcaagtgatcctccccgcttcaccctccagagtacctgagactaaggtgtgtgccaccatatccggcaactatcagtattgttgactaaagcaggtttggtttctgaacttctgttttaggtacttataatctaatggaagaaagatgataataaatgatgagttgtgctaagtgcaatgaagaaagcaaacaggatatagcaattgaggaaaactgtgtgtgtgttttgtgaggtgttctactgtgatagaatctgaagatcctatccactcttctgaaccaagaatgcagaataaagtggagccaactttcagacttagagcactgtaaggcagaaggcccaggcaaagaagaatttagcctgtgagaggctctgaaagataaatgtgctaaaatagggagtagtcacacacatgcattcatgataattatttttttcctcagtttgttcttttgcatatctttatttttccttttaagaccaattgaagtcaatatttattgagtattttctatgtgtcagtagttaaaatagtctgagacagtgctaggaagaaattaaaaaaaaaaaaaaaaagaaattaaaacctgatgggagaaacaaccctgacctaagagaggcagattgtacttgctcttaaaaaaagtgcaatcttgagaacaagtatagaaatatgaaaatgttaaatacaatataaggcaatgttttgaaactataaagagaaattagtgtgaagactaaaggagatgatatgtaaaatgcttagtgatttgtagttgcttagtttaacatttttctaaaaatcatagttcaaactggaagagtgggaaaggtagaggtgtctctaagaaagacatgcatacaagttatgaaagtgtgtgcagtcagaaaaaggcaaaggagggtgtctagctttccctgggggatctgcaacatcaggcaggaatttttccatgagaaggccctcatagaccccagggaatcatggagatgatccaaggatgtttggttggcaacagttaagctggtgaggaggaacacattaattagttatgcctagataagaaaactggagagtcaactcaagtcagctttccaaatcagtcatccaatccgaatgcttctaaaataatgaacaattaaaagtaatttcacactggttctcagttctagctgcacgttagagttacctaggcatcttcctaaagcactggggtctaaaccccactgcagacaaatgacacagtctctgtagggcaggtccaagaagagcatgggacgtacatttacgaaagatgatgaactactgcctcatcctcataggacctcagtcttcataagtagtgccaattcaatatggcaagaccacagtctctcccttaatctctacttttttttttcctgtctgagtaaatttactcaaagaaccagttcaaatattacctctaaaatgaaacatttatttatactcctaggaaaaattatttcttagcaaaagagttaaggaagccccgttgaggtattttgtacattgattttcctgtgattacatatgaggttacacagtcctcaagggtttgattgcattaaaatacatagcacctagcctaacgctcacaacatatcaagtcttgaatataggaaggaaggaaggaaggagagggagaaagaaatgaagaaaggaaggaggagagggagtaaaggaaggaaggaggaagggaggcagacagaagggaaaaaaggaagggagagaggggtggggagggagagaggtgggagaaaagaagaaagagggatggaagggagggagaaaaatgggcaggaggaagggtggggaagagggaggaaggaaggaaagaaagggaagagggagaaaggaaggaaagaatgggggcgagagaaaggaaggaagagggaagggagaaaggagggaaggaaagaaggaagagaagtagggagagggggagggaggagggagaagtaaaagaaggaaaggagggagggagagagagagagggaaggaaggaaggaaagaaggaaggaaggaaaaaagattcattaataagaatgattcaattagtttgcataccaggctgtgcctttggcagctgagggtgttcaggtaccagagacctaagagaaagggtacaaaaaggaaagatagaagtgccagggagactacttgtatgagggcttcagcagcatttttaacttaccatttgatgtttttagctttagaatactttcctcaaatatatataacagaaattagtagccttaagtgtggtcccctgaccaacagcatcttgggatttgttagaaatgcaaattctcacaacctgccccagacctaccacaccagcaactctggggttagggcccagcattctgattttgcaagcgtttccacgtgtttccgatgtgtcctcaagcttgagaaccgctggtgtagataaaagtcgacttactttggttgaaacacagctagtaaatagctgtcaattcctactccctttccatgcaaatacacacaaatacagtcctgtggagtctgtctccatagagtccccaagtcctcacacaacgaagttgaataagctggtcttgcaagtgtgagcctccctctatgttatacacagtctcagtgttgcctgactccagagttcccgtggttctccacatgtgaacttcaagaggaattatttctcttgatgacttttagattcagacttttgctaattcacacaatcccaaatctgatgattgccagaactttgtctgattaaaaaagaaaaagtcagttaaagcagttttcagtttggtatatgcagcctacccaactctgttcactttctaccaaacaatccttccctaatattgtaaccttcaagagtggtcccaaagccatccacacttctgtaggcaccattgacatagcatatgctgagcagattcccaagctgccatttcacccaatcatattttagacagttgaagtctttatttgagaagcattccgatctgagggttttttccctcgtctacttaaaatttcatagctgtgttaatttatcacccctcctcattgcgtagcttctgagtaagttatacagtaatggtgaatgataaatcagagggccaggcctatattactcatgacattgtaatagtattaatctgagatagcttttaattgtccgttctacagtctttaatgctaagaagatatagaggtttccattattctaattgtatttcaaataaatgtatgggctcaaatttttcctctctgttaaaaaaaaggctaaattagagatgtcttgcatataaaatgaattattttacagcaaaactttgattaatcacactgaaaaatagcagaaatctcaactgtatgtatgttgtctgcacttagtttgtcagaaaatgacaaaaagggtcagaaaataaggtttcatcgtgaaattaaaaaacgaaatttcaaaaaactttcaaagcaaccccctatgcctttcatatctgtaatctagttaagtgaaaatggatgttcagataacctgtggtccttttagctatcaagcaaaaagtggattattttcaaaggcttcatttgcaagataagaaatggattaatgcattttcaaagtactttcaacaagactattgagacaaattaggttaattttgaagttattgaaaagaccactttccaagtattccagtcaatcaaactttaattacagtaactacatatattgatcatacttagaagaaaaaggcagttacccagaaaagtgaaatttcctggtaattgatgctttccatatgaagcaccaaaacatttggatatgaactattgtggttgtagttaaaccatttgcagtctgactaaacagagaacagtgactgtctttagatattcctcatggcatttgtatcagttggcatcattcatacgagcacagtgaataaagcaggaactggtctataaagcattcttatctttcagacagtggaactcagtatatttactttcttctacattaaggagtccaagacgggtgctgtaaatcttttttttttttcttttaataaactctttagttttatcttcccctcctgctgtctcttggtggccactgctaaactaaggtctctagcaagaatttctatggagttctttgggtccatgtctgaaagtggccctctgtctatcttacttcacaaccagaaggttgtggggacaaggcaagtactttggaccagaaaagcagatcacagaagatttataagtgtttaggcagcagtaggtcagatgccagaggaataaattgagatcaagagtgcaaaatgagaattcccaagtatatgcgattagacagagcctggaaaattgccaggaactggtgggggtgggcagtgatgggggtgggtcagcacaagatgatgtccaagtgccaggccaaatagcaagtaagagatctctggaaattgaagcagacggacaaatttgaaataaaataaaataaacagaatttggaatcagttatatggaaaagacacagagaagcaattgatattttagcttcaatatttcttacttcttaaatcgtcaagtcacccacttctcaccacctgcaccattaccaccctaatctgagctatcatatctcttccataaacgctaatcctgtagaagtccctccagctggtctccacaggcaggcgatgccattgctggcccacccagatcctctttaccaggcaggtgcgtccatcccccagcagctatgagcattggctgctaatagtccccagcagctatgagcattggctgctaatagtccccagtggcatccttcctctgagaaccgtcctagcatataggaaaatacctgggagagtagcgcaccctccctttggcgtgcatcccccagccaattaattaacagaaatccaaaggctggctcctcaacttgaggtgagataaacctgtggtaccatgcagactccaggtatacctgtaggatcaggtacagtgaaaacagatgtcagttaaagcaggtcttcattgaacaaacttctaacctggaagtacaagtatttcattttcctcaattccttactgttttttatctatatattaaatatatatatatatattttcctaggccctctcccacttggacaagtacctatctctcaaaccctgcttctgggaagccttatataagatgcactgtcttcacatttgctgccctgtagcataagtaaatacagttatttaacttaggataatgccatatgatttgccaaaattgtattttgaattttgttctagacagaagaaattttatatcattaagatgagtgaaattcctattaaaaaggataaaagcgcaactcgatttctgacttcataaagattgaatattgtttcttactcattctacttggaaatagtcaagaaactctctgaaagtagaatatttcaaaaaattctgagaaaattaagatatttagaaacaaaaaggatagctgttttgaaaaataagtaaagtaagggaaatcaaaaaatttttcttgactactttgactttactgggtatatcacatacattaatagattctgatagcacttcagttttttgttgttttctccgtgttgcagctaaaacattggggctcagttgacttaagaaatttgcccaatgtcgtataactagccagttttaagtttgtcctaaggtatctgactccaaaccctttgtgcttttctttctgccagtgtacagtattccaatgagtgctaattaagcatttaaatagcaagaaaagcaaataaaaaaaagatggcgtactttcagtaatttaagtaaatctgggaaatactatatattatatccctgttgggagataattctccctggatctcatatgtttctataaagtctgagtcttatgagcaaaagcatttatagtcaatttaagactgtataaggaggcattccagaatagtagaggcacttttctcccctcttaaagagactcgctcgtatgcttgtattcctgggtactacagataatatctctctctgtagggcaagatagatgggtttgctagctgtgttgtaataagattgggaatttcctaagctcagtgttctcagatgtaacctagacccctttgtgcacagcatcctttgggtcctctgcatatcacccccaggggacttgaggagcagcggggaaccagtgaaagcgcagagctcaggatgcctcctgtgatgaaaataacaaactgtctaaatctatttgagctcactggctccttaccagccaaatctgtggaagtatggaaaccactgcagacacttcccaccatattactgctaagaaactgctttaccatttgacaatcctcctcctaggaattccaaattccaagtgagggctctgagaagacttcagataaggaaacccattgatttttcattttacctaatgtaacttgttttcctctcttggatattaataggaaatgcagctccacagagacagaaagccaggcagccaagccagtgtggggtctctgaaataacactgtgctagctgctactttccctgtctcatttgaagattcactctcccccgtctaagcacacccagaagaaattcatgaagcagatgctacgcctctgagtcactgcttttatttgcttctcctgtatccaccaccttcttagctttaattacatggtttggcacattcttaaggtaaggataaattcataacagagattttctcctcttaaagagcagctctggaggaagccttaagcattagatcaagaatccacttagatgtctatgcctcttctacatcttttcttctgcttactctaattgctatgcagtcctatctaacctctaaaagagtctgactttcttctccctcctgttgcattgcttgatataatggtataaacaactaagaagctgaaataatatgatgtgaactttcctaaaagccagtctgagaattctgcaataggagctactaagtaataaaaaagaactcagctggaaatatactttgaaaaaataaattggaagatggctttaaatgcttttgagtagtcccatggaatataaaaggaagcagaacacagaaaatgataaacaaaactttcaagactgactcaataagtagctcttaaaatagctatgagtttccctcctaacacccagcaggctgccaataaccagacagacaaatcgaacaattaaatgctatgaggcagcatcagaaaagatccataacaacattctgagcagagccttaaccactgcctgaataaaatggtcccaggcacaagaggttgtttctgacctggacaaaacagtgaaaaggctgtgaaatgtattcttttactgagcatctgtgatgtgactgataatctaatgtgttctgggaatgttgagataagagacacagactttttcaaaatgtagggaaggaaacagatgagtaaaatagtcaataaaatatggtccagtaaggttatgatatatatatgtcatatgtcattgggagattgggggaaaaacacttcactcagatgtggggtgtttgaagggctgagtcctcagatgagactttctaggtgaggataaattttccaggttaaaaaaagatcagcaaatagagattctaggaggacgtggtgtgttcaagggcatcaagccatgaaagggctggtgctttgggagataccgcaggccagtctggctggagtgctgaaaacatgtgaggacagattgtgaaatgactctggagcttgaaaagaggtaaaatcatgaaaggccttttgtgtcacgctaagggacttggatttcatcctgagagtgaagaagaaaccactgacacgatttatagtcaggtctcactctttttctttttcctcttatggccttcagcgggcgctaacactggttggcagaatggccaattcataatttatagatcaaagtatgtacttctcacaaaatgaattcaaaagtgattaactttttcaatatactgtgttatcacatcctgacttaatttgtttttctcctggtttaaagtatgtttctggatgtacaaagtaaatctttgcattttacaaagatttttttttaaagccaatataaggagacttcgtggtctattatatatgataataagttccaattggaaagaatctggtagtgttaataaagaatccttaaaaccaaagaagggaccatgtttaatgggaacatttataatgcacatatcccagtagcaattagaatgggggagggagaatcagcaacagatccatgagaatttggcatatgtggcctctagctttacataggctgatagattttcagtcaagcttgaatatggaagtcttgaaaactctttcctccatcctctgtttcctagagattactctttcaagtgatctcatcattgtcagcctctctgataagatcctagaccctggctgcagtttgactccagagtactctttcctttatattatctccacagacctggctcttttgcagaaagaaatttttaaatttgggacactgaaaagagcacatcaaatactgaaaactgtttcatgaggatcaaaagcttgctctctttatgcagctacttttggtaaatactgcttaaatagttactaggaagtcttcaactgtattactaaatgatattgcagtgaacatcaaaaatgggaggatagttcatttaatctgaaaagctgcatatttttatattatgtatactgcagtgcttgacatagctcactgtttttcatttccttgcaactgctggcctcttaaattgccttttttttttttttttatcatgtttctgttacattcaggctctttcttgctgagttattttgaaaaaaaaaagaaaaaacagttttgatctcaaaggtactgatattaagatttatccatacaattaaaaaattttaaatgtaggcctagaaagacattagaattgttccagactttttatagcatcaaatttcctcaagtctctaccattgcttaaatttgtcacccagctaatgtgtatgaggtcagtaaaatggaagtactggcatttctatttgatgaaaagttctatttaattaattatatttgtccccatgaagcctaataatgcatcaagattgaaaaaaattatatgtatacaaatatataaagaagataaatttataatatttattttgggttagaacacaatgttgccccatataaataacattttgatgtgttaagaaagaaagaaaacaacagttaaataaaccaccagttagattgagtgggaaagtgtttccttcctatacctacctatgcatttaatattttggcttaaatttgcaatttatgaatgcaattttagagaaggaaaaaacttcatttatactgagtatggtaagaatgttgtggggaaaattctagttattgtgaccttgaggggttaggctattgtaatatgccacatattacatatgccactctgtgtacagtgtagcagtagaattccagcttttgaatgaacatggtttcaaatgattggtccatattggggccatcatttcaatcaggaattaccagctctgtatattccaaaggttatgagggggcctgtaacatggcacattttcattttttcttctgattcttattctttcagaagtagctaccttttgaccattatcaatttttaaaaattgtactttgcacgtttaatccatttttaaccatacaataattacactcgtgtggtggtaaaattatgtgtcgttggggaatgcatataaaaacttgatgttaaacataccatagattcactcaattttttgatgggaaattttctgagcaaaagctgtctaaaaatggttctgatatatcccaaagaggttatgaattgcatcatttacctaattaatttattcactcttgctcattcattctgtaagtgagcattatgtgaacaaagaggcactactagggcacaagtacaacaaatacgagagatggagccacgagcatatgcttcaggcattgtggccgaggacaggcttcaaaagacactcctactacagtcggaaaaatctgagatcaattataagtaacatgcattgtattttagaacttttctgatatttcaaaagagaaaagaaattttccaacggcctaaacacacaataattagctaaaacttaaaataataatataatatcgaacaatttggaaattccagcttactgtggtgcatttattgctatcagtgctgagactgggaagctaacttgggaacttcattgaaaatattggaaatgaaactgagactcttacatttgattcagatctacaaaggctaggatagtttcatgtcagtaacaacctctggctccaagcataagtaataaaaaaatcctaactggaggaaatcttattcttttttgcctctcaggggtcatacagattaaactcaatcaaatgtgagttcacattaaaactcaaagcaataaatgtaatatgtaaaccaccatgagtgagtgtttgcagaaataagaaacgtatttagactctcaaggacttaagaaattaaaattattatatacagaatataaaataatatatgaaaagatcaaagaaataaaagctaaaacacaaaaatgagcatggaataaaaaattattttaaataattaaacagatttggaaaagacctaaatggaactctcagaaaccatcatcactgaaactaaaaattctatgagttactgcactcccatttcatcagctaaaataaaaaataaaaataataccaaacgttttgcaaggattaagagaccctggatttcttagacatttctggtgggaatttaaaatgatacagctactctggaaaaaagtcttcatcttcttgtaaaattaaatatgcaattactatttgaaacccagcaatcacattcttggacatttattccagagaaatgaacttttattcacacaaaaacctgcctcctaacatttatagcatttttttttactggaaacaacccaaatatcctccagtgggtgaatggttaacaggttccaatgcattcacacaatggaatactactcagcaataaaaaggaacaaacttttgctataagcaataacctggatggattgtaagagctttacacttagtgaaaaagtcaaatttcaaaatattacaaattgtataatttcatttatgtaacactcttgaaataacaataatataaaaacctgtagatatggagaacaaattaatagttgccaggggggcagagataggggtaggatttgaatataggtagagttctttcctatgatgacactgttctgcatcctgattgcagtggtagtaacatgaatgaagttaggctgaaactgcatagcaccacagacacacacacacgcacacacatacacacacgagagagagagagaaatggactcaggtaaaaatggtgaacagtgaataatgtcagttatctatttaacagtgtgcaaatgtcaatttcctagagcgaaactagtgaaaatttcatgggactctgagtacttttgttgcaacttcccatggatctaaaactacatcaaaactagaaaaaaaaaaaaaaaaagcttaaagctaaaattaaaaaacaacaacaacacaccgaagtatcaagaccatagttagacagccaatgctcaggtaggataaaagcaaaaaaaaaaaaaaaaaaaaaaagttttaaactgaaagagtgaaagatagatttgaaggaaatagccaaaaataaagatatataatatatatatataaatatataatatagaaatatataatatgaaagtggtgctaagagacacgaatgatagaataaaaaggtctaacatagacctaattgatgaatggaggagaggcgaaattttaaaaaatagtaatttatagtaccaaaaaatgatgaatgatatgaatccacagataggagtattaaaaggatgcccatgatgtagacatgttatagaaaaagtagaacaccaaaggaaagacagaaagggaaaatactaaaagcattcagagaaaagagagatcacataaaaagccaaatcatttagaccaagggttgctaaagagggctgcacatcataatttccatgaggttcttttgactatcaaatgccatactcaccccggtgaaatcatggtctttgggagtaggcctagacataagaacttttaatactcaccatgtgattccaggggttgagaaccattaatttagcttgtgagtaagcttttctagtaaataggcaagactaccagtggaatactatcttcaaagttctcagagaggccgagcatggtggctcatgcctgtaatcccaacactttgggataccgaggcaggcagatcacctgaggtcaggagtttgaaaccagccaggccaacatgatgaaacctgaaaccccatctctactaaacatagaaaaattagccgggcatggtggtgggtgcctgtaatcccagctacttgggaggctgaagcacaggaatctcttgaacccaggaggtggaggtggcagtgagccgagattgtgccactgcactccaggtcggacgacagaacaaggctctgtctcaaaaaaaaaaaaaaaaaaagttctcagagaaaaaaaaaaatcaatccagaattatataccaagcaaaatgagattgatataaagacattttctggtagataaaagcagagattgtatcacaaaagacttccaccaaaggaatttctaaaggatatattccaaaaggagaaaaatgagattcccaggatgtttgatagttaaatgagaatggtgagtaaagaaattggcaagtgtgtaagcaaatataacaggcattatccttaagaataaatgatcacgacaacaataataatctctgtgtgaggtttagaaatgaatatatgctgaataatgtttcatgtaagtcagaggtggatcagtgttaaagtgttttaaagtactcaaatcatctggatttgaagttggttctctaattttaagggctcgtgttattagattggatcctcctggataagtcaggatactttccccatctcaagggtcgtacccttaatcacatcggcaaagtcctttttgcagtgtcacattttccaggtatctggatgtggatatatttgggagctattattctgcctaccacagggccacctgtcagaaagagagggtcaaattacagaacacaggataatgcaagtgttcccaggatctgtcttaaaggactccaaaatgggcaaggtcgttgtacattcaatatttgataaaatattgaatgttccatattttcatattcagataaatttcactttgtctgaatcagattagtggtagggcaggggctatgagatgatagtggaaatcacatttcagatcctgaatggcattataaggcactttagaagttgacatttattcccaagggcaatggggaacctcttacatatttttatgtatcaagaggaagactaaattaagagtggaatagtagggtcatctctctgcttgctgcttagagaatgcattgacagcataaatctagaggacggaattaagaaatacagtttgaagttttagagtagattaaatgaatgaaggaatcacctgaagaggcacagtggtgtggccgataaaacccaggaatcagaatacttggcttggattagtggctgttttgcagtggatgttgcttgataactgtttgaattctctgagctggtggttaactgttggcaacttgtcatcaactacagggggagtatttgtaccggaaaatctgcaaatgctctcccactcttcccccagagccagaagcctccgcaagctagtggtggtgtgatattgaaaaaaataaaaccctcaaatcctccatcctcgatacagggaagctagcatcagtgaggctcacttcataaggttgttttaaggttcaaaatgaaaataggtagtatgcatgaggaagcaaggtgatgagaagttgctgaattttgttttgatgcttttgccaagtattgttactagtagggttctataaacagaacctaagtcaaattacctgtttaacaattttcagtaggtcaaatgtgctctcattactagagtatgattcacttggattattacaaatagaaatgtaaatacctatgtaaaagaacatatattcctcatatgcaagtgtatacatatacgtccaggcatgcacacaacacacacacatacacacatacacagggagttaaggtgacatacaaatgtctttttatctttcaagtttatacccaaagacattggaaaagggagacagatgaagatgagaatgtcagtgtcattttcctgaactcattggaaaattaggttttagctctttggccaaaggtgtttgctgactccacgcctgacacagaccgaaacactaactgatctcaatttcaggcaatgctagaaaaccacagttctccccaacatgaacaaagcctaatcccatgtgcacagcaggatggttttaaaagatgccattttgttgttgttgttgttagcaagctgattctaaaagacaaagagaaaaaatagagtaccaaaatacccatgcagggtttcttcccctaaaggcagcagttgtatgggaagcattcctgcctctctggggaagagtgagcccggaagagggatcagggttctaattccatggttcagtgctagctaaggggacctcatacctctagaaggctcctagtaatagcgaaaagggaggatttatatgattgaagagaagaacaataacaacagtactgtggtactattaatttatttttaggaattacattacttttttacattactgtaggaatccatatacatgctagtagtaatacttcaactagatggaaacatgagaaatggggacattcacacaatggtggtaagagagtgaatggatcccaacttttgcaaaataaaaatagcaccgtgccgtaaaaccaaaaatgtgctttctcctttatttagtaatctcagttataggagcttaatttatatttaaagagcaaataaacactaaaggaagacatgatacttgcacatttgtataactggggtggagggagcacatgggctacaaaatgtagaaaaatcttatacatcaagcataattttggccttgaacagtaatgccattgtttagctctgaatttcttttataccttgagtcccgctatagaatttttgctattgttctttcatctgtaggtcccttctctacaaggaataatcaggattccaggaactactcatatactcaaaatttttgaaatgagttttatgtcttggccacatctccttgatatccttcagcaagaaatatgtggttataaaatcaaatgggaaaaaacgactgcaatggtggaaaaggttttattgtcagatacactaaaacactttggatatgaatgttatgtttaattgatataaaagtctaaacacttacccactgtgctgtgattatggccagggtcattcttcagagctaattcatttagaatatgttaagaaaaatcctgtaagcatcagtaattgaggaaaattgaactcttgaacttttgccagatatttggctgtatgcattttatgtgttaactgagaagaagctgacaacttgctacattctgaaatcgtctcagttgagatttgggttgcaggagacattagccattagcccaactgcagggctattcactgtggccgtatcataccagtgctcaggagacagcagtcacacctaagaagtatgtccttcctcacctggactgctctcatagcaaagccacctgaacatccctcgttgttttaccaaccagattcatcatctgcttcctgattcggcaacgagcatcacctgttacctgagggagtccatccttgtaagaataagaaacttgactaagcaaagttagcatgtggttgcgtcttcaaagagcacaaacgatcttgtgaaggcgattgtttggataccaagaaagataaagatctctttctatctttagtgatagcacccataggtgaatagaaggaaggaggctccgtcttagccgggaggaaactcacttgttcaacatcactggaacttctaagttgaagtggaaaagggagcatgtgattttcaacacttccaacacttccaagagtagcatgtttccatagtcatgcataatctcagtctgatttgaggctaagaaaatattaaaagtttccaactcttaaaaagtataggagtcccacggcctggacacatagtaaaacacttaataaacactttagatttttttttccaaggaagcagattacgtcttgaaacaccctttactctcaggccagtatggtacggtcagtaagaggtatcaagtaaaattaattattgaagaaaattcttcattctagagtctaaataatttctcctgagataatctttttccacagttattttattataatgggattaccctaatagtctttgctaaaagagctgagatacataaaattattttttcatagtatagagttctaaatctttatgtccttattttatttattaatattattattaatattattatttttggaaagagagtctcactgtgttttccaggctggagtgcagtggcataatctcggctcactgcaacctctgcctcccagattcaagctattctcctgcctcagcccaccgagtagctgggactacaggtatgcaccaccatgcctcgctaattgttttgcatttttagtagagatggggtctcaccatgttgaccaggctggtctcgaactcctgacctcatgcgatccacccactcggcctaccaaagtgctgggattacaggtgtgagccaccgcacccagccaccttttttattttctttaaaaatcaaaacagaacatatttgacttaggcctttatcagacagagagaaggatgcacatacctaagctggtaaataattatgtcatcctcatttacagtataggaactttctccgtaattattgtactttgaggattaattttccatatctcatgtgtgttccttaagatttccacctcataccttttttttttttcagctaaagcataaatgtattgactcaatctcagtttaagaagtagggtcaacagagccttaggaccatctcctggtggctaaccatgaattgtttcctttcatgatttttttaagcacatgttgagttagatgccaagattctgaaaccagatggagctgactcaatgagcttccatttatgttccagcatgccagcattagctgggttccagcagatacttaagtaatgagatttgagcaacatcttccccaaagtattatcttctttagcctattgtagtttatgaaatttgggggattaaaatctggcttagagagagtaggtcacttcaattctcaaagccttcattttcttatctataaaatgaaaataacaaaacctacttcataaggtctagtaatgattacattagaacatctggtagaagaagccaggcaaagtgactacatgctgtgttatttcttttatgtgacattactgaaaagacaaaaccttaggaaaatattagatccatatttgccagtgattggtagtgggaacagcagactgactaaaaaggggcacaagggaaattcgaggagtgatatgctttttgtctatcttaattgttatggtagttacacaactatttacattgtcaaaactcatcacggacttttagtttatacaaattataactcagcaggcctgactttttaaatgaacactcatcacggacttttagtttatacaaattataactcaacagacctgactttttaaatgaacactcatcacggacttttagtttatacaaattataactcaacaggcctgactttttaaatgaacatatgtaatgggtttcacacacaatgcagactcaataaacaagccctgctcacaacttctctcaaaggagccaagcacaacaggtacttaaattaatgtcctttacattgaaaggtattatataaaaccaaagcaagcattttccatttttaacacatttctaaggcttttgcatttccataaagaaggcagtgatgactcatgatgtgattttaagaatctgaacttactaaggtcccttgaaagtaaccacaaaaaggctagatctaaaatatattaaaatccatatacaattaattgtagagtgattcatatagatacagtctctattttgtattgcttcttttttaaatagttatctgctagtgaacaaaaaaataaatatatactttttgatatttcaaatagatatcaaaaagtatatatttatagcttttgaagtataacttttaaactttatcaaatataaaagtatatattctatttgatatataggtatgtgtatgtatatatgtatatttatttgatatatatgtatttgaatagaaatagaaagtgaatactagtaacctgatggctaagaacgatcacatatttatatgtattcattcaacacatgcactgtgggttgtattctgtgccaggagatgaggatgcagggatgaataaatagtatttctgtcctcaagaagctcatactttatagtgatttagagacatgtatgatgaaattgacactctaatgtgagtctgaacaatttttaggcaagcaaatgctcttcatgcactacattccataaccaacctatgcacagcagtaagtggagtctttggggcttggtttttgttaccacgtttgttacagaatgccatatttggacctatgacaaaaaaaaaagtaatcttaagtcaggcttgcttattggagaataaaatagaatcatgaggtaggagatttggagggactctgttacagtcaaataattttattttaaggaaagcagatttactccttaacactatcttaaaatcaggagaaaatgtaagaaactttcataaaatatttaatatagtttcaaagttgtgagcgtatcactgttcagaagttaactgcaaaacagagatgactatatttgccataattatcaataatgatgtatatatatatatatactctatagttacactgggatgagcattaatggattggtaatgaatgaacaacagcaatgattcaacaacattagttggctaaagcttcacaagaataaggaaaacacagcaggaaccttatagaggtaagtgaagcatgaaattcagttacgtctttgacctaatagcattaggtcaaagcctttcaactttatctctttactaattatggaacgaaccctgtttaaactcttcataccatataattctctaagcaattcttagtggtagttattattattcacattttagcgatgagaaaattgaaatccagatagatcaagtgacttatctaagataacccaaccagtaagtggcagagatggaatttgacctcagccaatctgggtcctggtccccacccttgactctgtatgatacagtgttacaacaagagcatgggtagagatgcaattagaaggtaagaattatatctgcaaaatcttgattagtcctaacaataataatgtagtcactactgttaacccaacttgatgcaggctaatagctaaaggtcataaagtgtccaaagaaagatttagtagtaagtacaatatcccaggagaatctacctccagagtgcaagtcgttatactactcaagttgatatcttccaatgtaggtgtctaaaagccctttctagttctgaatttcactgattctaaaagggagtttgtggttagtatagctggtgggggtagacttacattgctgccaagtgcagaaatacactaaagccatgcacagcaactcaagggtcagcatttttgtcccacttctgggcatcctgaaaatcctttcttctttgagcttcctcaaaatcttgtataaactgggcttaaactaggtagatctcagctggagggaaagttctagcaggctgaggaagcctagaaagtttgcattctctaagcaatgttagcatgaactctttgtactcattacttcttagtatatggcagcagcttcagaaaggtgagtcaggaaacattcacattcccaacaattagaatgtcaccactctttgttcattcttttgaattatagtcaagaagtgtcttattaattcaacacaatgcataaatatatcttgagtatctccaatgaatcatgtactgttcaagcctctggcaatacaaacaataaaagacactcctacgtctcaaggaactatcactttgggtgacagagagagacatctaaacaaatatacttacaatgttggtaatacattcatggaggcacatgggaaggacccagaagcagaggaggttcactgtgcttggatgcagatagcaggagttaatatggaagaagtcaagaatgtcttcccagagatggtgaaaaacaaaatgagttttgaagatatgatgggaaaatacactgatttttagatatagctctagataaaaataaagagacaaagtgttacaggtaaaattagctgcagatacatcttagttgtcatgtagttgatccaattgagtgaacaattgaacaacaattagaacacaaacaaacctccatgatctgaggcctgctgaactctcttttctgacagcccttcccactgcacattggatatagaatgatgccatggcattccatgcatccatgcctttgaacacactatctcctctgcttgaatgacctttgctgcttatgtagaaggaaaaaacagttacattcatacctaaggttccagagcttccaagaccttgtcaaagaaaatagactcctagcttttctctactgaatgcaatctccgttatcaggccataagctccttaggagctagcgctagatctgagtgaacactgccagtagtgtgatgaatttggcttttataggctcaaaagaaatattgttaaatgtacaacattttttgagccatttgttaaatttttggcagcttgaagtcatctatggtgggagctgacaaacactacattaaaaaaagatcaaaaaatttgttggataaattacattagagtaatttttaaagtcacatattcaagttgtagtgatttaaattaaataaagttagtgcagattataagaattgatgagtattgaattgatgagtattggaaaaggggatgagtggagacacctctctgagcagtgtgagttttgaaaaggaaatcaaattattagagaagataatggtagccaaaaagactttctaaggatcagtgttctcataattaaaaaaaagaaggcataagaatttctgccaaacatactttttcaaaaataaaaaagatatatgaaaatgttttataaaccatgtagtacataactatataatatatacattatatagtgtatagttgcaattattggactaaaagcagttaatacaggctttacatatgttaagacttttattcagaagtaaatgaaatgtactctttgagaatgggtatattttattgttttttataaccatattctcatttatttttgaaactcttcttagaataagaaaagagtacaggaagaccaacaagtcacattcaaaccttataattctgcagcctaggaaacactgtcttgtgctggaaatggcttcctttcttcctggtccaacttttttgaactgcccatggattttgcactgtacaaatcacaatccttagaaatatattacccacatacatttctgaagagggttttcagggcccttttttgagtattacttttggatatattattcctactaaattatatttcttccagaaaaagttttgaaaagttggcaacctccctatttcagtccttcatattatgccacttgttacagtcataaacagcaaggaaagaaggaagtttgaccaaatgcaaatggctgggaagaagtagccctttcagagttgctgaatgtctcgtgtgaaaatgctttgtggctgagcttaagaaataaatataaagtagtatttaaatcctcatctcaaagcttctatcagtaatagatatgaagcccaaagcagtaaatgtttaaatgactactttacatctcttaaatgcagtgttatgtcctggctatatggtaatgacatcattaaacagaaatcctttgagccgcagaaccaagatgctttatagtaagttctatgaagttacatagtcaaagagttcactgttctttaagttagactcatatccgcaattttatgacaggttctgcttaaataattgtagggtagtggtaaagcatggactttagggtcaataatctgaagatctaaatttgaatttgtcgtgtctttcattagttagctgacattctggatttcagtttcaagacctttaaaatgggaataatagcaatcatcttaaacatgtccaagaaagagtgagacaattaaataaatacattactaagaagggctataaatgaaatgttattataggtattagcatcatcattatcattcattaccctaatcattatcatctttaagcaatattaagggatgacacttacagatagactgagtcttactctctgggtcaagaaggttatttcaaaatgcaagttactaaagtatattatatatgcaaaacatttggcttattaaaactcaagtgtcatggctcatagccgagacctgcactttcatataaatgtgatttgatcatatgtatcatattcaaaaatatctattagtcctataacgttagccacagtggctaatttctataatagcttcacattttagttacttaccaacataaatatttatttcttatttatgttacagtaaacttaagtttgcttgggtggaaggttgtctctttttcacgcaattatttagagttccaggcttcatccatctaatggctttgttaaagtctagagtcttggagtgtaccactgactccgttaatctgaccggcagataaaatagtaaagaaatcatggaagcttgcaaggaaagtacatgaaccaggcctggaagtggtatataccacttccatgaaaaatcctactggtttaaaatcggtcgcatgactgcacctaattgcaaaggaagccagaaaatgtagtccacctatatgctctgatggaagataaaatggatttgatgagtcttgccagcctctgccatagggttctagcatattacaataaattatgaatttaattgaccgaaagacaaagcgcaacttaatggtgtcacaatcccatgttagttataaaaaataatgtataatctattctcccctttatggttactgtaaaaattagtagcaccctagttaattcaatgccagaaagcagctgtcttgagagttcatggtcttaagctttacatgcctgggctctatttttggtccagtggagttggtacctctggggcctgagtaatcccgtgttgcagcagacagagttcctctgctgcagtcaggccttctcatcagtgtatacccctgtgaaacttccagactacacagaataacctggctttctctcctggatgtggatgtggacactaaatgctcttcatctgaacgaagaggtttgtgtttcataaagattaagctaactatgaggaaaaaacaggcaaccagactcttctgagattttctgtctgcatatagacatcaatataaacataggtatatgtttgttcagtatggcttttattattaacagaacaagagccagctccctgagagctacccaaggtcctaaaccacctctgatcaaagttatctcatatctagggtagcagaggactcctgatttttcagaggacctattcccgtcatatcttataaaatgtaatgattgacttcttacatacaagctgctaattttgatatggtctaagctgatatcagtttacgctgaggactttttcatatcccaacataacttgacctttcatcccatttgattgcatggtctgttcatgaccagccctgacctgtgataaccctcctttataatattctggtgttaaggatgcccaaccttgcgctaaagtaacctgatagacccagaaatgctgccagtacagctattttatcaggtgggatttagatatttatgcttctgtgatcatgtttatcaaaaattccaaaaacattttctcatgaggataacataagaaaggagggaaggggctgagcacggtggctcacgcctgtcatcccagcactttgggaggccaaggcgggcggatcacgaggtcaggagatcgagaccatcctggctaacatggtgaaaccccatctctactaaaaatacaaaaaataagccgggtgtggtggtggtcgcctgtagtcccagctactcgggaggctgaggcaggagaatggtgtgaacccgggaggcgtagcttgcagtgagccgagattgcaccactgcactccagcctgggtgacaaagcgagactgcgtctcaaaaaagaaaggagggaaaggagggaaggaaaagagggatgattgattttccctgccttactcacaggatcaaatatgataatgcagacaaaactgttgtgatgatatagagtatttttgtcatctaactcatctaactccatcaaataataggatagcttggttttgagaaaacaagtgacaaattatcatacttatttttctcatgaaatatccttcatgtgtgatctttatattctttggaaaatctaaaagacttacagttagtcaaagtaagcaccaacctaagttccaatctaatttcagaagtctgaatcattattttaattctttagggtactggaaggaatttaggttcaagatagctgtgaacaatgtgtttatatagtaaaacaagatttatttatttgttatcactaaattccatttaaattttacaatagctattattacaataacacactattaaattacaactgcatttatgtagatacaacattcctcaaaaatgttgtttggtatttaaagggcattattatgattatcagaaagaaattttgttaaattgcatttaagatatcttaaatgtttatctagttgattggttgatttattgacatgagtagaatattttaaattagtaggctacctagttaaattaatgaatttttatctttagtatcatgaatgaaaatgttgcacatgttgagaatgaatatgagacagtctttaagtcaagagcattacaatctgattgggaagattattctattgaatatcatttgtcagttactgtgaatagaatggtgaatgagacatttaatttgcatgtacttgtcatatctttcctactaggatataagcttcaagtttcagaagatgagaaatgtgtttaacatctccctctctctctttttgtacagctcttgattgtcacaaagtccgatgtgcttgtagttagcaaaaatagttggataagataaataaatgaatgaataaatacacaataacattttgtagagaggatgtaatagatcctaggaacttccatttaacctgtgaaatctctccacacatacagttcagaggcaaaatgttctggttttctaaatcctcgtgatcacatcactgttgtcagtttgccttaaagaaaaagttggaaaagctcatagaggctagttgcttttagctgtgaatctccaaatacttgaacatttcagaatgaagccaaacactgtttaaaatatcagcaagtggttatccatggatggtgggattcacggcttaatgtttgtttatgttttcatttatttattattcttttgcagaggggcacagatagatccattatttgtgacacatggtacaggcatttgaaaagattcattgatagcaacatcacagcaagtaatacagaagtccatattgtttttccatcaagagttatgctgaaactagcagagcttatgctatgaaaagccccctggtagagaacctcttcaccctaacagcctacatatgtgggaaagggaagcagggcatatctagatgagtatataattgggggagcatcttgagaaagacaatgatctttttcaaaagggccaagcctcgtgatctcagcctctggtatctgcctgttcttccaatgagttctctcaggtctgcagagctagctgcttgctcatttattgaaaaggactggaaggagcgtccagggccatctgcatttgtctctcctcacatgcatcttctaaattttccacaatcatcatgttcgtaataaaaacatataaggtgttttttgtttttacaaggtaaattaaattgtgtatgatattttttattctttaaatgtcgtacacaaatgcatcatcgcactttagccttaattggccaaccctgggtattatcctgactaacaatggaagaaattaaagaatcatgagtcttcaaagtcagcttttgaagccagcctcaacctacttaattacagttgtgcgtgtgtgtgcatgtacgttgcatattttttaatggaatcttcatactagtcatgagaatggatagtcttctatttttcttttaattttgcgtataaggagagatggagattatgatagaataaacaagttgctgaatgaaggacacacagttaagaagtgacttagtcttacctccagtgaaacctgtggaatatatatatatatatatggaatatatatacacatatatgtatactgaactttgcaacaatttacttgatttacatttggctcttttacaaaaagtcagagtgagaaagagaaaattccatagaattagaatattctaattctaatttatacaaactatcatgggtttatagcatctgaaggcacccatttgagtaggggggtgttacattgactaatattgacctatttctgagaagacatgaaagttaaagggtcaattgagtgttgttgttttcaagaccagtttagctcctcttttcattttatagtcacatttaggaattcatagcattcaaagccatgataaacagattatgcaaaagtaagtaagtggatagtgactatagttgcattttatgttaactgcatccttaaaataaacattagcatatcacagcttttctagagaataatttcagtgatttcaaattagcttgtttcagtaatttcacataatgcaacccacagagtgcagtgaaaagaacagagtgaggaccaccagacctcagcttaaaaacactcctcagctttttgttacaaaaagaggcaggtagtgtaattcttccttgtaatttctaccattcagtgcctatgtaataataaaatgagaaagaattgatagaatatgctaatccaaaaacataaaccattatctttataaggaaaattaaaatacagattagaaacaaaaaatatctctgaacaaagtcattaaaattaaaaactaatttaacaagggtttaaagatatgtaatgatatagtataaaagctaaattaaagtatctaaaagtaaacaagtgttgaaaagatctgtaactcacttattggaaatataaaactgcatcaaagcgaaaatagtgtaaatagctaatagaaaaaggaaaggtgcttaaagaaatgtaacctagaaacaaatgataaataaaatgacagcaaatatgcatcagaattaaaatacaaacaaaaatagttgaaattcgaaggtaactattttctgtactttccatctcttaacacattttcaccctctgtagggtcaaagacagaacagatataagaagagtgcgttaaaacaatttacctgttctcatagagacaggaaacagttattaaataactaaacatataaacataaaatatttgcattttatacttgttttatgtaacttaaactgtttcccatctgcctggcatggtggcgcacatctgtaattccagcactttgacaggccaagaagggcagatcatttgagcccaggagtttgagaccagcctggacaacatgacgaaaacccatctctaaaaatgcaaaaattagccgggtgaggtggcgcacacctgtgatcccagctacttggagggctgaggtgggaggattgcttgagcccaggaggtctaggctgcagtgagctgtgtttgcgtcactgcactccagtctgggtgacagaataagacgctctctctctctcctccctccccctatatatattccccatcctacctcttgctctagtcactgctgtagtgatcagtttttcccctagacagagcctccttttgtgctctgtaaatcctccaatgacccatttctgcctcctgccttggggtttctgtaaggctgtggcaagtaatgccagaaaaacctgacctgcgcatgtacaaccaaaaccagaagcacaagggagttaatgcctgtgaggctatccttgagcagtgggggttgggacctgatgtgaaaaatctgaaatatagtatatgcaggttcacagaagtcccattgggatcaagaacctcctgtagtgtcgactaacctgatcaaataacactattttggctttcttcccattcatttttgactccctcagctatcactcactttatagataaagttcagagttcaaacaagttatgtaacttactcaaggtcaccctatttgtaagaaacaacagcatctgtcctcaatgccttcctttagaactgaaggcacttaaaaatattttctacttttacctctttaaaaagaggtaggtttaaaaacctgccttctgttctttctccccattcagtgacttcaaggtatgcatgcccctgtctgatgtgaagatgtcactggcgactgcctattacataaaaccttctcaaatatgttcctataaaaaatattattccagagagcacatggttgatccaaacgggctaatctctaatgctggaattctaggtttctttgttcctgaaattggtcaagtcttttccccccaatatccataaccataatatgcagtttgtcactcagggaactccacacaggcacctatcacagtttcctggtaataaaaattaagaatatagttgctcccatcttgggttggtttcaagtacatcaatagaacaacttatagaactgtcatattttagagaaaattgcagaaagcagtgtttccagtcatttgctaactgagctagaaattataatggcatgccaaattagactgagctgtaaaaggaagatattcacattactcttctctgccctcacagtatgcataagacactgagaggcctgcaattcttattctcttaactaaacgtttttcaagtcttccccattctgggtgttgtattttgctccatttattttgccttgcatccagtcaccttgcagctgtaataacttgttggctctctagggaaagtggggttggagtcctttctggtcaccggatggttgaaggatgtgcacggctgaactgtttacccacacctcatccctcctcctgttctatttttgagaactgtgtgtttcataattttaataaaaatagagatcacactgtttatttggcagaggcgatgagaatagggcatgctttgctggattttttttttttcttgaaattttccttctcacactgctgcccggtctaaggtgagaagtggctgtttctatgtcttactgtcttaggtgtccctctgcctgctgtcacataagctgtttctggcagctctgcctgtgaccaattctgctgtctcctgctgggaggctgacacctaactggaccctttgttttccagagtggaaagaacctggtttatgcaggcaagaagatagtatcctgagaatgaaaagttagatactgtctttgagccatgtgaagtgcaaaaagacacaaacagtgaacagctcgttaaattaggaaatctaaaacacaggcctcaaatgagaagcatttgtgtccccaaatctcaactcctatgctcaggagtttcactgaagatttactgtagaggcaatgtagaggggccctgggagtttaacaatgaatataatgtagccccaccctggaaacagacagtctaagggggagctgaagactttgtacaatagattttaaattcagaatttattgtattttattaattagttttggggtctagttattccacgttaacctgtaaaagttgccttgaactataaagaggttaaataaacaactaagaggagtaacataaaatctgtattctggcagcaatggaaatgtggaagaaggtaatcacattttcttttcctgacctccagaccaagaagtaagatttaaaaatggcttgtttcagcacacacagccccgttttcattttcacctatctctggccttcttatgccaatacctcgtgcccagatactcctatttggagaacaagagcagcagcttaatcagataaaagtaatatttttcttcttctttctagcaaaacttagattctcatagagcagagtctctcagctgtgtattagggaagaaatcaactgattaagctaaattattctatagtgtgaatgactgatagaatttttgttctagaaacattagtgttttaaatataagccttcctttaactatttaccttaatgatttgtgtttggtgcaacttacttctttagaaggacacatattctcaaggactcctaaaaacacatctttgcaccctccagggtaggagaataatggatggagaaacattgctctgcctcagtgattttcgagaagcgagagaaaggtgtctgcccagatggtgaggcattttgaaatggagccatggtgtattttgaaaagaattacagcaatactgaagtgtaacatcgtgtgtagaaaatgaagcacagatatccacaattctacgatccagattctctaaagtaaaattttactttaaaaagtcattgtgaatatgtaaaaaatacagaaattatcaggtagaaaaatgtctcattaggagctcatccagaacctccaggtgttttaatcgtattaaaagtaatataaaccagtattgagcactgatctggttactggtaatttagttcatatcaaagtgaagtaaagcaaataagcaaaacaaccaaagcagtgtggtgttctggtcaaaaaagccacctgggccagcgctggctgggcctctggaaaattgggaatccatgggctctccatcattgtatagctgctgccctcaaccattctaatcacacaattggaacaatcccgacccctcccctggtgtccacggtgcttattccgcagcatattgagcctctctgtgccagacacggttttaggaactggggatacatcctcctctctctcatggggttcacatttgaaccacaggagacagacaaaaaggagtgtcagatgctgatacgcattgggaagaaaacttaagaaacagtgatgtcatagaaaatgactggggtagggtaggggattattttatttggctggtggttggagaactctgaagaggtaacatctgagcccaggttaaatgacaagtttccagccttgcaaatatcagaagaaagagcattcctggcagagagaacatcaagtgcaaaaccatgggggcaggaatgagtttagcctgttttagaaacggagagaaagccagtgtgaaccttggagtgtgaccctggagagacaggcaaaacgtggaagccatagagcttcctaatccctggttgggaaactcattttacttccaaatgcattggaaagccctggagaattttgagcagggaggtaagaacagtttatcatttttaagtataccttttataataagttaaatgctaataaaccaatgactgcttgaatattatttggattccttgagagaacacatggctaaagaacagacctgtcttgctgctctctaaagcaatgaagctgatggaaaactcagctttgctgttcagcacaccgtcaccatgccaccctttacgtgccttgagccaatgtgtgtatgtgcctctaagacttctgagaccaaaacctctctttctgcctacttagcatgcacaccacaattcctctgaagtgtctgggggctacccgctttgctgtgatcttcttttagtgtattttaatggattttagaagagtgttaaatctctgctttgtaaagccttattcctatcctcaaattatctaaattcattaccttcttgctataatagtttaattgagtataggatacaaagctaatttatttcacatttttgcttttaatagttttcacttttcttattgaaaaagtaattactgaattccaatacaataactggaaatgacttttctaataacacatattatcatgtcatcatcagaagaaaattctttgaagtaccctcaaggtagaaagccctccatatgtgttttctatgttcatatatacatatatgagtgcattttaatgatgtgctgatattctattattttgcatgtactataattaaattgaactatataaaaaatgactttttagatcatagataatcaaatacttgtttatggttcaatctaatgtaacaattttcctacattttaatattttgtttttaatttttaatatcgagaaatgccatttatactcatcctatgtttatctaaatatatgtatataaattatacttgcacactagcctagtaatttctttagaataaattctcagtagttgaattattgcacatggaaaagaacatgtacatttttttttttttccttgagacggagtctcactctgtcaccaggctggagtgcagtggcacaatctcagctcactgcaacttctgcctcctgagttcaagtgattctcctgcctcagcctcccgagtagctgggactacaggcgcccaccaccacgcccggctaattttttttgtatttttagtagagacggggtttcaccatgttggccaggagaacatgtacatttctaatgcatatatttccaaatttatcttaaacttgtttatacaatagtattataagtagtaatactggatatgattgttttaattttggccgatcttttaggtagagaaaaaaagtttactttcgtgtgcatttccttgacttaccaattaaagcacttgagcattttttataatatttttccaccacacctgtcccttcaatcttttttaacggcatcctctcacatgctgccattaattcatgtactgtgtttagcaagcaaagcattttcaggtgggggtcattcctgaggataataaagtggatgaagtaggttccatgggatgatgatatcaactccaagggttaaaaaggttcaccattatatctttggaaaattagcttgcagtttgagatttgctaaaagccagcccacaagatgaacttcaccaggctcttgtctaaatgcccatcagagacattctggaaatactgtttactgggttaaggcgttaagacatctgggttaagcgccatcactgggatagtttttctgaaaaacccaaaaacatttatgatcttctatacaaaagcaaaaacttaacaaatacatgctctcttaccagagtaacaggggaatatattttatgcctgactagagctttgcaaggttaaatagggaagaaagataaagaaaaagaacaagaactatttcccgagcaatatgagaaaacgctggcatgttggagtttagtcccatgaactcattcacagatggggccctctgtccctctctcataatcaagaaagtgatcaggaatggagaataaatgattgattctagaactgtggaggagttcacttctcagaatgcggtttctgagccagtagcatggcgtcaagatacaccccaggcctgctaattcagaatctgcattttaacaagatccccagggattcacatgcaccttagagtgtgacaagccctgatttagaagatactatttgcagagcctgaagtacgtgaggtatggaaagagagacgacagaaaaagaaatcaccaagtttcagccttctgataaataaatacattgattaataatatggtacacaaagggatggagatgggaagttaaataatgacccaaggcagtgtgatatacaacacatgagtgtgcagtcccaattccttgtgacacagagcaccagagaagaataaattccagtgagtcggattagtttgtctttgatccattcagaaatgttaaattaatgttcttgacattatgaaataaaacaacacatctcaagtgcttacaatgatgtttagcacatggtgtgcagacaaccaactttagctagtgttatggctgttattattgtcagcatctttgtcctttgtcaagtaattggactactaaaggaaacagtacatattagagaagaatattgtgctaataagtgtgaggtatgattatataaggccaccttaattactgcaagaaaaggaagagaaaaagttgtcactttaaaaagctcagcaacagaatatcccgcatcagcacttagtggatatgcttgccattaaagccatggtgtggaattcctgattactcagcttttgcaaattgaaagaataataaatagcacaaaaaggaaaatggttacttcttctaagatgtatagaaacaaacatctaattttcatgttatgcttgtttaattaggtaatttactgtaacatatatttatcagacaagagtacagataagatgaggctctttttccctttatatcatattatgagtattaatttatactgcacaaaggacttactgattcttttcatgcgcgtccgtgtgaagaggccaccaaacaggctttgtgtgagcaacatggctgtgtatttcacctgggtgcaggcgggctgagtccgaaaagagagtccgcaaagggagataaaggtggggccgttttataggatttgggtaggtaaaggaaaattacagtcaaagggggtttgttctctggcgggcaggagtgggggttcgcaaggtgctcagtgggggtgctttttgagccaggatgagccaggaaaagaactttcacaaggtactgtcatcagttaaggcaaggaccggccatttatacttcttttgtggtggaatgtcatcagttaaggtggggcagggcgtattcacttcttttgtgattcttcagttacttcaggccatctgggcgaatacgtgcaggtcacaggggatgcgatggcttggcttgggctcagaggcctgacaattctcacataatgatgttggtgattgagatttacaggcaaaagacaaaagtgtgactatagaatataagaaaaaaaagaaggggagaaagtatatatttaagaagaatgaagtgtaacactaagagacataaaaccactattctggtataaaatatagtagccaattccatattctgggagtaaagaaataaattcaaatgttaggtcataccaaacagcaaagaaggcttgtacatgtgacctaccctttctgggacttaatttctccatttctgaatagagaagccaggatcaaatacagatcacctgagaaacagtggagaagctcaatattgccatgttttgtttcaggcataggctttggagtcaggtcaactttcatctgctttgcccactgaactagcgctgtagacttgatcaaattaacttatttgcatattaataaacaaatgaatgctggaatgagtagaggaaatagtgctttgattaatttctagaaatctgcctgtctcactcaggagctgctgggtgtggaaaatgaagagaggaagtaagcgtagtgttgagttttcccaatttgtcgctcttctgaagctctctttttcacttttcgcttgggctttcacgtaaaagttggtttgaaaataagttttctctggaaaaaaaaaatcttatgtaagaagtcttcaaccttcttaaacatgacagccatccacctttattggggagaggtaggtgactgtagattgctgaatagacactgtggcttgtgttaatgactcatgaacatagttaacagggaacaaaaaggacagtgagtatttaagtggaagaaaacatcagaaacttgctactccattccaatatacataggaggtgggcatatttaatggaaaatgcaaacacgtttagcattatgactatgatttagaatgttaggaaacaatttctctgataaaatgctatatatctgtatattctaaatagttgtatcactgaatcagccttcgcacttttcttctagcatttgatggcacccaaccacgtcttcaagttgttatgcctgttttcatttctttatgagacacgaatgttggcaaaagaaattgacaattttaaattgacatagcctgtttccttggaattttagaaaattttaacctgtattgcgaattgagatttatctttggcttatatgttttttatcatagcctatgaaataaaatctattattattaatattatgaataaataaacagaaaatctttaagatagtgcatcggtgtgggaatataacgcatggagcaccatttgaacttgatgaatattagcaagtaacacaaaggttcataatggctgataatgcaggtggtaaaatgactcattttatgttatacataaggcacccctctgaagtatacccactttggaaagatacacacaatcgaattagctaagaaacctccaaatatctttctaggatttttcatctctagaaaaagtcagatattcctaagagggaaataagtagaactattctacaaaaaatagttaacacagcaggcctgagtcggatatcttcaagcctgcttgcaaggttggcccttggctgccatctgggaacatgtattttgagatagtccccatttttctctgataagaatgcctcattgcacctaaactgtttacacaaacaatattgtttaggctgaatacctactttcctctaggtatctagaattttggtagtcaaagttgggtggcaggggtgcctatgtgaccagccaccaataaaacacctgagctctcagctctaatgagcttccctagtagacaatattgtattcatgtcagaaatatttctggaacaattaagtgtgtcatatgcgatcccactgggagaggattcttagaagcttgtacctattttctttggacttcattccatgtgacttctccccttgctgattttgcttttcatcctttcactgtaataactcatagccatgaacaggactatcaaacttgggcttggtcttgtggaccaccaaggcaactgtattattgtgtgtgtgtgtgtgtgtgtgtgtgtgtgtgtgtgtgtgtttctattaatatcgttgtttatttgatgctcatattttcccagttttatcagtagaagcccctccaaggcagttcccatatccttttgacagattcccttaatttttttatgttatttgattttttaaaattatactttaagttctgggatacatgtgcagaacgtgaagccttgtcacataggtacacacgtgccatggtggttcactgcacccatcaacctgtcatctacattaggtatttctcctaatgctatccctcctctagtcccccacccccagacaagccccagtgcgtgatgttcccctccctgtgtccatgtgttctcattgttcaactcccacttatgagtgaggacatgtggtgtttggttttctgttctcgtgttagtttgctgagaatgatggtttccagttacatccatgtctctgcaaaggacatgaactcatccttttttatggctgtttttaaaatgttcacctaaaaaacagatattaatcaattgcccactgtgtatcagacagtgttctggttactggggatacagcagtgtttaaaacagaaaattcctctgccaaaactagaagatgtcatagttagtcttaatagaatgctataatgtcctaaatattgtttaggctcaaagcgcctactttggccatcggcaaattagaattatatcagcaaattaacaagatatcccctaaaatacccttgatgcatgcggagacttcctctatccatttcttataccatgttgaccccctcattctccctccccttggtgccaatttattatgaccacactatgtaatgttgcatgaattgttttgtaattactctctagtgcttcaagtgggtatatttcatcttcccagtaagtagagagcaaatacaatacctcttttatgggttattttcatcctaaggttgctcagtctggtgtcctgcagacaaagtgtgctttcaaacatttgataattttttaatgtatccaatgctctgaaactattgctgcatttctgtctttgagcatgacttttttttacctgatagccacaacaagttcatattatgttttacttttggattttcccaaaagagctatgactagaggatagcatttccacctggggctttgtctgacttgtccatgactggtaattacagtttttgtctagatgtgacttttggtccagtctctgagcctccagcaaaccatacatcttcgataagccatgatgcttagagaactcattgtttcaatcacacagccatgaaagagaaccaccgacatttgtctcaaatgaaaatggagccaaaattcataggcaaagtcactctcccacagatttcacagaacttagagattcagagaaagcgagggtgttccgttccattgtttttgcttgtttatattttccattgatccaaaaataattttagcctgagaagacaagggagatcagtgagtggcagagacattttgggggtgacgttctggcaagggaattcagactttgagaagctcatcaaaatgatttgggaaagttttgtacccaaattaacaggcaaagtgtgtctttgtcaataataggataatctatttttctactaatcaatacttgagcaaaaattatgatttcaagtactaccttattgttccagcaattctatgccattggttgagaaatgagatgcatccattttagagttgctcctacagaacaatcagtgctttcctgggttatatttataaacgcattctcagttctgtgtcaaaaatacagttttacattattttttcattcgcgttattaaacattatttaacctcagaatgatgaaatggattaataatatgtcaaggaatgatagtgtaagctctcagtacattgcgtgaggcacatatcactattaataatctagaattgtatggcagtcattaatacttttgttttaatcctgtgatgctgtcagattattttgtataccattcgtcttttactttcagggtcatgacttgaaattttttaaacttattctttacggtatattcaggtatttaaaagttcagtagaaatgggatggaaccgttaaaatgtagagctttcctctcttggataaggagacctttttccagaattctaagtgaactgctatggcatgatgaagactagcactctcaggccaggtgcagtggctcacgcctgcaatcccagcactttgggaggctgaggtggagagtttgagaccaacctagccaacatggtgaaaccccacctctactaaaaattaaaaaaaaaaaaaattagcctggcatggtggcaggcatctgtaatcccagccatttgggaggctgaggcaggagaatcgcttgaacctgggaggtggaggtttcagtgagccgagattgtgccattgcactccagcctgggcaacaagagtgaaacgtcatctctggggaaaaaaaaaaaaaggctagtgctctcaatgtgctgagtcttttgtccctgacttaatctaagtatagtgcaccgttctcaattcataagcacagttgacccttgaacaacagagttttgaactatgtgggcccacctatacgcagattttttttcaataaatatatttttaaatgtttagagatttgtgacaatttgaaaaaactcactgatgaaccacatagcctagaaatatcaaaaaataggaagaagttaggtatgtcatgaatgcataaaatgtatgtagatactagtctattttatcatttactaattaccataaaatatacacgaatctattataacaagttaaaaattatcaaaactcatggacacacacttacagaccatgcatggaaccattaacagtagagagaaatgtaaacaaacaggaagatgtaatactaaatcataactgcatacaattaagtagtatgtaactgtactactatagtaattttgtagccacctccagttgctattatggtgagttcaagtgttcctactgtccacttaaaactctgtgtgatgctaatcacctcctcctgagcagtttgtctctccagtaaattgcctagtacagtaaaaagcgatctctcacgattctcacttaattttcactgtatttagtgcaatacagtaaagcttgaataacaccatgagacccatgcaaagtgccactagtgatgctggaagtgctcccaagaagcagagaaatgtcatgacattacaagaaagagttgaatttcttggtatggactgtagattgaggtctgcagatggagttgccaccatttcagacagacaattcattttgtaaacaatgtcaacttatggtatcaataaatacagtactgtactgtaagtctattttttcttccttatgattttaacattttcttttcccttgcttactttattgtaataatatagtatataatatatatataacatacaaaatatgtgttagtcaactgttgatgttactggtaaggcttttggtcaacagtatgctattaatatttaagtttttaggaagttaaaagttgtactcagatttttgactgtgcaggaagggctggttcccctaacttccatgttatttagctgtatagcattatatgcttactgtacatattttgtatacttaccccaataggagcattttgcatgttccttttaggaaagttgtgttgactcataaccataaatggctgtttcctatgtgcaagtgatagattctcttgtgactatttctaacatggcagttcaaccaatttgactttaggtccagtgttttggccagctaaaaacaatgcctgtttaaatgtgtaactgaaggaccagagtctctgtgaagtcaccttctaaaaattaaccccttctcttggctgaaaattgtaatggagacagaaataggtagaggcttaggtggtttgatcatagaactctacttgaagagctacatagctcaacagtctagatacataagaggataaaagagaatgagaaacaaaaagcaagtcaagattagttttctatgacctcaccatgcccacaagaataccaaactggcaacagaacccagagctttccctgttttaaagttaattttaactttcaagattaatgtaaatctaggtagccaagagtctccatcctatgtccagaggaaccaagaccagaaagctgtttcagagttgaatatctgatatttagtgatgaggttgtccttgcttgagtgctggaccttagttatccctaagtttcttgtgaggcgtgtgatgtattgacaagaacttaaagatttggtcatcagggtttctaggtctaaacatgagttctaccgtttactccctgggtgatcttgggcaaggtgctgaactactgtaagcctcaattctactttttaaatgacagtcagcattaccagataacgttggagcattaacaagaatatctgtgtcaaaaagtaaggaagtagtcaataaataagtaaataggtgaggataatagtatggcaaaggggcaccagaatttctcaacaaccaatgtttgaacaactagagcagcaaaataaataacacagttctagattataatctgaagtataaatatacatgaggccatactgatgtaaagaaatgacttcataaataaatacataaaataaaagtgtcaagtcatgcttacaaggaagattccaaacaacagcgtaggtagattctgtcccctccagtacccaggagatgcgatataattcctgtgttcctttcttaacattgactggggcatgcacttagtgactcgttgtcaaagaatatagtaagaaagggggagaaagggtatttttatcgtggagaaactaggtaaatactaccttaaccaaaccaataaggattaacatctccagcatgttatgtggatatcatgggctccttgtcattctgtgaacttcccctttgagatagtctcccataacctataattccagtctaatcataagaaaaacgacagacaaacataaattgacagtctacaaagtatctaaccagtattcctcaatctgtcaaggtcccgaaaccactgaaggccagccaagtctaagtaaacatgataagaaagtgccaggtggtatccaggatggagtcccaggatgggccaaggggtggggtggggagcattcatggaaaaattagtgaaatatgaggaacacctgaagtttaaagtaatgggtcagtgttggttcttagttttgataaatgtgtcatggtaatgtaaaatgttaacattaggaaaaatcagaaggtggtatactagaaatcactgtactatttttacatcttttctgtaaatctaaagtaatcatacaatttaaaagtttattagagaagaagaataagaattggacttgtaactaaggggtgtgttgcccagtaagtgacagaaaaaaaaatcaatttgtttattcttctttttcttacccatactgagaataagggctctcaggcactgaaggctgcacatcttatgattgcatctgcatgaaggtcaataataagcagagctaaagtgcagtgctggaagccaggagggcaggcacccttaaagggcatgacagtgacaggggtgggggcacgaggaggagaatgctaaggttatagacatgccctgtttcttgctctggattctggttacatagatgtggtcacctcgtcgaaattcatcttactggaaaattaatatttcttcacttttccatttttgtgttatacttaaatttacaaaaaaataaaaaagtttatattatggggctgggcatggttgctcacgcctgtaatcccagcactttgggaggccgaggagggtggatcacctgaggtcaggagtttgagaccagcctggtcaacatggtgaaaccccgtctctactagaaatacaaaaaatagccaggcatggtggtgcacacctacaatcccagctaatcgggaagctgggtcaagagaatcgcttgaacctgagaggcggaggttgcagtgagtcgagatcgtgccattgcactccagcctgggcaacaagagcgaaactccatctcaagagaaaaaaaattaaaaagtttatattaaagaataaatgtcagagataaatggagagtacagggttgcagttcatttgaggattgcattatctctccttcctaaagttcaatttgtgtctcaactgactgcatcaaaactaaccccaacgtcttttcaaggtcatctataacacacacaatgcatgctgctcttcaagtcctaagagaaaacagaattagtagggctgccttctcattcacaggatcataccttaactattcagaaattgacagttcattgtgatcaccaccaggtgtacagtatttagactaaacagacagtaaagatacaattccaaaagcttcatgataattccattttcatgaatccatgtatgttttctttcaagtttcaattgtgtttaaattttaggctgggaaaaaatagagaaaagacatttgcctttttctgagcaatttaattatggaaagggggtactcattttttagcacaatctggttttatctgaggttcgtctgtgatcagtggcaagcaactagtttttgtttttacacagggaaaaatatggaagcagtttttgactcaaaggccctactcactttgagttggatgtcccctgagaaatacctaagaagtagctttaaaataaattggaaagcgaagtaggaaaaaggtaggggaaggaagaggagtgaatgaagagtcagcaaatgagcaggtttccatttgaaatttaaattggcagctggcactatttgaatcattcttcatttaatataatttgaatggggtagatgataatcttgcattttgagaaggcaaagcaaaaccttgaatatgaggaatgtacaaacctctgttattttgcacagctcagtttaacacacttcccttcactatgcttagaagaaaatgaggtgtaggtactttagttgtttatttcttgtcagcacaatgcataaatgatgtaagcgcaagattcgaaccacatggtatgtggctatacacgattaaatggaattattgaaacaaggggcaaaaagaaaaccttgaacttgtgattgagtgaaagggaaacatccataatgttgaaattaaggtgggattaaaagatagtcattaataacaaagttatcatgctagtagaggttgatcagttaggaacgatatgaggaaaagaaaacttaattaactacagaaatatgtaaattactttttatacattccagataatgtgttttatttttctagaacactgattttgtatacttattttaatcagcattctgaatacaaacatctcaaaaatacaaacacttcacatacgaggaatgctaaaattagactagaaaacagccacagaacaaagagaatagcacaaaagagtcttacaaggaagacattctgacagacccatgaaaatagacacagtgtcctagactggatgtattatatcatctcacatattagagaaggggactgattgttattgttcttctagagagaatgtgcattttgccagcctgatcagattttatcctcatgatgtttagaggtacatattgcttctccggttttatacatgaaataattgaagcttgaaaaagtaactttaggctcaggtagttatagaaaccatcagaatttgaacccaggtcttatgtgatcctgaagctactgcccttggttaacattttgcagacatctccattttcctcagtgacaaccaaggaaatcatatgtattagaaaaatctcagggaaattttagatatatttagaagcatgaggaaaaaaatgggaattaaaaaaaaaaaaatcacatctttacgaaaggtacagaagaatgggccgggcacggtggctcacgcctgtaatcccagcactttgggaggccgaggagggcagatcacgaggtcaggagatcgagaccatcctgactaacacggtaaaaccccgtctctactaaaaatacaaaaaattagccgggtgtggtggagggcgcctgtagtcccagctactcgggaggctgaggcaggagaatggcgtgaacccaggaggcagagattgcggtgagccgagattgtgccactgcactccagcctgggtgacagaacgagactctgtatcaaaaaaaaaaaaaaaaagaaaaaaagaaagaaagaaaggtacagaagatagaagaaaataaaacaaatgatgaatgattctaggaggtgtaactgattctaaaggagttggaaactacaggcagtgacatccggaccccaactccccttcaagagcacctctggggtgtaaaggggaaaacagacttgggaattaacctacttggggtttggagtctggctctataaaactatttgtgtgactgcctgcaacctctttgtgtttctgtttgttaatttatgaagtaggaaggataacgtctgcatcattgaagtttattgtgaatattaagttagatgatacaaataaagaactgaatatacctagaatccattaagctctcggatgttagttccttcctcatttcataatatttctcttcagtagaatacagaaaagggcccacaagggatggatgttatttgctctgcctatgataagaaagaattttagagtcttgccaattattcggcctcatgtggatcaagcacatagatattaggtctattcttttccttttttttctgtccagatgcttggattcatgtacatgaaactgcttgttgcataaggaccaaagactgaaatattaataatggaattgcattttcatgtggactcaacttatcagttcccaaatttctaccttgctgtgcgaacagagaacatgtggaaacgtctctaggtgtctgcagttcactcagtttctctaattctaattattaatatggcattagacatagaagagttaagaagctcaagaatcagtctaggattacttgcttgtcatttaatgtgtcagcctggtaaagacaaatattttatgtaaattcaacaagaagtaaaagaatataaattatctagtggccaatagcttaaatacataacctgggaatataatcagccatgagattcaggaagggtgtttcacagttgtgcataatttataatgagagggcaggtataaatataggtaataagggatgaaggtatttatacttttaaaatatttaaatgtagtttgattacatccccaaataactttttctgccctgtcatctggtgtaactaaatatagcctggcattctggtagatcggagatgtatcttctctgtggataattagcctcttgtattaaaaataaaacctataaatatcacttcattagtaggattctatcctcttccctgctctctttatgatctggaataacccacagacatttagaagtctaatggccagaacgaaataaccgaggttggttttcggggctgttgagtgttgtgggtcaataatgaaaacggactgctcctaggttttagatcaacgagctctcaagggaaataaatgaaatgaagagaccatgggagtcaggaatttgctagttgcctcatttccactttttgtatattcttcttagttttccttgtacattaaatcattatgctctcaccaaggagagaatgataagtacctgattcataagatcttcttttctaagtaagttcctaattttttcaagggtaaataataataattcaattcttcagttcttctaagcatcatctatcatgagttcaaatatggtcacattaacataaatgttcaaactatgatagctcttaaccattgaggaacttaacttttcccctggatttttttcaggagtcactgaatgaaatgagatggctgtgtccccacccaaatctcaacttgaattttatctcccagaattcctacgtgttgtacgagggactcacggggaggtacttgaatcatggtggccggtctttcccatgctattctcatgatagtgaataagtctcagagatccgatggatttatcaggggtttccacctttgcttcttccttattttctcttgtcaccaccatgtaagaagtgcctttcacctaccaccatgattctgagacctccccagccatgtggaattgtaagttcagttaaagttagtcctctatttcttccccatcttgggtatgtctttatcagcagcatgaatacagactaatacagtaaactggtaacagtagagtggggcattgcttaaaagatacccaaaaatgtggaagcaactttggaacttgggtaagaggtagaggttggaccagattggagagctcagaagaagagagaaaaatgtgggaaattttggaacttcctagagacttgttgaatggctttgcccaaaatgctgatagtgatatggacaataaggtccaggctaaggtggtctcagatggagatgaggaatttgctgggaactggagcaaaagtgactcttgttatgttttagcaaagagactggtggtattttgcccctgccctagagatccatggaattttgaacttgagaaagatgatttagggcatctggctgaagaaatttctaagcagcaaaccattcaagaggtgacttgggtactgttaaaggcattcagtttataagggaagcacagcataaaagtttggaaattttgcagcctgattatgtggatagaaaagaaaaactcattttctggggagaaattcaagctggttgcagtaatttgcataagtagcaaggagcctaatgttaatccccaagaccatggggaaaatgtctccaggccatgtcagagatcttcacagcagcccttcccatcacaggcccggaggccctggaggaaaaagtggtcttatgggccgggtccagggtccccgcgctctgtgcagcctagggacttgttgctctgtgtcccacctgctccagccattgctgaaaggggccaatgtacagcttgggctgtaggggctgtggcttcagagggtggaagccccaagccttggcagcttccatgtggtgttgaggctgtgggggcacagaagtcaagaattgaggtttgggaacctctgcttagatttcagaagatgtatggaaatgcctggatgcccagataaaagtttattggaggggtagggcccttaaggagaacctctgctagggcagtgcagaagggaaatgtggggttggagaccccacacagagtccctactgggtcactgcctggtggagctgtgagaagaaagagggccaccatcctcccagaatggtagatccaccaacagcttgcactgtgcacctgaaaagccacagacactcaatgccagcctgggaaagcagccaggaggcaggcaaagccacaggggtggagctttccaagaccatgggaacccacctcttgcatcagcgtgacctggatgtgagacctggagtcaaatgagatcattttggagctttaaaatttgactgccctgctggatttcagacttgcacgggccctgtaacccctttattttggagaatttctcccatggaaacagctacatttacccaatacacataccccatcgtaactaggaattaacaagcttgcttttgattttataggctcataggcagaagggacttgccttgtctcagatgaaactttgcactctggacttttgggttaatgctgaaatgagttaagactttgcaggactgttgggaaggcatgattggttttgaaatgtggggacatgagatttggaggggccagggcggaatgatatagtttggctgcgtccccacccaaatctcaatttgaattgtatctcccagaattcccacatgttgtgggagggacccaggggcaggtaattgaatcatgggggctgatctttcccgtgctattctcataatagtgaataagtctcacgagatctgatgggtttatcaggggtttccactttggcttcttcattattttctcttgccgccatgaagtaagaagtgcctttcacctcctgccatgattctgaggcctctgcagccatgtggacctgtaagtccaattaaacctcattttcttcccagtctcagatatgtctttattggcagcattaaaacagactgatacacaaagaatgtacatttagtagttgcccttcatgaaaactcaagagcattgcttctcaagtgctaggcattctactaccttctcctttggacacacgagtgctcttcaggaagccgctcttgtgctgaaaggtcccagagcagtactgtgaactttggggcaatggaggaggtttgggcaacttctcctcttaactaagttgttcttggttacctgtcccctgcagcagatgcttggcccagacacatagaaaacctaatataaacaaacactttcagtacttaacgctagcccttctctcatatatcaactaggtctggctaagttatgctacccacaaatctcagtggcttaaaaccaaaaaaactttgttttgttttgttttgttttttctcccacaaagtgcctctcagggcttaacaaaggagctctgcttgtgggagacactcagagaccaaagtgagtggattagctctcacctcaaattctgctgcttcctatgccagagagaaaggaaactatttcaaggacaattaaatgcttgacctgaaagtgacacattgcactttcacttacaacttattggccataattatcatatgaccccacttaggggcagggaaggtccaggaagtacaattctatcatgtaccctcatggaggggaaactggagacttttggtggacacaacaatctctttgtgaaagggctcaaaacctggctgagtgagaaccattaaaagcctatcttttttattctccatgatttccaatcccctcccacctatgcccaggcacttctatgcagaccattcctcaggaaataaacaaaattatccatctcagggaattaattgatgcaaacagataccttcagagtttctttacttttcaaattcactagcaatctaatttggactcagctaagataccttacaataacatatttttatttttgaatgatgtcgacattacaagctattttacaggctgatttgattctcatgaaaatgtttgcaactgaagctagccatgtattattttccccatttgatattataaagctacatctcagaaagtttgaatggcttgcttaacactaccaagctagttaatggtaaaatttggtttacaattttagaatccaagcctaactattcttttcttactaaaccattttgatttattctcagaaaaaggaataaattgaactatacctcagaagatacagggaagtttgcttatttcttttcattatattgcttttttgtcgtaatacctgggaatgatatgtgtcaatgtgagtcaaagaacttgttcttagatcgttatgagttatcaggaaaatattaacttgtcttaataatctgagcaagttatcaccagacttttaattttacctatttcctaaccccaaaagcacatatcagaaaaatttggcatattacaataaaaccatatgctagttggtaatattgaaatgaataataatgtcagacaatagtgtcacaatccaaccatttgcttgagtcaaaaacttataatcttccttgattctccattttttttgttgtttattgaactctccagccctatctaacccaacaggaaatcccattctctcttcttccaaaatattttaaaaccaatctcctctcaccgtctgcacagctagtacaagccgacagcatccttcccattgagtacagaatcagtcgtgaaactaatttccctacttcctcagattcttgttggagtcattttttacccagcagacagaatgatcttttcttaaacattttttaagttacgtaacataatgcacatatgagaaagtgcataaaacataaatacactgcttaactaattgttgtaaggtgaacactctagtagctattatcaatgggctcaataaatagaacattatctttacctagaagcaggagggacaggtatttctgatcaaaatcattttttcttttgtacatgtaactgtgttgatattttattgatacataatagttgtatgtatttggggggtacgtcttacattttcataacagtatgcaatgtgtaatgatcaagtcagggtaattgggatatccatcacctcaaacatttattttgtccttttgttgggaacattacaattcttctcttccagctattttgaaatatacaataaatattttttaactataatttccctgctgtgctattgaatactagaacttacttctatgtaactgtatttttgttatggtaataacttccttatttggtttatatgtactcacaaataatataaattttctaacttcttttagaattttctattaaaaaattatatcattgtttattatttttgtatctaacttattttatgatatacgtatctatgttgctgtgtgtttctgcacatagttttgttgatatagttgttccagttctctgttgctatgtaacaaaccactcctaactggcacagaaagaactgttttattatgttcatagattctgtgggttgggaattcaaacaaagtatagcttggagatttgtctctgcttcataaagcctggggtatcacctgaagaggctcagatgtctggggactagaattacctggagtcttcctcatttacatgtccagcagctgggctaaggtgacgaagcaaacactacaaatcagtgtgcctgcaagtgtctattaacataacctgggcttccttaaagcgtggtggtgtcagaggagtcaaatttcttacaagtggctcaatactccaagagaaaacgtttcagcagcgctggacagaaacacatacccttttatgaacacacgtccttttatgaatgaggacacatgacatcattttcaccaaattttgatgattagacctgccacaatcccaaatgtattcaaatggtggatccatggatccagcatattttaaacaacaaaatagtattccactgtgttaatatactataatttaattattcattctgttcttaatagatatttgagttgcttccattttgaactattatgaacaatacttctgtaaacattctttggtgtgtattctggtataggtcagcatgcatttctgaaagaaatatacataggaatataattgctaagttttagagtatgcaatattcagctttatgagataccatcaaaaggtttatcaaagtgattataccaatttacactgcccccaaacataaaagtgggaacactcttgccaacacaaactgagattttcggaatctaactttttttttttttttttgcttaatgtcccttggaaattccaatagcacttgacataaaaatgaaaccgtttaccgtggcctacagggcttagatgacctggtctctgcacttctctgtggacttatcttcaccttgccataaggctgcagcctcatgagcctcctttctagccctaaaacaagacaaactcattccccacctgggacccttgtacctgctctttcctctcctggaaagcacacatcccccaagtccaatatctgttcctcaaggaggacttgtgtgaccaccaatataaaatgcattccactccccacccctagtttctccctttaatgctattctgttttcatcagatcacataagcaccacataaaattatcttttttatatgcttgtttatttatattgtgtctattacccctagaatttatagtgtcttgaaatgtgtaaaagactgctttttgaattaatgcatttttataattaattaagtaattgagtaaacttacctagctgtgtgataataggtgttatgttttttattcttcttatgcatttatttatgtcaagcacagtgcttgggactagtggatgttcagtaatattaataattgaaataatttggctcacattaatgttgaagtggaaagaaattttgtgtcctagattggccaagttttaagatgggttgatcactctgggctctgagagattagaaagaactatgtttactcctctgtaagaaggccatttagataacccacctgactgtcctcattatcaattttctcctttttatttatttggtttctttctattgtctgttcactcaccctttgatggataatgctcaggcatcttctgcaggttagcctgacactaaaatttaactctcatatttttgaagcttcgataaaagtagtcgatgctggaaaactgtctctgacacagtgagcagctctttgttttgcagtaagtggagtctttaaaaagattgtgatttttattgtccctttctttgtgacaatcgtgtgaaagggtcagttaattatgcaaatttggaacttctgagaggaagccaattgagaagcagtgaatgaagcaacccaatcaccctggaggcagagataccccgtcctcttacttggaggctgtctcagctcaactgagtgcagtgactctttacctgcatacggcttgcgaaacccactcagagtctattcaatggatctgcagcagggtctgagaatctgcatttctaacaaatccccaggtgatgcagatgctggtggtctgagtgccacactcagagaaacactgctataagacgagctgttcttttccccctgaatatctgaatttgtcctttttgaacttccccttagaccccaaaggcctatactcaaaactccaattgtatatccagccccatcttctttttggagtgggactcccatgtctttcaatgatcactagacatttccaactaaatgagattttgacggttcatactcaatgaccttgggaaagtgccctaaaatccagcaccatttcctcttccatattttgagaaatagtgtgcctttgtttctcaagttaccaagacttaaatatttttccaccgttttacttctcgatctgaactcttggtttactttattatcataaatatgaagagtgatttctagctagagtaatagctactgatgacagatacatttatcactgtggaaaaaacacctacgtcagctctttctgaattctgacgcacagatcaaagcttggtaagtcttggtagtctgaacaagcgccttctggagaagtttaaatgtaaaacaaagatttccaagtgccatcatgggttaataattttgaatcagaaattgtgagaatgatgcccaagaatcagcatttttaataaataagccttgggccaaatttgcaagccactgacttagatcatcatacaataagatattttaatgccacttggttaagtctggaataatttaatccttcttttatacttaagggactaaatcaaaaggcacattttccagcaatattagtacttccaactcttctttttccaacagtgacttgatgtgtgtgcagatcaatgttagttttatgttactatattggtgttattttctttattccttgctgatacccactttgggactctgcatgcaaagtgcctggataatgatgtaacacagagaagggtcctcaccttgggttttcctctaagactcctctgctagcattcctcaagcttgccagagcagtttatgcacataattgatctaatctttatttatcaatgaaactagccctgcggtttttcccagaagactctttggataacacagaggcacaacagaaagggcaccatgttaaaaatagaataaataatattttacagccaaaatgattgtcaccacctgttatatctttctcatctctgggtctctcctttagatgcattttttcccagagatttcttctaaggcagaaccagcagggaagaaaacaatcaaatgctttgcagcctggagtaaactttcacaggacaggagaagatgtgagattctcagcttctcctcccaataaaaacagcagcaatggaacagcatctcatatttagatttcaacagactggagtagggacaggggacagaaattttgcaaatgatgcagcttagtcaatgaatggcaacatttcagaaagcttaaattcatatgatgagggaggagatatgtctgggaacgaaagactagggaagagtctaggtgtttattcagcatcttcactgccccatctctgcacacagtttttgctccataccttctttgccaccaacactactgcccaagtagttgcttctaccacatttaccaccaccatcacctccaccatctccactgccacaaccccaccatcagcatcaccctctccaccaccatccgttccaccatgacaataacttccaattccaactccactctcatctggactttcaaacctgccacttccatcaccatcacctcaccattatcaccactcatcccaccaccctcacccctcatgtcaccattatcacccctcaccccaccaccatcaccccttactccaccaccactacccaccaaccccagctttccagcttcctcctgctcaccttcacgttctctctgctgagcagaggagcttcttaacactggagtttaaacaattgatgaaacatcatccgtgtgttctctctacaatagagcagaaaagatacaatttcttttttggactcacatgagtaattcatatttcccatttgcctagggccaggttttcaagaacaaaagctctcaataggagaggctgtccggagaccttgtatctctgctctgtatttccatccccagcaggaatggttcggggcactgcttggctttgccctgggttacattttcctctatgcgagtttccaacctgaagtcagatctgtttaaaataaaatgaaagcctctgtcagggagaaatatcaaaggatgactcttgcctagaggtagcacctacttttaatttttaagtattttatagagaaacatgtaaatttacacaatctgcagaattgttatttgcaggaacctatggtctcttcagagggaaattagaagttagaaagtcttaagaccttggtttgctgtattttaaaaggttcagtttttcttaaaatgacggtgtgaatcttttactcaagaattgtaactaggctggtcacggtgactcatgcctgtaagcccagcgctttgggaggccaaagtggaaggactgcttgagcccaggagttcacatggcaagacctcatctctacaaaaaatttttaaaaactagctgggcatggtggaatgtgcctgtcgttccagctactcaggatgctaaggtgggaggatcacttgagcctaggagtttgagactgcagtgagctgtgattgcatcactgcactccagcctgggcaacagggtgagacattgacacacacacacacacacacacacacacacacacaattataattaaaaaaaaacgagcagtatcaatgtctttgttctcacctctgtatctctacagcttcctcctactccgactttcacctccacagtcttttgtttgtttgtttgtttgtctgtctttgtttgcttgtttgtttttgtctgtcataagcattccaagatgaaaaactgagtgcctgtcacaaaactgaaaaagttcacagctctgagctcacaaatacatggttttggggttacataggccagatatccagtttataaaacaaagaaatataggcttggctaatgcccaaggatagaacaccacccatgattccgtattttttaagatgcgatggtttccctgggcaacagtgttgaattacgtacatgcatcacgtacagctgtatacagcgtgtggtccatataaaattaagcccacgaggactgattccatacaggaagctcctcatcttcgtttccctactacatttatcataataacaattcaaatggtctggatactaaacataacaattcctgaaaggatctttcattttagactgcttgaaacaatgattttttgataatgagtgagcactctgaattgaaaatgatatacaatttactgcaaataatcatacactaaaaacatatataggaaggaaggaattaacaaactggctataaacatatttgattctcaatcctaagaggaccacaaattatatatatgaactttgatgagttgggttatctgagttttattttcttgatttgtaaacaggaataaaataccaaaattatagacaatatttgcaaagtgcttggctcctgcacgcagtaaatagtgtctctacatactttggcttgtgctcttagtctttagttccttctcaacaatcctgtgcctaagaaataggtattgctggttggtatctgctgtactgtatgatctatgttctttgctctttgtttcaaaatcttactaccttattctagtttggagtctttgtgagaggcacaggtacatggtctgataacattttgagtctttaatccaagtgcttgtcaccattgtctttggcagaagcattatgtctatggaattaaattttttttttttttcactgtacagttttagtgtaggaagggagaggaaaccactttcagtgggatcaggtttacttggcttggagaagaaactgaatgtggattcctcatcaagaatatgcttgtaacactagtaaatatttccctagtaacaatagctgggaggaggaaatcatgtttaataacttaatgccaaatagcctgtggcttacagtggcacgcatgaacacacacacacacacacacacacacacacacacacacacacacaccacgagctggccattagctcaataactgttttaaaactctattatttatctcattttagtaaatcagataatcaatatttatcgattatgttcatcaccattttggtagacactatgacggataacaaaaggtaataggcatagtctccacttggaaagccattacagtatttaacaaagcaatacaaccatttgataccaattaaaagtaagttttggtttggaatggtagtaacttccagtgacgtgagctttcagaggatggcagctagttaatatagtattctctttgaaaaagacaactgttgatgtgtggagtgttagctatgttcaaattgagaacgtgagtgaagacttattattccccttctgttaacatctcatctcttcatctttctggatcttaggcttttttttttcctcgacattagtactgtacaattgtaatatgtaatttaagatattctaatagcctcattttttaaaaagtaacaataagtatctggaattaactataatgatatattttgtttaatttgatatatcccaaatattaccatgtcagcatattgcactggcacgtttgaggcacccgatagctgcatgtggttagtggctaccgtagtagatatggtggctctcgagggtcctcatgcagtggctgcaggacctgacctgagcttcatcacatctcttattttagaaaaaaaaagctgactccattgatggacgttcagcattgtgtcaagaacagggaatttctcctgtcaaagccttctttattgtttcttcttcaatttacccacagcggtcctggctaggatcctgtcatggttctcagtccttccctctttccttcagttgctgctgttgctgtccagctgaagattaaggtagaaccaaccgtggaggagctgccatgggcttttgttgtctacgggtttggggatgggacatccagaggggcctggcaggagtttaattaggattacagatgagggagacagaggaaagcaatggcaagagaagggggcaaacctgaacagaaggttccctccacccttctgctccctctcacttcaatgctggagtaataggatctgccaaatctcactttccccacctgggatggtgttggcaggtggtagggtcaaagagtaaagagaagcgagtctcatgtgggcattttcaattccatcacatacttttacttacatttgcatacaggtcagagtcaaaaatattctattttggtacctgatctgaaattatttgtaaataagacaattaaattcatttactccaaaaccatcacctcaacatctgaagaatgcccagcattgagccaagcactcatgtactaggaaaggtaggaagtggcccccgttctcaagggtccctgtcacacattagctaggaagtttggaggggtcatcaaactgaaactttccagaaacatctgtctgcattgagggtatattcaggacagaagggttacaatcatgtctgcttcatttttacttgtatgtagtatactttttaagttgtttttcaaaaaagttagtatctaagtggacaaaattaataggagcaattataggagcataacctaggtagagctgcctaatggttgaccttctaacagtggaatttcagtcatcactaaatacgtagaagacgcattcagggaatacactgtctttctactccctcaattatgtcactgctttatctgagagcaatggagttgtgtaggctggtgcactgaaaactgtcaattgggagtcaaatatctctcatttttcaagtagtagccagcctctggggtttgagcaggtcccagttcagccacctgttttttgtttatctttggccaatcacttaaattttcttagtttttttttttttttccacttctaaaatgagactaataacttcatctagttacctatcagttgcaaagaaatgagataaaaaagctatctatgaagacacatctcctcaaatgtgtttggcatcccaacagtaaatatagatcatgttactcttgaaataaaggccaaaaaatgtcttcactccccgtgtagaataaaatgcagtctgcttattacagtcttgaccatgcacaccaagggcactgtctccagctgacactgtgcgccagtcacgttggcctctaaacatgttcctccctttgttagcccttttttgtctttggaatgttcctccccaagggcaaaggtcaacaaactttcactctaaaaggccagatagtaaatagtttcatcttgggggccatgaggtttctgtcacaactactcaactctgccatcagagaagaaaagcagccataggcaatacataaacaaatgagcaggcctctgtttctctgttccaacaaaactttatttacacaaataggtgatgggctagacttggtccatgggccaccatcgtttgctgacccctccctagaccttttcataatggcttttctgatcattttaatctcagatcaattaggatctaaggccttccttgaccactcttttgaacatctccccaccccatctcttgattgtgttgctccgttttattgttttcttattatttataacctcaattatctaatgtattcattcgcttattgatttattgtacacatccattttctgtaccaccataattctagttcgaagggcaaggtctggaagaaagtagatggtaggtgctcaataaatgatttgtttcatgtgtgaataaataattacccaaagaataaaattccagaaggaaaattctgaattttagtgataggaaggcaagaacgcttgggggtagtcagaggcacaggaagatcagaaactcctgcaaactatgagccttccatataatctttcacaaatgaagcttctaaaaagctgacctgtatgaaacaaggtagttttttattgttgttgtctgcgcatgatatagactgttaatatctcactattttctggctataaaacaagcatactgataacagtaaaaatcaaaggtataaataaccggcccattagcaggctgtatgcttggaaatggttttgagggagacttttaaaggcagcttttaataagaccagccattcattccccatgcaatcaatcagcattctcaatcaaatgccaatggcatgcctttgtggttgctactgaggatactggcaaaatgaggcagcctctgccttctcagccatcaagagtaattatgtaatgccatatagacaaagattagacctatagtgatagggggatatcagccagtgtcctggccaaaaaaaaaaaaaggctcacatgaaaggatttaaccaaagagatgttaatgaagctatgccactcttatgtacagaggtgaggatgaggctaaagaaaccattcaggagatgtgagggaccctgggtccagcaacagttggaaaccactctaacctgtaggctagaagtcttagggagaaaatgatattaccagagtccagtgagaactgatgcctgaaggaggggccagccaataggagttctggccgtagagaaatgtggctcttactagaatctcatcaagacaagctttctatacttccaccctgcctgacataacaggaagtcagagggtaagagagctggtgtatgcaattcatgggagtcgggctttcagagcaccaagtaaggtggagaaatgcatgtgacattaagaactgagaacaaaagaaacataacaggcacagtagtaagagtaggtaagccaggtgataagagagattgcattttggaagtctgtatttactccattgattttatttactttgcaatatgtgaatgcagcagaaaataagggattaaaaaagcttttagaaatgtgtattttttaatacttaaggatgtaggctagaagagttctaggattattggcagagtttatctaactcaagccaattcatgtgaagtcaaccagagtcttgaaggattagaaaatacctttctagcctgttgcctggggaagaaacattccgaactaaggataatcttttgcctgggaagaagaaaccatagagtaaaattcatcaccaagataacattgaatcttcattactgcccaaaaagagagagagagagagaaatttaacatattcctggtaatgaaggtcagtcacttataagcaataatttccttttttttgaccattatcaataaaaatgaaatctctctttagcctgccaaaagaaaaaattataaaaacaggacctgttacaggctctattacagaactttgaaactggtatcttaggactatgctctctaacagagggtcatttcttcaagtaactatatgttgaactcttattatcaaatgatgaattccagtctcccaaattactacttgcttttattaattgagttagtgatgcattacctcactttgttgcatagtttttggtccaccaagtggctgcacgaaagaaggaaatgaagtgctggggatttccttaggcgattacaagaagacaacttttaataccaaagtatttatcatttatgattttcctagttgtcttgcagtgatctaagcaacttgttttgtgatttattatagatcttatttaggtctgtttttttaaagagaagtttcaaggaaaaaggaacctctataaaataatttcagtcggtgtcgctgttcagtagatgacatctgctggaatgaatatggtctagatgctgctccatctcctttacagattgtatgcttgtctagaggatgtatgccacattttatccatgaaccttttctaccacacgcaccattctttatccccatgccccatcattacgccaatgccattccctaataaatgaatgtgaggggttttaattattttgtgccaaatttcttcaagcaactatatgttgaactcttattatcaaatgatgagtttgagtctccaaaattactacttgttttcattaattgacttagtgatacgttacctaactctgttgcatagttttggtccactaagtggctgcaggaaggaaggaaatgaagtgctgggcatttcgttaggcgattacaagaacacaacttttaataccaaagtatttatcatttatgattttcctagttctcttgcagtgagctaagcaacttgttttgtgatttatttattggaacttactaagcttttttttttttttagatagacgtttcaaggaaaaaggaagtttcataaaataatttcaatagatgtctcgttaaaattcaagttgatttcagtgctattctgacctagctaccaactagctttgagaccccaaacaagccacttaccctctgtgatcctcagttttctcatctctaaaatgagggggatgggctaagttgtccctaaagccctctaaagtgctacatgctgtaattatgagtctatgttatccccggaaatatcatgaaaaataaaaataaaattgattgagttgaaaatggtccaacagttacaaagaaatatttgacattgtaatcatgcatcagttagtttttggctctttaattttgaaagcagatgtttgattgcttgtttaaagcctgcgtaaaaaaccccaggcaaaccttgcaaaagctcaaaatattcttaagcagggatatcaattgcataatttcctagaccttgcagattggttcaaattaacccacagcatatttgaaagcctttttcttttgtgagcatctaaccaattccccattgctctcctcctgggtatctattcgttatcaaaaccggaagcacagtgtggcatccaaattggagttcagtgtcagcagaggttacatttgtacatttcccagaaaaggaacaattattgtcataggagaggattaatgtacggccattttgggtctttattataatcttttctttaagaatgaggaattggaatgttaatgtattcaataatctatgaattatacaggtatgctatagtgctttgaccttttcaacatttggtaattttgattgagtggctgttctgagcctgttctttttaacagctctattatcctgtggaaaagaggaaggctagccaaatttcaaaaacacatttatcccgaagcaagaatagagggaattagttacaatgtgccagagagagtgcaagatgacttacagaccttctctgatgtaacctcaacaacatctcatgagataatattattatcaccattttacagatgaagaaattgggacccaatgcatgcctcatgggtaagaggcagaggcaataataatcccagtactatatgatatcaacatctatacacttgcacaaaggtaagagggagaggcaattattacccctgtactatgtgataccaaattctatacacttcctactcaacaggtctttgatttttgaaagtagtaagtgtatctattaagcagtaaatacctgtaaacatcctgcattagactgttctcacactgctaatgaagacatacctgagacagggtaatttataaaggaaagaagtttaattgactcacagtgcagcatggctggggaggcctcaggaaattaaaaatcctgttggaaggcaccacttcacagggcatcaggagatggaacgagtgctgaggggaaggggaagccctctatataaaaccatcagaccttgtgagaactcactcactatcacaagaacagcatgggggaactgcccccgtaatctaatcacctcccatgagttcccttcgacaaaacatggggattatgggaactacaactggcgatgagatttgggtgggtgcacagccaaaccatatcattcttcccctggaccctcccaaatctcatgtcctcacatttcaaaatgatatgtctccgatgagtggaggaacacccggttcttcatcttcagtcaaattagataaaacaacatggatacacatggaatggttttgagaagtggagagtttaatatgcaagaaggaagtggggagaaagaaagaagcagatccctggtacacagacagagggagggggcctccaaagccaaaagagggaacttcaagtgccaaggataccagccagttttatgagtaggctggaggaggtggtgtctgatttgcatagggctcacgggattggtttcaccaggtatgtcgttcacatagcccgtgaaaaagctggccctcccaccctagcctgttgatatgcaaatgcagggcaccatgatgttctacacactggggatatgtgggggtggctatgctgctaggcatatgtgagggcaaggataagaggacaatggtggtgagaattgccatgtttgatggactcagtttctaatggctggcatttgcacatcaaagattgcctgccaggctctaaaagtgggggttttccttctagacaagaagcatttttgcagctgctttaaaagaaacgaaaactttttctatctgcctaaaataatttcttaataactcctaccacaaaaacacaaccccactttcccaacagtcccacaaagtcttaagtcattccagcattaactcaaaagttcgagtccaaagtctcatctgaggcaaagcaagtcccttccacctatgagtctaaaacaaaaaggaagttagttacttcctagatacaatggggtacaggcattggttaaatacatcctttccaaatgggagaaattggccaaaacaaaggggctacaagctccatgcaagtccaaaatccaatagggtagtaattaaatcttaaagttccaaagatgatgtcttttgactccatgtctcacttcttctgagtcatgctggtgtaagaagttggctcccacagccttaggcagctccacccctgtggttttgcagagtacagctcccctcttggctgctttcatgggctggagttgagtgtctgtgaattttccaggtacatggtgcaagctgttagtgaatctacaattctggggtcaggaggatggtggccctcttctcacagctctactaggtccaccaggcagtgcccagtggggactctgtgtgagggctcccaccacccattttccttccacactgccctagcagaggttctccatgacggctttgcccctgcagcagactttgcccctgaacatccagatgtttttttacatcctctgaaatctaggcggaggttcccaaacctcagttcatgactttggtgcacccacaggctcaacagcacttggaaggtgccaaaccttgaggcttgcactctgaagccatgacccaatctgtaccttggccccttttagccacaaatggagcgaccgagacacaggacaccaagtccctaggctgcacacagcagggggcccagggcctggcccatgagaccattttttcctcttagcctctcagcctgtaatgggaggggctgccacaaaggtctctgacatgccctgaagacattttccccgttgtcttggtgattagcatgtggctccttgtttcttatgcaaattactgtagcagggttgaatttctccccagaaaattggttttgcttttgtattgcattgccaggctgcaaattttccaaacttttttttttttaatgctttaagttctagggtacatttgcacaatgtgcaagttcgttacatatgtatacatgcgccatgttatgctctgcttcctcttgaatactttgctgcttagaaatttcttctgccagatactctaaatcatctctctcaagttcaaacttccacaaatctctaggacacgggcaaaatgccaccagtctctttgcagagcaagaatgacatttactctagttctcaacaagttcctcatctccatctgagaccacctcagcctggactttactgttcatatctctgtcagcattttggccaaagccactcaacaagactctaggaagtttcaaattttctcacattttcctatcttcttctgagtcctccaaactgttccaccctctgcctgttatccagttccaaagctgtttccatgttttcaggtatctttacagcagcaccctactctaccggtaccaatttactgtattacttctcacattgctaataaagacatacccaagactgggtaatttataaaggaaagatgtttaactgactcacagttcagcatggctggggaggcctcaggaaagttacaatcctgggggaagggaactctttgcagggaggcagaaaagagaatgagtgccaaacaaaacgggaagccctttgtaaaaccatcagatctcatgaaaactctgtcatgagaacagcatgggagaaccacccccataatctaatcaccccccacgaagtccctcaagcaaaacatgggaattatgggaaatgtaattcaagatgagatctgggtggaggcacagccaaaacatatcccatcttaaaattttatcttattccacattgagctttcaagcatttattagtacttatgatgccctgtaaccttctgtagctggtagaatgatgaaaaagaccaaaattccccaccccaaaggagattagagctgcggagtatattgactcagggttatgggaacacaaaagagatggtgaagcacccagagatgagtgattctggtgaactggtatgtaacacttctgctcagagcataaggaacagtggaaggaaacagtgttaccagggccatatggaaatttgaacagtggatgtaggactacccagtaggagctacttccaaaaatggtatgctatggctagaaaggagggaaataaaataacccattctctctgttgttctctgttctcttaccagtgtcccccattagctgaatccagccagatgtcagccatcacaaaaactcagtctctaagggtttcactcagagcagggcaaggatggatggaaagggactgggaggaaggcatgtagaatcatcaacagaagggctttccaaaactaaagaataatgtggcttgaagataaagtcacatctccatttctttcaaaacagagtaccagcaatttttaattgattttttcctcagcttctacttaccaaaattctctggagttttaaccagagtagtcttatgtgtggaatgaagaggggaataaatggtaccaaggataataggatgagctcaaatcagtctgtgcttatgaccttagtgttaatactgtgaaatgaaagaaatatcgtcatttctcattttggtgtagagatgctaattctacactcctcttcaaattactgagataatagtatgtgactgatgatgaattcctagataacactgggctgtgtgcctttgaaatattgagagaaaaactcatgatattgatagtccattagactagaagatgagatttcaaaatgacaatggtaatgagggttcgtttttggcaaccaccttgattcagttctataaaaggcaaagaaataaatacatgactcccctgagtgacatttagacaaaaggtggttctgtgccattgtcggatagctttcaaaatcaatggattcagcaagttttgttcatttcagatatttggtacatcagagttccatgttagtttttttttttattttaagatttaattattagaaataaatgtacttagaatattggagacaggaaagaatattaggaaattttgttattgctaggaagaatctaaaaatagcgttaattgattaaaaagtgaattattgtgttagaaactttgtcttttaacaattacaaaccaaaattctaaaggaatatctaaaaagcttatgtaataaagtttcagaagactaggaaaaatagccttataagctctagatcctctctaacagagatactgttgtaggtaaaggagacacatgctccaataataagatgaaaccctggtaaccctggagtggcatcctctagcaaacaggagagtaggctttggtttgattcactcaacaagtgctcattgagaatcttctccgtgcagttaactcaatgctgtggaaggtataaagctatcataatatcagctgtagacaaatgaaaaggaatgcagttatcaagaacttcagagaagtgcactttttgctgagagctttggtaacctcatctgtcagtgtaaaatcaatcagggatcttccctgtaggctccgagagtgactatatatttctcccttcaaaatgttttatccaagataattagtttaacatttaatatctgggacttcctcacaggaggaaaatgtcatgaaagaggaaagcattggaatctagaaagtgataatataaaagttgaaagaggcatatttagtctgctttgcctttgagaggaattgtatgcctgttgagttctatttcttttaccttcatgtgctggctggctgagtcactgggcaactgggacccagggtgtccacctgaccaggtataatttcaatcatgcatacagttgtcccaggattttcttgggttatagaatattttctaaacataaagaagctatctctcttgcttctctcccgaagaattactttcttatcagcttaggcataaaccgaaaggatgctcaattatatgtgcataaaataatgattcattgaagcattctatgaattttatgttcccccccaactccaaacacagacccagaatttgagataaagagacatatgcaatttaatattatttaatgcgtgacgagtctgatggaatagatattcaactcagtgaccttgaagtatagagtggctagtatgaacagtttgcatgctacactgtatagcctaaataacagagggcataataaagtaaaaactgtaaggttgtgatcagcttctactggtgagggagagagatgattaatggtgtaacgaagaaattatcatggtgtttctattttctacaaagctgttttcagcttcaaattagaagttactctttttgccaaaaagagtggggtataaaccacattccaattgctgcaataattctgacaaactcaaaggcagatagcaaagcatctggaaatgggcagatcaaaatgttgtcttgaaaaatagaaaaacaacctttccaatggaaaaatacctggtttgtagcattttgcagcatatgtaatgtatagagtaaaatgtatgccctgggtagctaagaagagaataaaaatgaattaggagaacctaaataataaaataatgttgttttcataattatatataatgggaacaatttatttactgacttcactgaaacatgatgtttcagagcttttaatcggcttgtgaaatgttagaattatttctgtctcaaaatatgtaaaagtatggtggaggagaaatagtaataccttttcctcacccagggacctatggaaaaggtcatgcctgacacctctaatccaaaagatagactggcaaattaaaagcataaaaagtttatttatcaaaatttcatgtggcatgggagcttttggaattaaagttgcaaagggccagagaaaattttttattttttttgagatggagtctcctctgtcacccaggctagcgtgcaatgtcatgacctcagctccctgcaacctccgcctcccaggttcaagtgattcttctgcctcagcctcccagctagctgggattacaggagcataaccccatgcctggctaatttttgtatttttagtagagatggggttcaccatattggccaggctggtcccatcctcttggccttgtgatctgcctgcctcggcctcccaaagtgctgggattacaggcgtgagccaccgtgctgggccaagaagactatttttattgctaagtctgatgaaagaaatggatagttgtagagaaacatgattggataacaggagtatgatctaatggtaatgaactggagacaacttcgcaaggccagattcttctctgtgtttctgtaagccattcattgcccctgggtatcaggaagcacatctgtcacatgaggatctgggaggtggtgaacgtcagagagtgatttttctaggttttatggcttgtttgggggtcaggagggggcgatttctcattcctgtgacctgcttgggggagaaaaggatgttaagttctcttatgggagtttgcagatactgttttgactctgaatatagagactttataactaagccatggtcctcaaatcaaaagtaatccgtatgtggtaatctggagaggtgtgtaataattattcttgtagattcagaccatcctaaccataatcaatgctgggcaggtaataggagatgttttatggcaaatgattcagtcaatgttccaattattgaagctctatgtaggagaaagacaactgtagatactggtttgtctatagatccattgaaaaaaactggggtactgacttgttgaccatgactcatggggacaagaccacaactgcagcttagtatctaattatggccataagccaccaactacttaataattgtctatatctagtaaatatggcatatatgtttacggtatatacctggactcctagtattctctttgagccacttttttgatttattaattgttacttgctttgtgtgtgtgtgtgtttgtgtgtgcatgcatgtgtgtgtgcatgtacaagtgtttaatccattagtctcttagcatataaaaatgtttttcttgtaaaaagatgcctacctatttagcctgtgcagtggaggaagctgggggaggtagatcaagtacaactgagaattttgtgaggattcaaaggctcaacatttttacttccttgtgagcctttctgccttgcaaaggtcaacacactcacgtctcttccccctccagcaatagtgttttcagatatgagcaaaatattttacctcaagtttcaccattttctttttttacaataacagaaagcagatttttattcagagtacacttacagtggctttgtttttcttgctttgtagaaaaaaacagcatttatttatttattcattttgttgttgtcagagtcaaaatgtaaatttcttcttccatttactttgacattgcactgtatatgtactatttttgaaaagagtggcatattctgtgaacaggtctttcagagacaaaggaaataaaacatggagaacaatgcaagtttcatcctctgataatgggtagatggtctacggccataccaccctgaacactccccgtctcgtctgataatgggtagatgttctcaaaaggcaaagtatatgaaaaactttaatgtaagaagaacataacataacttttatatacaattatataattcaacataacgttaatcatcattttattagcacttttttatcattgttagatatagaaacatagatgcattaatatatacataaacatgacatatttctacatgcacacaaatatggagttaacgtttatttagaatctactaatatgcttgtggtagaactacaaagatgaattatatgaaaatcttatagtttagatggaggtaacttaaactacacataaaattcctggaatagcgccttccatgaacaaggcactcaaggaaaatttgtgcaataaatgaatacataaaacaacacaagtacaaagcagcatgtgctgtttggtaagctaaaatgcaccagaaggttcaagagttaaaagacatagaagaagcctgaaggcaatgaaactattgatgtatttgcagagaagttagtcattgaagtgtccaagcaggcaggtgcacatgcactgggatgcagctatgcaggttggaggaggcaggctccgcagatagggagagaagaaagcggtgtatctgattttcttttcttttctgtttttggagagagatattgaaaatgaataaacagtccagggcatagaaaagtttgtgcaataggggaaaataaagtaaattcaagggaaaataatagtctaaggtctcctataaaaatagtctagttactaggccaggtgcggtggctcaggcctgtaatcccagcattttgggagaccgaggagagtggatcacgaggtcaggagttcaagaccaccctggccaagatggtgaaaccccatctctactaaaaaactacaaaaattagccaggcactgtagcaggcaactgtaatctcagctactcgggaggctgaagaaggagaactgcttgaaccgggggcagcagaggtagcagtgagccaagatcgagccactgcactccagcctgggcgacagagtgagactccatctcaaaaataaataaataaataaatataaatagactagttactgatgagtatagctatttacaaagggacacataagacgtttttgtcttttttttttttaattttttttttttgagacagagtgtcgctcttgtcacccaggctggagtgcaatggcaagacctcggctcactgcaacctccgcctcccaggttcaagcaattctcccgcctaagcctcacaggcgcctgccactacactcagctaattttttttttttttgtatttttggtagagatgggttttcgccatgttggccaggctggtctcgaatgcctgacctcaggtggtcctcccgtctcagcctcccaaagtgctcggattacaggcgtgagccaccgtgcctggccggacgtttttttttaagagaaggacagaagtcaagttatgtatcttcttaaatagggaaatacattttacttcctctaccattattactattttttcaaggttcctaaaatagttgtcattttacataacgttttcaaacatctgtgacagatcttgaaagcgtcactatgcgtttccttaaaagaacacccatttcagaacccgtgtcgtctctttttcttccttttccacttccacgtccatgcgatcaagttgggttcaagctgccgctgcggcctgtcttgaacccacccattttcctctaagctctgctgccctgggcctactgactcctgtcctctcactgtccttactgctgtcctctcctgggctgatggccgaaaacgcctccctcacgggctcctcaccctaagtaggtaggtctctcccaccttccatctaattttcacagtcccatcagaattttctttataaaggctggtatggctacctaagttcccgttattgcccagaagataatcccaaactgcctaatatggtattgatagctctcaaaatggggccatcgagtaccccccttacactatctcccattcgtttatcccatctacaccgagattcagtcaacctgctttgcttttcccaaatagtcaaagatgacgcatgtttcccatcctctgttctgtgctgttcattcaagttttttccttgcctggagtatcctcctttctttcttttagtcagaaaagttctattcacatttcaagatccataaaatgtcacgttctgtttactcacttattgtaaaaacgtgtactctcttaacttcgcctttctatttatacacaacttacatgtacgtaaatgtgccttctcccctccccgttacacccagcacacatattgcctagcacacagtaggttcataagaactgttgaatgaaattttcaaatcgaagcagatataacaacctcttattttttttaaaaccacttttgtcaatttattcagcctaatgaatatttttctatatatctgccatatgtatagaaaagtttatacatagtttctttatcaggcctaacagaataacttttactgtattaaatagtaacttactcaacttgtcaaactggagaggcaattgatttgagtattaggtctttacattgcatcaaccaagttgattagtcatttttaaatttatcattagttaacattaaaaaaaaagttaaaaacaagcattgctcaagcccccttgtttcgtgtttggcacactgcatagcttttaataaaaagttatttttcaacctgcagtggaatatttaaacatccatgcaaagattttttttttttttttttttttttttttttttttttgctaaattttcaaagaacatcagaaatgttgtattaaaaaacagatgatggggcagtaaagacttttttatttggtagtagaaacatatggggaaataaaatgtattaatgttgtaattataacattccaatgtttctgctttctcaagtttttatactaaaaatctttcaatagaacataactttaaagatagttttctttatactaggttcatgcatttgtgtcccatatttcaccataagggatatttgtaatatatttctggaatgggaaatgggtcaactatctagctgtccagtatttcacatttatgaacagaacccccaaactgaaaattagccttgggtgtttcataacttaggaccaactcagaaatgtaggctttggaaagcaaataactgtgatccaattttcgggaagcaggtttgtcttttatggcaaagaagagtgatcccagttttaattacaggcattgagtgtccctagccaaaactcagtctgaggtgtttcagcatggaagatcatttgggaaagctgggtttgcagaaagcacgagcaataaagacataacatataaacagatattctgcacgtagtttgcaaaatcttaacctcatcaaaagaagagatcaaaattctatttaatgcaattggagattaagttgcagagtacaatttaactgaaatacagtaccacattcatacttcaaatggtttatcaaaagaaagactaaaaaagactggttatgtgtctatataaggtttgctcttctctttctctctctttaattaaaaaaaatatatatatatataatatatatgtatatatataaccaaggcaaaaagtaagaggttgatgctctctgtccaaacctctcttctctctctttttttaaatatgtgcttaatatattcctatcttcccaatattttaattaagaacaatgtttgcacacatttaaatgagtgacatctttgcttaaatttgtttttgactaattattttccacgtgttttcaccttccaacactaccttagtcctaagttatgaaatactcaatgctcttcataaaatatcttgaaataactttttatttcaaaattaaaattaaatcacataaaagtatgttcttaaatagactatagttttcttagatcttgttgagattaaaaacaagtgtgatctggccctggccgggggtggtggctcacgcctgtaatcccagcacttttggaggccgaggcaggtggatcaggaggtcaggagatcgagaccatcctggctaacacggtgaaacaccgcctctactaaaaactacaaaaaaattagccgggcgtgttggtgggttcctgtagtcccagctactcaggaggctgaggcaggagaaatgcttgaatccaagagttcgaggttgcagtgagccgagatcgcaccactccactccagcctggcgacagagcgagactccgtctcaaaataaataaataaataaatgaataaataaacaaattacctttaacttagtatgaccattttggattgctgtaaaatattccataaaatagtaagagccttcaaatgtaacttagagtaaatgggcaaatattatttttcctatttacagagatatctaatagcccaaacaaatatttgaaatcaaagttatatttgaatgcatttctgaatagatgaagggataaacagatagtaatataaaggagttctgcaatgctatgtctatagacctcatgccaaaaatggggacatgagtcaagtctacctaacatgtttctattttctaaaaaaaaaaatttaagtactttaaatgcttatgctttgaataagaataattgccatttcaaaaaatgtaactaaatatgtatgcatgcatctgtgtgtatacagagacaagcagtgatttataattttgagaaatacgatattctgattctgattaaaatagctaaaattcacaaattcaaagttgtgaaactaaaaaagaaatttttttagacttgtggattaaaatcttggcattctactcatttaactgtatttatctatggcattttcatttggcataattttcatatattttgtaataatatcacattggctgcataatatgaagtcccttgaaagaaactagatttcaattctgtggaagaaataatttatgatgtaagagttgtgattatacagccaatatgagttaattctttaaaaaaaaaaactaaattgatcaagcaaaaaaatgtactcacttgtttgagaatgtcaatcattttcaattaaattatctagatgtttcccaggtttcagctgatatatttttcttaggaaataatattttatctcattaaattatttctcttgaatacaaaaaatctttatttagccatcagaccaaaaataaataaataaatagggacagctcagaaggagtgagcatagttctttctcttccaaacatacaggtggaacgtatagtgctaacagggaatattctgtgacatcataattttgggcactgaattttgattgcagtgtgttcttcagagtcaggcacctccaagtctgcctcttaatactgccagctgatgcctctaagcctcagttttcacatcagccaatgtgaccactattacatacgtcattgtgctactgtcaggatgacataaagatgctgcatagaacacgtttagcccaaagcctggcacgtgataagaatacaataaactatacctatagtcagggcaacagaaagacaagaattgatatggtcaaaatcataaaccctctttttgtcctacggaaggcacaggcaagaatttggatgacacatggtggtgcttctgcccttactagtgacctaaaaccaatctgccaaagtataatgattgagttttgcagaactgttgctaagagatatataggtgtatatgtacatgtatacgtatataaacatatacacacacctatgtatatataagccatatctacacacctatgtatatataagccatatctacgcacctatgtatatataagccatatctacgcacctatgtatatataagccatatctacgcacctatgtatatataagccatatctacacacctatgtatatataagccatatctacacacctatgtatatatataggccatatctacacacctatgtatatataagacatatctacacacctatgtatatataagccatgtctacacacctatgtatatataagccatgtctacacacctatgtatataaaagacatgtctacacacctatgtatataaaagacatatctacacacctatgtatatataagccatatctacacacctatgtatatataagccatatctacacacctatgtacatatcagccatatctacacacctatgtatatataagccatatctacgcacctatgtatatataagacatatctacgcacctatgtatatataagccatatctacgcacctatgtatatataagccatatctacgcacctatgtatatataagccatatctaagcacctatgtatatataagccatatctacacacctatgtatatatataggccatatctacacacctatgtatatataagacatatctacacacctatgtatatataagccatgtctacgcacctatgtatatataagccatgtctacgcacctatgtatatataagccatgtctacacacctatgtatatataagccatgtctacacacctatgtatatataagccatgtctacacacctatgtatataaaagacatatctacacaactatgtatatataagccatatctacacacctatgtatatataagccatatctacacacctatgtatatataagccatatctacacacctatgtatataaaagacatatctacacacctatgtatataaaagacatatctacacacctatgtacatatcagccatatctacacacctatgtatatataagccatatctacacacctatgtatatataagccatatctacacacctatgtatatataagacatatctacacacctatgtatatataagccatatctacacacctatgtatatataggacatatctacatacctatgtatatataggacatatctacacacctatgtgtatataggacatatctacacacctatgtatatatataggccatatctacacacctatgtatatataagacatatctacacacctatgtatatataagccatatctacacacctatgtatatataagacatatctacacacctatttatatataagccatatttacacacctatgtatatataagacatatctacacacctatgtatatataagacatatacccacagcgattttctatcacgttcgtttttaatcaaataatattagtcaaaaataaatacgtgtttgttttattattcctttgcttagttcctgccagtactagctggcttttctagtggaaggctgatcactttttccataaatccatttaatccaatcagtcttggcaggattgagacatgttctcagtggaggtcaagatcttgtttcctggtcactaagagcatgggataatagtaaactccagaaccatttgtaaaatactgtcagtcagacaaatccaaatacctgtcatgtgcccagtaagttattgaactttaagagaataaagtatgacccttattattgtgtttctaatcttctcagaaagggaaaaaagactatatataattagtgctcagctgtacaattcagcatataagtagaaattatttcactatgaaatcagataattgagacaaaattttagattgagtgagtaataatagccttatcttcttttgccctttatcctcttcccacatttaaactaggaagagaaatgaaacaagtcacctgtggatgttattggagagtattggatatgattctttgctcttacctggtgctctttcaccccacccctaactttctccttaactctctggcaattccatgcaaggccacctaaaatacccctttctcaataaagattttcctgaattcccacctaaaaataatttcttccttctctgcctttcatagcactttatgtgtgctgctccatttgtgacccatgtgtattctgttttagttatttatcaggggaaattcagccagatatcgggcaaaattcaccctcgatatttcatgtaggttcttttctgttttccctaagcattggccagtttgggaaataaagggacagagtacaaaagagagaaattttaaagctgggcttccgggggagaaatcacatttcgggaggttctgtgatgccccacaagccgcaaaaccagcaagtttttattagtgattttcaaaggggagggagtgtacgaatagcgtgtgggtcacaagagatcacgtggttcacaaggtaatagaatatcactaggaaaatggaggcagggcgagatcacaggaccacaggactggggcgaaatttaaattgctaatgaagtttcgggcacccattgtcattgataacttcttatcaggggacagggtttgagagcagacaaccggtctgaccaaaaatgtattaggcgggaatttcctcgtcctaataaacctgtgagcactatgggagactggggcttatttcatccctacagctccataaaagatggccgcacccaagggggccaatttagagacccacctcagtgatgcattctctttctcaaggatgttccttgctgagaaaaataattcagtgatatttctcccatttgcttttgaaagaagagaaatatggctctgttccacccggtcactggtggtcagagtttaaggttatctctcttgttccctgaacattgctgttatcctgttcttttttcaaggtgcccagatttcatattgttcaaacacacatgctctaaaatttgtggagttaatgcaatcatcacagggtcatgaggtgacatacatcctcctcagtttacaagatgacaggattaagagattaaagtaaagacaggcataggaaatcacaagggtattgattggggaagtgataagtgtccatgaaatcttcacaatctatgttcagagattgcagtaaagacaggcataagaaattataaaagtattaatttggggaactaataaatgtacatgaaatcttcacaatccacgttcttctgccatgtcttcagccggtccctccgttccgggtccctgacttcccgcaacagctatttcataatattagggattgtatggctattcagacgtccttcttgagggcaggctctttatcttttcctcacaacagttagcagtgtcatggagatagcaagtattttatagaaaatattgagtgagtccatgaatacgttttaattatttgggtacttaaatgtagaaggttagttgctttaactgtgcttatacaatggaaaccctgttctctgtcaaaaaaaaaaatgtgaagatcttgaaaaatgtggagaaactggggagcagctaagtggctctgaactagtcagattaggctcatctatgctgtagtaacaaacaagcccctaaacctcaatggcaattgatatttatttctcatgtgatctgcctcacaaatcattgcaggaaataatgttaccaatgttttggctcttcataaaacattcattattttctctgtcttttatatagttttctcacccacctctgctcagcccctgtgacaatgtccatctattgcaggtggtggatacaacagcagcccacttatggtatcagtttatgtttcagtcagagtagaataagctatgctgtggaagaaaataaatgctaaaatttcactggcataacaaattaatggttaatttctcaatcatgcaagtccaatgaaagtgtactaggtggcttttctccatcttgtggctgtgccatctgaagaatgtgaccttaagatcaccacacatggaaggaaagacctgaaggaccatgtgaataaagggccagattggtctgtggccatatcacctccactaaatccattgccctcaatccagtcacatgcatcctaacctcaaggaaaactggagaagcacatggatggatacctggtgagaactaatagcatatgccacagattctatagtggcattagaagttcacctaattcttaagtcttgtttttatttattttattatttatttattttttgagatagagtcttcctctgtcacccaggctggagtgcagtgtcacttggctcactgcaactgccacctcccggatttgagcgaccctcccacctcagccttggagtacttaggattacagctgtgagctaccacgcctagctaatttttttggatttttagtagagatgggatttcaccatgttggtaaagttggtcttgaacttctgacctcggtctcccaaagtactgggattacaggtatgagccactgtgccccgccctaatttttaaatttcaaattttaaatttttaaattttaaagtctgatttttaaaataccgaaaggtataccctccaatttctccctaggaatatgccctgtgttagtccagaagatgctgaaggcatatttgaggggttaccatgggggcattctttcatctgatcactgcagatttctccttaactctgtcatgtctcatcagtgtagactgacccacacttttccacaccatttacctctctggattggattgactattctttatctcatttttaacctctcctcatctgtcttcatggagatgtagttttgtgttttaacatctctaagaatatgttttgttaatgtaaattatattttacatatcctctgtactctattttatgtatcatatcctctgttttttaatattatgatgcatactataatgcctcttacatgatctaattatagaattttgacaagtacactattgaaaatcagcctcataattaacagatattactttattttgctgcaattaattgttgcctgctttatcttagcaattatttcttggatggcagaattggataatctgtgttgccacatgggaatatctatgtaaatggcaattaaatacatcctattaaagtatggtgtgaaagagatagatttaagttgggaaataacttccctgtgaccttagagagtttctggattgatcatcagataagtctacaacagatgccaaagaaggtagtatcagtttaagagatttcattcagctaaacacatataataaggaagactatttccaggagctactatgtacattaaattctattagtgatcatcaacaaaatttattaacataaaaataataaagccatctgaagaataattactgcctattgggagaaaaaaatagaaccatgaagaaaataaactctgccaacttagtgattttcgttaagtaaccaaacatttctactttgtgtcttccaaggaaattctttcacttatcaagtgttatacatattctttgttctaaaactgctctattcagctgtcattctatgattttgttttcaaggttgccccttctcttcttactcattttaattcttttctctttgtacttagattaaaataaagtcaattttaggactgtgaggtaagaaaggaagaatttgaaagatgcaacgtccttgtttatagtagatatttcaaagaaaaaatgtaaaattctcgttaatctaagaagactcagagaatatacaagatttaaagaactatctttaataaactattgggtagcattgcacactcagggcttacaactgaaaaaagaatctggcaattttatgcatgaaaaaagcaagagtaaactaatggtctatatagcatttcaggaggtgggacggttctttccaggttcatgtaaagctgaattggggtaatatctctcccctccacaaacatccccactgggccttcacaaagcctgtgaaacagcaaacagttgttttcctaagtaaatcagtatgcagtatcaattttaatgaaatcctttaaaaatatttataagacatactttgtgagctggctcttgaaaagtgattagggattgaatatgtggagagaagatttttcattttgttttatgtttttgaaaactaatgagaacaatgtttgaaaggaagaaggagtaaggtcagcagagtgggaagataaggcaacccaaaactcatcaaagagctaagcaaatggagggcgaggggcattccgtttggcctgttctcttggataatttatgaagttcaagtcacagaactgggaataaactcccaaattttcaggttctgtgacccattcgcttttcactctgctcctctcctgcgaactaaaaagacctcgaattttaaaatataatcaaaaccccccaaaacttaagaaagtgtattctcctttcagccatttaaaataggaaaacaatgaaaagaaagcctcccttaaaatctgaacattcaaagctttcagttaaatttatagatttattcaagaagagttgtcattctattaagttagaagttgactgttgtactgcctcctccaactgtatttgattccagaagtcacagagtatttacactttgtggttcttctttctgtcgctaatccacataagagagatacgtattgtcactctattaaacaacttatttgtggtttgactgtgattttccctgaaccttatatgtgtttcctttcattatggttagaatcttgggcagatggattttttcttatccatccctgcctctgttccacaggcacacaatatcatccttacatatgtaaatcacattaaactggcaagcttccctaccagactggaccctgcagggagcagggtatgtgccatgcttatttctgtgtccctcactaaacctaacacaggatcacacagtagagattcaacagaaatttttgaatatgtattatgttttttaaaccacattgaatttaagtaattgcttattatgaaaacaataactattaattacagatagttgcacaccaaaaagggaaaaagcaatcttttcaaaactgtcgtatgactaaattaaagtcctaatctattttccccttcatgttggtttgtagatgtattctcagatcaaatactattgagattcaggaaagcttgtgtttggcaaggtgaatcattgactgcatagggctggcagccaaaaataaaatagttgattgcaaataaaatgataggctaagaaatctcagcagtgcacttttggggtaagactatggtttgaggagaaatccattgggaaaagtcaacctgggcatgatccaagcaatgaatgcctttagtagactagattcagcaaatgaaactgagtgatttcaaatggaggttcaatgtgaaagtcagagaatggggagagattgagtttatatttttcatttccagccaagttatggattagagtgtttcccaggaagagaagtactagctggggttgagaatcaacttctaggactgaaagaaacttgaaatactaggcaagttttatggtagacagatctaccataaagttaagaatcaaagtggaaactcaattctgtgaacttacccagcacaggatggggacatggaaagccatgattgggagctatacagaaatctgggaattgctgtgatccctcagattgaggtttccaagacaaagaagaattggttaggtggagagaagtggagacacccggcactcatgctgggtcatgctaagttaaaaggaccatggcttcattccaagtctgactcaatggtaaagaaacagttgtaccacttccttagtcaggctttgcacatgaactaggctagagctagagtaaccatcttatctgttttacataccagttctcttttgaatatagaagaaatcaccttaataattatgtctggaccatagtcaaaagcttggattttctaggcagactgagacatattgtcacctagagcatagtctattgaaggtaatgggggctgagtttcagggatctttctgaaaggaccggaggtgatagaagtaggagagattgggttagttttgacaacaattatgtcttatctacatgtgaaggctatttggcattccttaccagaaggcactaatggctaggttaggtgggaaaaagataaagacaccctgccagtggttttctggaggactgtagtggaaccacaggaggaatatgctggaatgaaattcttcacgggcatatccttttggatttcttagtcaatcatgaattagatgatcaggagatgagtgactaagtctataggacgagaagaaagagacccatcaagatgcacagcaactccccatgattagaatcatggaaaactaatgcatatagatcagggtacagaagataagatgacttctcttccccaggaaaatccctaaagtgaccagaataatgtgttttctccagtcttaagaatatatatttagggaaatgacatttgtagattttccaccattgccagtctacatagttgagaagaagcaccaatgttatcatgtattttattcactgaaagaatcacagagattcaatagcttgtgtttccaagcattatgggagactgcttaacaagtccagaaatgctgaataaaatatcacaaacattcttcagatgagattctaaactgctagaaagtaagggacctcaccggagacaaaaaagagagagagagttgaaaacctgaggtacacagcacattcaacatcagactaggctttgagcaagggacaggagagatttgggaatgaggcactgcccataacatcagagcccataaaaagtgacgtgctcagtaaaagggttgacttgaaaaaatttgttcattgccaaaaagataataaagatgtctggactggggtaggtatcaaataaacaaactaaaacgtgtttgagactcttgctatgaatatgacctaatggcatttgccatcttaatttataccaaatcccttgcatgactttgaaccccccaagatgagaaatgaaccgaaaaataatcccaggatggtactacttatctgattcttggccaaagcaagcacaaaatctccctggaggaacaaagttcataggacttctaaacaaatccccctattactcatgtttctaccagtggtcccctgaagaaataaatatgcagcctcaggaacattttatgaattgcaattttaattctggtttgagtccctatcttctttgcataatatctttggctccacaccttcctgtgctatgattgctcaacaaaataaagataatttagaagtggacagagtatgcaggggcttactgaacaacagaaaagtaatatccttctatctatggcttatttttagaatgtgtccttaaatttcagtgtttgtcattatcattcacagagcttatctgtattgacctttactatcctttttaacatcttaaaagcttcaatcatatctctgctcttcaatgtcttttcttcaattgttgtaatctcagtttgtctggctctcagaactaatataaccttctttcccatttatcattctggtcccgtcaatcccttctgcctcctcaatgtctttcctgtgacattattcctttccctgccgagggagattgtctgaaatggtaagtcactgagtgtagattaatcagctaccattacaatgtctggcttcccaagacatgtttgtagcctatttcataaatttgttgttcttaaaagcaaacctaatttcacaatgaaactacccaatccccttttcatcaaaaaccagggtaaaaaatgtctttggtgtaaacaacactgttcagctactgtgatctaattggagttagtttacactgtgccttctctaaaatcattcctcttggaattcttattatagtgagcactgctttgatcccttttagtctctttttgtcctccatttcttccctattttgtcctttctttactccttagagagtgcacattcctgtaacataaagcaagctgttggtaactacccctggtattctgtgcacaataatctttgtgcagtgcttttattcttcacgcttgatgtgtggaacaactctgtgatttctgctaatgcccaaataatagtttcctcaaatgctaaatgccatgctcaagctaagataagacgacagcggtcagaataagagctcaggtcttctgatgcttacttttttcactaaaccaagaaccttaaaactagagatctttttgacaacttaatctagtatggaggtattaccaggttcttgctaaggttgagaaattccctttttgtgaatacaagaactgtatttgtgtgttatttgtatatatttgcataatgatttcaaatgtccaatattcaagtacacaagttgaaatgtagtaaagctactgaagtctacatgattcttttaagaacttccttttagagcatctaggaacatcctcatcatatgactcctgaatttctactttctattttttatttctactttccctatgatctctctttagcaatattccttttttttctcctagcttcatagatatatactatcaacttatatatttatatatttaaattgaatattcaagcaagatgaaaggacttcaattctggtaaggaacttatacaaaactaatcttacatagagttaggggtgggagagaataatagcagaaggataatgttcactaagttactgaccaaagtctgtactaggtatatcacatacccattcccagtagacaccttcccttctaacagtcatgaaaagtagtaatatttcacttattttacaagaagcacaaagagattctgaagataaaatgcaattgttaataaatttaaaaggcaggattgaaacccaagtatgtatgattccaacgctagcgccctttccactgtatcaggctgcgtcatgtgataggcatcaccacatatgacatggtctcaagttgctgagcaggcctgggatcctgatcagtcaaccaacatgcattggactcaacccacatatgggatgctaacggatgagactcaatctttccaatcaagaaacttacaatctcattaggaaaacaagtatagcagatatgatatgattaacaaacattgcatgattacttcataatatgcatatgtggggacagggggtatataagaactcttaactttctgcttagttttgctgtgaatctaaaattgctctaaaaaataaagttagtttaaaaaaatctgtcagagttgagtatttgttggaattcttacaacttccaaaacaagtaccctctcgccaatcagtaatacaacccaatgcatacagaacatcattttaaggcagacagggccaccacatacagcctgtgatctaagcaatttttaagaggactttgtttctcagcaacttcagtgtcggcaggctcccctaagtgttgtctcactcagctggatggcatgtgaaccacaaaatgaagtgcagcagctttgcaggttgacttctgcaagaagtgtgaagaaatatccgtggatttgcaagaagtgttaaaaatatcgcaatcggaatattgtcaatcacttctaaatagatactttctcaggaaacatgtttcctttcttgtttctcactctctcttgtggctgggcaaatgtatagtagtttaaggtgttgcaagaggcaaactccacttaaacctctttatttccctagctgagactttgaagaatagaccataaggagcttggggagttatgtgctatttagttttcttcctgacatcttccttttgacttactgcagattttttttttctcatgccaatatatttttgtatgttggatctcactgaggacaaacaagaaacaggctgtgctaatagaaccaagctaggggatatttcaattcagtgttcagctaatagatttagcataatttatcataggcataatgtacctccgattgtatataaataaaattagtccttatgttgaaaaaaaactgttatagtatatgtgtaccttgcatggaagctaagaacccagtttcacaaatgctgtctcaccccaatgacacattatattgaaaaatccaaataccaagccatgacattcaagtaattttcatgaatttaaatatgctgatcaattactcaaaaaatattccagaggaagactatggggttctgtttgattataaagtgtcagaaatatggatctttaagaaacaaaaatcacccctcaattgcaacaataaatctgaaagtctatggcagaataatttgcagaaaacttaattgggcttccatctcttccttctcttccacaacatagacccaaataggtaatgtgcagttttactgtttcctaaatgtaaattccatactcagattctgttttttttttttcctgtcttaagatgaggatttgaagttggccaaagtgttaatcttctagatcctttccttcaccagcaagaatctgactgtagctgacccttcatgaatgctgcctgatttcatccaccatcacattctctatcagtaggctgcaatttatgagttgttcatagaaaagtgaaggagattaaacaaaaatcctactgatcatcctggctacttccaattaggctgtctccaaattgtgcttcattggggtccagaagaggaaatcaactatacaatcagatatttgggtgtgatagtcacaggagcaaagcatttcctctaaaacacaaaatctgattgtgcaattccctgcttaaattctttcattagcatcatcacccctgttttcttcccaaaccctattatggtatggtttctagttagtttcagtatctaaatctagattcttctgaggcagtggtgctatcatatcatatcatatcatatcatatccttgaaacctggaactcctgggctcaagggatcctccggcctcagccaacctaatagctgggattacaggagtgagccacattgcctgggtcagtatctcaattcttgctgagctttgcctgaaactctgctcctggcacaccaatttctacaggctccttcacaatttcacacctgtttcgtctacctccctgttcctcagccctaaatactggtcaccctgatcttctcctgtccatgttcctaaacttccagttcagcaatcatgcttgactttcctgagcaccttttatctccaggtaaaggtgacccttcttccttgtgccctaattgctgtttttgatcagtgatcattgagccacttaatttgtaaatttcttgaaaatagggacacattcttaagcatcttatccatctccgtacttccaactcttgtaacagtgcctaacacattagaggtagtgaataaatatttctataaacactgttccaatgaaggaataagcaaagaagcagttcatctatagaaagcagagattacgtgagtgtatctagagacagccttttgcatgagtgtaataaggaactgtctcctttacttacacagtatgattttaatagtcttgataaaagtttatctgcataaaagttatcttcttatattttatttcaataatctttcctttttgtaaaggcattagtttcaatcattaaaatgcacaaaataaataataagacagtgctaaaaatgggggaaagtactgaataatggttcaggcaacagggcaaacagaccttgcgtgtacccaccaataatgtaataataataacaataatgacatctagaagactttaaagacagtgacaggaaactcaacaggtgttgtaattaggtcaacatcaaagtagttaagttcacttacactgccaaaagtatcagttttatatgtctggaattctaaagccctaaggggtcaaggaatatggccttacgcccagggcaggtgggagactgaaactgatttggagctgtttaaggatggcccgagtttataaaacagaacatagatgaatctggccaacaagtagaagatgacaaagaagcttgtcatctacctcactgtttgtgaagaagcaatttctcatgagaaactttaactccctgtctgccgttgtgcatggaagtgagatctggatttgctctataccagccaaagctaagaatataatatagatatgagtccaagattcacaaaaccctgggactctagcaaaagcaacttaaaactactctacagggacatttacacaatccagggcacatggcactcaaagagtaaacaactccaaccaaaaatgacttctaacaaaaattacattcccctcgaggaagtaagtcacaataagagagagtcagaagatgcaaaagatgagaaaaatggtgccccaaggacaataaacaataaaactgatatttcacatttttgagattcaacgacattgaatcacatagatacgactaggactttcattgaagaaaaacttgctgtgaagttgaagatgaagttactgtgatacataacatgcctcagtgatttcacaaggcttggcttatcagaggtttgtttgattcaagggaaattgagaaggtatgtgtttcaaaggaataggtcagaaagcttttgcagcaaaagtgcctacttatgatgacctctatgggagtctgttcaggctgctataacaaaatagcttacactgggtggcttataaacaagggaatttatttctcacagttctggaggctgggaaatctaagatcaaaggtctggcaagttcaatatctgatacaagatgacttcctggttcacagcacattcttactgtgtcctcacatgatgggaagtactatctggggcctcttttataagggcactaatcccattcatgagagcactgcaatagcaacctcaaagacattttacaatagtggctgcatgatattggaataagtggaacttcttagtgcccatatttacttttgcctcctcagccctggattaactggatatggcttcagtttgactcttcacatacacatttactcagactaccaagtttttattgattgatttccacgtggctgagtggtgccccagcccttggcctctctaaaataattgttctgggtctatattccctttgctttgctgtcttctatgagtttatgtctgcagggtaagataggaggctatatatatatttttttaaatttaattttatgttttgaaacaaagtctcactgtgtcactcaggctggaatacagtggcacaatcatggctcacggcagcctcaacctcctgggctcaaatgatcctcctgcttcagccccctgtgtaacacacaccgtcacacctggctaatttttgtaatttttagtagagataaggtttcaccatgttacccaggctgctcttgaactcctgaccagcctgagcaagactcaagtgatcctcccactttggcgtcccaaagtgctgggattacaggagtgagccaccgtgagtggccaagggacaggaagatttataaacatcttttgcttaaagttacttctaaagaaaatccatgttccatagaaaagtggatatcaaaacacaggtaaatactatttcctaatagcaacagccaagagatggttcaggaacatcattatgtgtaatcacaacatgcccagagtagtctagataatctgacaatttttgccttaccacacatggctctgatctcaggcaccttttatatttagagagtcagctgctttatcccaattttttcttttcttttcttttctgttctctcctttcctttcctttcctttgtttcttctcttctccctcccctctcctccccatcccctcccctcccttcccttcccttccctttccttcccttttcttcccttctctttctttttttttttctttaagagaagcagtttctctatgttgcccaggctggacttgaacttctgggctcaagtgatcctcccacttcagcctcccaagtagctgggactataggtgcacaccaccgtgcctgactagtttttttgtgtgtgtttattgaagagatggggttccaccatgttgcccaggctggtctcaaactcctgagctcaagctatcctcccaccttggcttcttgagtagctgaaactacaggtgtgtgccaccacacccacctttgacatttttaaaggaaattactcaaacttatctaaaaagaagagataaactgagaggttattaatattctttcttttcatggaaaaaatcccttgtatgtgaattataaatagaattaaactactgccagttatttttttaatgtgcattgcttgatacaaatcatttgtaaaatcattattagcatacatcattaggaaggcattttattattcccaatcataattctttttttttaataatctgctgagagtcacaattcagatcctggagattaggcatgagaagttgggggttggtatgaactttgtggaggacacttaagttgctcctccccagtttctgcttccagacttgagaatggggagtccacttctctctatagataccataaccagttcaaaaaggaacaatgcactgtgctgaagggatcttctttcactagaataagaattccaaaagactaataccccagacactttatattactgtttactgcatttagtcttcagaatattattttttttttcctgcatggtacccaacaatgtcatgttagtgtgtattttcttccatatgttttttagtttctttggaaaccttctagatgctgttttgtttagagtgttttgtaggaaaggaatttacaccatttataatagttagaacaagaaatgtttatatgatgtgaatgaattctctagagagaattttacataactgcttcattttaatttcgtaccttgactcacttttttcctcatttttttattatagacaggataaaatgctagtgaaagatcaaaagctaattaaaagtaatcaagaaattttctttctttacatttatttctaacagcaatttaggctcatatcatttgtaactttttgaaaatcaatgtttagcaaattattaccctgattctcatttagggtttaacgatttccttatagatattgttatatgggagtttatgtgtgttactgaaggcaaccctaatacaattaacaactaagatgcactgaatattctgtattatgaaacatcaactacattaaatctatagtttaacttaaccctcactgtaacactaagaaacaagtattgtcattccattttataggagctatttgcattttggattgctaatttcatttactcaacaagatgttgaccacaaaatataccccaggcactgtgctagactttagaagtttaaataaaaataagtaaaaatcttacacttaagattctcagtttattggcatagaaacaaaatacaatttaagcattctagtataaatttctttgtaaacaactattgggcttagtaacacagcaatttataccattttatctattgcttcaaccaacattaatgatccttacatgcaatggttttcaatcatgtaggtcatgtacctcagctcagaaaaaaagcacatcctcatctccagaatacgcatgtctgtctgtaactagcacagttgcacacgcattgcaaggagacttgaggacccctagaatgtcatctgcacaattctgctcacattttctcccatttctaattcattatctttatttctcttggagtttttttcatgaaaatctgatcatgccacttcctttcataaacactgcaaaggctgttgaggcctatagggtaaaaatataagctcataaccatggtgtatagagggattcatgatctgaatacaactcacctttgcagcctcatcctctatccccatctttccacttatgccatcccacatttgctatgcctattattttttgggaaatttttatagcgattgcatcctttttttttttttttttttttttttcataaaatgccttgcctacaaccctagtctctttactgaactatttactcctactgagccctcagggaatagttcaaagatcacccctctggcctttcaagagagttaatgttccctgctcctgattggctcactttcattatagtacactcagttctccatatccatgggttctgtatccgtgggttcaaccaaccacagacagagggaaaatatttttttaaaaaatggatggttgcatctgtactaaacatatagagacttttttcttgtcattattctctaaataatacagtataatagctatttacatagtatttacattttattatgtattataagtaatctagagacgatttaaagtacacaagaatgtgtgtagattatatgcaaatacgataccatttcatatcagagacttgggcatctgtggatttcagtttccgcggcgggggcgggggtctgaaaccaatcctctatggatatcgtggaacaactgtatttgtaattttgtcttgtaatcattcctgaatcagtgatccagagctgcttttgatcagagactatgcctgttgatatctgcatttcaattatgtattctaacacccggcacatagaaaaaacacagacatatttatttaatttattgatataggcaaaatattctttatctggaaagcaacttcaaagttttgcttttcctcccaaatacgcaactcttcatactacttccaagaagtaatgcctgatctctcagaaagttaatattttgtgataaaaattccgaacacctgtgcaggctgtgtttgatcagatgaccttgtgctgtctggactcaggataactgctcacagacttaaaagtaaggtatgttgagctaaagaagccagagaaatagactttcatggtatgatttgtataaataaatttgaaaacaggcaaaactaatctatggtgatagaggtcagaatagtggttatctctgggggacaatgatctctggtaaggggcttgagtgcgctttcttggatattggaaatgttttataacttgattgaggtgactgttaaatggatgaaaacatatgtaaacattccctgagctactaatgaaatactattagaactataactactactaattttttttataagtaaagctggctctgagactttcactatgatatacatcagcaagaccatcattctgattcagctctagaatgaggaagtggctagtgggcttttaaaaggcttgaaatccatttttgcaaaatttgaggcccaccgaagacccactgaagttcacccatggcccatgcactattaatttttatagatgctgtgatggtttaaaagatgttctcatatccaattctttgaaaggccatctctgaagaataaggtctaatttacctctacttaagtgggggctgcactttgtgacttgctttttttatttaatagataaaagctagtgagaaatgatgaagtgcaacttgggagactgtgaggtactgaggattatgtttcattcactctctcttggatcactggtagtggagaaagttagctgccctgtcatgaagacccctaatggagagggccacatggtgaggtactgagtcctccagcagccagttgtaaatcaacaaagcagtcttccttagaccatgtggttgtgaaaccatgtgactgagcttgcgagcagatttcccagcccagatgctgccttcagctgtctgccgccctagtcaatatctctaccataaccttactggagagcctaagccagagccacctaattaaccagccctggattcttgactctggaaactacgtaagataataaatgtttcttcttttcaactatcaagttttgggataatttgttatgcatcagtagatgtttaatacatatggaaaattaagacccagagaggttaagtcacttgggtgggatcacacatagagtcatacttgagattagaatccagattcctctcctataatgcctcactcctaaaactgttgtaaattttagaagagatatatttgtaaagcattagaaaagttttaatacgtagtgagttgtcaataatgttagattttaacttactatttatccttcagaattgacctctactaattacaacccaatatgaaataaatattagagtttatatcttcaactctagtctcgtcattaagtatgtttcataaaaaaatgaataaagagatcttccatccagtgttcaaaagcctgagactatccactttataggagagctgattgaaaacacaaagcacctctggcagagaggttggcattacactctctgtcgacgctcaaaagcttcaggaagagtttaccatctcagaggaatgagaacaggtatcatagtcagagggcatatatcaccttgggaggtagagaaacagggtttgaggaagctctcaaaaaagaaaggcttgtccttttctttgttatggaaattgtaaggagttgaaggatagagctccagaatattgccattgaacaaatagtaaaagaatagaattaggtactggctaacccatggggcatcagtggcactttcatttcttttatattctttaatttgttattgaaaatgaatctattcttatttaatttgagaaggtggaagtttaggagtggatatttaattgttttacagtgtgagagtatgtacacatttgtgtgtatgtgcatttatagaaccttgtctcaacctacaaataactgaattcagaaagatcacaatctgtgtgaaattgctggtctacttctactcctcagaccttcagtaagttcacagagagagaaaaagatgaaaaagtgtcttttgatgtacaacaaactcttcttcccttccaggtagctttgatttggatttgggttcaaaagagggaatggtggggagaaaaagggaagggaaggaaaagagagagagacgttggaagggaatacaaagaaacgacatattagagcaaattgtaataatacatatctcaattgtagaactttattgagaataccaagctcatttgacataaggcaggcatacattttagaaatctctttcatctaatatatattatccaaattaaaatgtgcttttttaaattcccatggactttattcttaagacacagaaataaacaataaagataacaaatacaccttaatagcaaatccacttaagacatattcttatactccaattttattttatattttatgatattttctaaacaacccctgtggcagttcgaattattgttccactttttaagacttcaaaatttcagaaggtttaaaaagagattaactatttgtagcctacatatgaacacaacttccttctctgtatgacaacattaaatgtgtgtgtgcgttcttcacatacagcctaagttgttcctatcatctagttcacatttggtgaacaaagctgagtagagacaagtagagaccctaccaccagctgatctgctaccaaaagatcagcaacttagactatagaaataatttacaagagacaattttaaaatcccataaagctaagcaatgtagggctttgcgggggaggtcatttctagttgcttaatggcttatcttcaaacattgtcctcagtggggtgccctgctatcttggatctgaaataaatatgctctagccaatttcttgagtatttgtgttgcaaggagcatttgaccaaagatcccatcttcaggcatccctcaggctaaaaaaaaaaagccacagaacaaaccgttaacatttttcttcaattgtcaaatagtttatatacagaatatattttttaaaatttaataaaccagcagcaaaaaggctataacaaaaaaagaagaaaaataaagagagatctgaacactggaccaggcattgcatgtaagaaagtattaaaattggaaataaatatattaaaagggatttgacttttttggttatcagtgtgataaaaattaaaatcccatgagatatcataatatgcaaactacaatggctgacttcttagaacagttgaaaataccaagtattagtgaagatgcaaagacataggaattctcataagatataagtagaaatgtaaatggaaaaaaatcctcttgaaattgtctttcagtgtctcctagaattaaatatgtatttatctgtgaccagtgacttcatttctaagtttacgtagagacaatatgtcaatatttcaatgtgtcaatatgtcatctgtgacaagcatgagaattttgaggacaatactaaaaattagaaatattccaaatgttcattaacattataaatatccatttaaaataaaatactatatagcaatgaaaaagcataaagtactgcttgtgctatagatttcacaagtataatattttgtgaaagaaactaaatacaaaataggacatagctgcataaatttccacatttgtagaaatttcaaagacatgcaaaactaatctctagtatgaaaaaccagaaaaatgactacctctgagttggaaggagagagagcaggagagttgcttctgttttttatcttagcggtggccatatgggtatatttactttgttataactcacctagctatatgcttgtaatttgtgcactattctatacttcaaagttcaaaactcagtggacaatgacaatgattacagtgatagtaactaccatttttgaatgtttcatgcctgtccattacaataaatacaatgaattagtaaattcttataataattttgctagaaacatattattactcccttttgtaaataaagatactgagagtcagaaaaaaaaagatgtaactgagaatcagaggtaacagttcagatctcccagagctgaaaattggcaggaccagaattctaacacgggtttacctgagtccaaatcctatcatttttccttcccggcctcattgttaatagacatgaatttagtttctagtgcatccaatagagcttctaaattgataaaagatcaagctataaactatataaaaccataacatcctttactttactgtagtatagaaaaacaaaatgcacctgggtgttttatgagggaagttattccacctgaaggagaatatgtttgcatggcagcattctttacagagccctcctgccttctcatcagatggctgaccccacctgacctgctaatcagcagggacctacatcctctagagatgttaagccatataagatattggttcagacccgttggattaatgcttagtcaggctgtcttctgggctcagattttctcccaattcatgtttccctttgtggatgttggctccatgctctgtagttcacttcccttgcttcctcacaaccatcccaggctctggaaatcttcctttgacttttttgggagaggattttggactagaactagtaatagtattcatatgctactactagtatttgtggttacttttaatggcaaaaaccacaattacttttgcactaatgtagtacgaagacttataggaagaaattgcttattaaacgtagggtgcctgactgaaatgagcccataaaggaacttggaggtaaaagtgatgaactctcctaagaagcaattgtccttactttaatcagcattcactgtgttaaaattccaccctaggttgatagcacatttctgagtttttgtgaggcaggtaagatgtagtgaaaaaattctgcccacttattgcccatgtgaccttgagaaagctacttggcatttttttgtttgtttgctttttgttttgttttgtttgagatggagttttgctctgtcgcccaggctggagtgcagtggcactatctcagctcactgtaacctccacctcccgggttcaagcagttctcctgcctcagcctcccgagtagctgggactacagatgcacgccgccacactcggctaattttttgtattttagtagaggcagggtttcaccgtgttgcccaggctggtctcgaaccccttagctcaggcaatctgccacctcggcctcccaaagtgctgggattacaggcatgaaccactgtgccccgccgccgcttggcgttttaaacctcagtttcctcatatatagagtgagggtaaggatgtctaattttttgcctctgtaacaatttaatgtctaattcttatctctgtaacaatttaatgagataaagcatgtaaacatgctttggagtattttatgttttcatgagtcaattcaacatgatctgtcaaaagaggttgattgcactttctcctagccaacagatttctagtgaagtgtaccttgattgtatctgaggctgagcattttcttttaaaaagagctttgtaaaaatggcaatattctttatcctttacttaacagcggtaattgaaacagagtttcatgatccattgaaactctgaaaatgatcagcttattctgtgggtgttatagttgtgagttgagttccagttagattttataatatatagaataatattagtattactatcatacctaccattcatggactttatcactattcttatttatttctcaaaacgatcctaggaggtgctttttaatatttacattttacaaaaggagaggaatttggaatcctgcgcaagagaatttaaggaaattgggcagctaatgagagccagaatgggatttatattgagtttgtgtgactctccccacatggagtctatctgcatatcccatcctttgtttgttacaaatctcaataggagtagcatctgaagacttacctgtgtgtatgcagtgtcatgataactagttgagaaataaattattggccagacgcggtggctcacgcctgtaatctcagcactttgggagactaaggtgggtggatcacttgaggtcaggagttcaagaccagcctggccaagatagcgaaactctgtctctacttaaaaaaaaaaagaaaaaaagaacaaacaaacaaacaaaaaaaccccacagaattagccaggagtggtggcacatgcctgtaatcccagtaacttgggaggcgggaggcaggagaatcgtttgaacccaggaggtgaagctagcagcgagccaagatcgtgccattgcacttcagcctgggcaacaagagtgaaactccgtcaaaaaaaaaaaaaaaagagaaagaaagaaagaaattatttagttaatcactaggttattaagtgtacatgtgaccataccataattttgacagatttcatattttattcaaattgaaagtgggtttatatttatattctgacaaaccaatttgattcaacagattattcacgggaataatcaaactagtaatttgatttaagaatagcaataatatatttgatttgaaatgggactcacattttctaaaatcagtgccaaacgtttctcccacagtacacaaatatgcatctacaaatgtctcacagtggctctctttggatctcctgcttctctgtgcctctaccaatccacctatctgggatctttttcctccccagtgattgtgggcattattctcttctcagccaattgttttgacataacctaatagatatttaactgaattcctgaaactcatctcttgttttcccatcaattaccacgatttcagggctaggctagaccagggcttctgaagcattaattatacatatgcatcatctggggatcctattaaaatgtagattcttactcagcagacatagggtggggctcaagcttatgcatttctaatacagttttatgcgatacctttgctactggtccttagaccatactttgagaagcaagggtatacatacaccacattaagtaatagactaattcattataaagaactttgatttgattgctgagaaacctggctttttatcccaacctacaggaattaaccacataagctaattaagtcacaaattccctaggttttcatttcattaagattaaatgtgggctctatctatcttagtcactttccctgctctaacatggaattttcacattaaatataacaccactactagttacactaagttactgagtatctaccatatgccacatattgcaccagaagctacgcctgttatttctttttcatcttcacgaagactccgtaacataaactccatggcatcattttaaaataggagcattggggattacagaataaacgccttttccaaggccacagggtgattggtgctagagccaaaattttacttgaatgatttgtaattttccatttaaaattatattttatatgatttattgtctagtttgtaaaggcatttttgtataagcatatatatttgatcttaatgtcacatatttatttgttaacatcttggccaccactttttcacttaaaaaagctgaaattcagcattaaaaataaaatttgtccaactttaacttcgcctgcataatgagacagagaagatagcctgtgatatttagtgacaaaattaatgaatattaccatcttctttttgcttcagctcacatctttatttttccctattgtttttactttttggatgacaaggcattctccagattcaaaattcaaagctcatttaaagagtatttaataaaaagaatccctctaaatcctgtccctgagccacgagctgctcctctccagaggcaaccaatattcgactttaaattcatcctgaaataccttatgcttatataagcaaatctttttctttttttatctattcatgtgactctatatttttacatgaggagctagccgttaaacccaggtctcttttcatcaaaggtccacgctttcaaactttacaacataaaccctctttcttatgaatacgctatttgtgtgtagatactgtattacaaaacaaaaatacttaggtccaaagagtgcctgtgacatgaactccactcgttgcttcagtcctgggtcgatgggatgcaaggccctgccagaacagagagtaggcagactgtacccctcccttcttagcacactgctcacaagcaggtgggcacagagtctgcaacagcagaggctgcacaactcaaggaagtgattctgcccaactcccacatgacaaccacaccaaacctcgagtaccatggctcagcagtctacaccatgaagactatggcgaagactttgaggtccttttctcacaaaagttaagagtatcattctcaactgaatgaaaagtaccatatattttctaaaccaccaacaaatgcatttgatttaccaataaataaaatattattatagtggtatttattttttcactcaagtatcaaagctactcagtgcatgagtttaaacaagttaaattttgaactacatttatgttgaattttaactcaaaacacaggaaaacaataaacaatgccagataaggttgaattaacaagccagctgatttatttttctagcttctggggccagttgctggtggctttgttcattctataggtttgcaagtatgatatacttcactaagcaggatctggtttgtatatcttttattttttctgatataacctcttctacaaaatagcaaagtaacattgggccagttccttaatggccaactttctgtggtcattcttttcagcatgtgtaatacaaggtgcttaaagtatggatttcctttataaggaagtaagaaaccccgagaaaagagagattttgtctccatcacaaaaacaaaacaatgagtgaataatttttttaaatcagtcaattcaagtggtacatattgcatgaatccaagtgtttaattaatattttcatcatcagcccaatgaccttcaaatcttttattaaaaatacctgtaaattcacagtcaaacccagaattttattacccatttcaaaattccacttctcaatataacattattatagagggaagcactagacagagattgcaaagtcagtccagaaaaacaaaggtaaaatgaaatggacttttaaaactctgcagatacagttccatctggaaagccatcacatacaactgtccaagtggaaaaaaaaaaataaaaaaggactgagcactccctactcatataagataaaagaaaattctttttctaccctaagattctgaaattgcattttgctatttccttccaatgttagaacagtgtgatccagtattggtggcatgtatgctagcagagtggaaaaaaaaaccctccaatctcacactcgggaagctgatgctgacaacatttttggcagatggactgtgattttctctcctgtgaaaccaaacattccaattaaaatggttctctgatttttgagcaatgataaaagaaaaaagaagctacatgaggagcagacagaaaagttaaacctaaaaaagagcaaaaaggaaagagagataaagacaggtgagaaatatatatcagaaataaatgtgaaagctatacaacagataatcagttggaaaaggagtaaaaggagaaatgtaggctgaagattatttaaatagaagcaatgtagtagaagcagtgatatatggcaaaagtcagtctacaatacatgaagtttatttactctggaatacacaaatttctcatttcactagctgttttaagcccagttgtttggtagtgtgtgttgaagttttcattttaggaccaaaaaaaaaaaaaaaaaacccctcttcttttattttatggatttattgtgtggttctctcagctattcaataatcatgaattaaacactttgtgtatgccattgactctgtggtagaattcgcagtacatatgtgtttgccagggaaaaagtgtgtgtgtgtgtgcatgcacacgcacacatgtgtaggcatgtaaagaatatcttaaaatcaacatatttttcttgattttctaggttaactaggagttctcagtgctctatgtgtccccttgaaacaggtattccatgccttgatggctaataactctcaagataattgaccaacttcatgggtaaatagcagggaagaagttagccagaatctgattcctcctgggagagaatgctgaattgttgtactgtagacttaattattctgggaaacacatttctaggaatccctttcctaaatgattttctttatttctagggttagagtcgatcaaaagtaaagttgggtgggactggtgagatgaagtgaagtatcagacgtcgtgttctgaaattcccattagttagtggtggtgagagacttacagggaggttttggtgggttcccgtatcttcactcttccattctccactaccagatctccttcccaattgccatcctgaccaacaatgattggtctcagatccaacaccagacacatggctgcaaactcgtagaggcagaagccacgaagcaccaaaggctttcatggacttcttcatgtgtgatttgacacaggatgaaatagaattaaagggcaactacttctttaaatactggaaggctgtgaccatggttaaggatagcacatctgcatttccatctatttgtttacaattaaaagaagaaaatagtatttttattagcagtgcaatcccctttccagtgcttacctttccctgtctctgccccttgcacactaagggaaagatatgaatgaataatttgataaactgcttgggacagggcctgaaagcctccaagtcgagcctgtgtcatgcaactggctgctaacatgtcttctggagaatggagcttcaactaattgaaggacctttgttttgtttaggggatattgtatttggaaaccattaaaatgctaagacaataggggatattgaaaataacatttttgaagaaatgcaatgaaaataaggaaggtctcttagagaaacataatggaggaacagaaatgtcgaatacagattttattaagttgtttgcagtattctatcagatatgacctctctttttttccatggaaaccggtaaaatctacatttctcactctttggtggtgtagatttactttatcaatgtgaaatttgcagtgaatacaaggatggataaacaactcttgagtgcttatccaggcactgctccagctgggaatatggtgttgaccaagatggccacatctccctgtcagtcttacaaccctgaagactatgaatggagacaacaatattaacagctcacagtgcaggcataaaacaagtgttattaaaggaaatagggaagaaaatcaagagaatgcacctagtcccacaagctcttaccagcccactgagaagtgtgcttgatcacatcaccatgaaacattccatgattgtgatcctagaaagggaactcatctctgtgcttctttacttatttacaggaaacttggaaagagtcaggaagcataaagccagcaatcaggtaactggggagatgtttggcctgtgaaacaatttgctagaaaaacaaatatccggggcttgaacctacaaacagattcactggagttaaattcagagggatatattatgatgtccaactgcacagtggacctaaccactaggtgattatgaaagtcccctatattaactatggaaatttggcttcagtactacctagacaaatggtgcttttccatgggtagaaccttgccaagatcttcacaaagccattttcacagtttcctcttgggaaacaacggtaatcctaataataacgtaaaagatctctttatgaaaaaaaggtttctgtctaataggacaggtcattctagcaaatagtaaaatctggggaaaacatacaaagaacagtaactcacctagatttgaaaagtggggatgggcacgttttacatttattctaattgtaagcaaaagttgcgggacatctggtactatggaaacagtgacagatgctagtaaagttgtgctgtgattataaattgtattttcatattgaagacctctaggtgtttacatacgctggtagagttcagtttcactgcagggatctcagaagtagggtgaggcattaagccctgaatattttaattggtctcaatatactaattggtctgaaaatgacagttatgtaaaaatctcagggtcagagatctgcattatttactggtgaaacaagttttcaattctttaactagaataaagaaatgagtatttgctgagtgacttgcttgcagaaaagttgagataaattcataaataaatctattacaaagcctgactgaaaacgaatggcttactttacacattaggacttaaaatgcagcactccatatgggaaaggcattcttaatctcttcattgttatttaatttaacatgtggagcaacaggttcattaatcacttcatattaatattcaagtgagagtgaagatgctgggacacgttctattccaaatagcgattctatttggctgggcgttgtcttaggcatgatggagagggaacaggaaggaagattaactttctgctacacttatttctgcttcattatcctggaagtcttttatgaaccattagtaatacttaaccagggtaaagccaatcttgatgtctgcccaatttaataaacaaaacctctttaatttaaagcttatgtgttggccagacacggtggttcacacctgtaatcccagcattttgacagtccgaggtgggtggatcacctgaggtagggagttcaagaccagcctgaccaacatggagaaatcccatgtctactaaaaatacaaaattagccgggcgtggtcgtgcatgcctataaacccagctactcaggaggctgaggcaggagaatcgcttgaacctggggggcggaggttgcagtgagctgagatcgcgccactgcactccagcccagtaacagagtgagactctgtctcaaaaataaataaataaataaataaataaataaataaataaacttatatgcttgtttattcaaaacagtcatatttacaaatcatgataagaaagaatgatcatttatttcatcctacattttctctcatctttggaggcatatggtagctaataagaaaagaaaagaaaagaaaaactactatttattgagatcttgagctaggcctttgctttttatttgcattgttatctaataagttaacatacatgtgaaaaaaaaatcttctcttctaatatactctctgaaaactggaatacatatagtgaaacataagaaaaggattatataacttacaatagttaggttgcctgttgaaagtttagattgttattggtgaatattaagcattatgaaatattaatggtaatgtgttgtaagctttagaaagttaatcttatttaattctcatgatggctctatgaggtaaatatttttattcctatttaatagtcaaggcagctgaggtttagagatgttaagtaatttgcccaaggtcacacaactaataagtgttagaggtgaaaaataaaatgcaatgcttgtgctcttatacatgcaaaaaattgcataagtagtctcttcagtaaatttactatgcagcatttagtagcctgtaacctaaaaaagtaagaatatgctgtgcttaaagtccaagaattttccaagacctctttggttgttcggtgaagcctggagaaccccctcaagtatatctaaggctagttaatagctcaaacaggatcatattcacataatgcaggctttatcttttgctgccttgttaagattcagtttgagcagccttccaggttaggggaggttgtcattggttcttgccttgacctgacatatagccatcgttcatttccaggatgaatttctgttctgtattaatgaacaaggtgcagaacatgaaatacaggactcattacatttcttggttttcttcaagatctttgcttacttctggcttaaatcaaatgaaattgttttcctgggtcttggtgaccctctaaaataaggagactctttgggaagctcagttggcagtctgggttgtacagaacttttagctcactcctgcctctcattttcatcacagaagatcctcaccttttgagcatcttattcaatacaatttgagttatgggaactttttaattaccctttctggaaccctttgtttgaaatcttcattttagttttcagaagataatgcaatcaaaactggacttattttattttaaatatcttcctaagtcccttctttttagtaacaccaatactagttatgctttttagcttcttctgccctctaggtagaaggtgtcatccaattatgtcgctacaagtttccttatgtctctttccttataagttaaaatctcattagattttatgaaaagtttcagtaatatgcagtgtattgcaattacgagccttggcgtctgtcttaatatgatcttgctcgaactttgaaaatacttattcatagctgtttgcctcattatgcaccaagctaaagcttgctaaaactgaaaccattttcatgcctccacgatgtcatggaaggaagtgaggatctcctagtagatttccttttttccttctaaagcagtcaagagcacagcaagatgttgctgaaggtatttaaaggaaaatgaggtcatggtgtcaccagaaaaggtcactgggctggcttccgtgagtcttcacatctgacactcagctcctcaggctcagaagctcagtcttgacaggggtaacccagatttgattagatctgaatatggagttacattacacttctcatgaaataattttcaaaacaagaatgacaagaaattaatttgcaatgaggtagataactgccagtggaatcagacactcacatcttctggtagatattctcttcttgtaacatagtaaatgaaagccaaatcatggtcaaaagttgcttagcattttaacaggtgcatcattatgatttgaatacttaagaccctcaagatagcacaacctgatgcatttatgtaaaatgtgcttgttactaagaccatataggctgaatccttgattaggcctccttctcccagggcactgcttaaacagacattgccagtactcccatgttctagtactaaccaatccattcttctgccctacaattgatttaaaaagtagaactttttgggaccattatattttaagtggtttttgttaaaaggactattgtatcttaaagtgactctgacctcatccgtaaggtgttcatttgtagttattcctcttaagagtaattttatttccccatttcaccacgttcacctccaattcagtgcatgatggtgcactggaaagagtttatcacaacaggagtcatgaggccaactccaagagacaaggaatacatatacaaggacacacacttggtacggtcagacaaataacaggatgtttcactttgtattaaattaacttgggataattcccaagatccaaggtagatctcaaaaatgaaccttctaggaaagaacaaaagcatctactggaacctggcaggaatttcagggacgcttgttctagaactcaagataaactttaaaatggaagtacaaaaacaattctttttaggaaaagaattgttaagtgaatcttaaggcatcagagcatgatgcttatgatcatgagttttagggtcaaccagagctggctctgccacgtcttaactgtgcgaatttgattagcttcaataaccggagcctgtttttctttatctgcaagactggggaaataagaatgcctacctcacaagggcaggagggttaaaaaaggcagttcatgaaaagattgaattcagtatgtgtactgcagacagcactcagtaagtgaaagttgctatttattggattaaagggttggttttattttatttaagaaggattatcaattgagggcttcagagcaacactgtactttatttacaaaataaaaatatgcaattgggaattagtttcagccattacgaactacgaaatattgtgtacatatatatacatatatatgtgtatataatgcctgtatgtatatatatattatgtttatgagcatatacgatacttaattgtgaaatgctccttaactgattgtgaagcaggtttattgcgcactgtttgttgtttattgtgcactggctcccagcttgtctgagtctggtgagacaaaacacactcatatgcaacaagttatatgaagtggattcatttcttacagataggcagcaagagacagcagatatcaaggattcattgtgaaacagtccccccaggttcagaaaactaccaagagagatggagtctcaagtccactggcaccatttatactgctgaagagggatcctgaaaggcagccaaccctaggttatataacttgtggtcacaggaatcacggggctaaagcactgtggacatcctctttttaggtgggaggactggaatggaggccagactgccccatctagttcctccctatctcagggcattgcattcccagcacattctacaattattcttgagaactacaagtgagaaaaggggaagaacagagcaggtccaaggtcacacagagaactgcctagttgcaacaaacacgtatgccacagaaatgaagcagtttaagggacggcctccagaacctgaacgcatgcttttcagtgctgtcttcttcccttactggctgtatggacttgggcaacttatgcggtctctttggacatataaaaggcttgtatttaccctctacgtttctagatttgaaccctgtaaaatgatcaccaggtaggaaaagagtcacagttatataagaacattcagaattacattctctagtaatctaaattaatcttatctctatttgatagttttctggttctctcactatacttgggcatggatctcaacaaaaaatactgcctctctgggcacatgatttttgttctttacaataagatatagcataatggctgacttcaattcattttccagctatgccttattgagtttgtgaccttggacaaacttctcaaaaccttgattttctttttagtaaaatggttataataataatgaccctttcataaggtttttgtaagaagtaaatggtgtaatgcatataaaacattgaatacatatttgacctggaggaaatattcaatgaattctattttttattttagtacagaacatacaacagtgattgtaaacagtattgagtatggaaggagaatgtgtagtgtaaaaaaaaaatcctccatttagtaataaattattttatctggggaaaaaaatcaggtatattttaagggcaatagaagctacaaaaagtagtcaggtagaaagggggaactcttggctgaaggacacatataaaaggatgcagagacattaaaaggtgaagatgtcaccctagaagtgagtgttacagaatctcaaaaaaaatattttgataatatcacaaaagaggatgagtttctgtttttactaaaaaaaatgattccaatggtcaggtaagataagatttacaaataatggaatatctttattaacccatggaactaatgcaaagttcatttttattttagataaagtgcctattttacatagatttcctcttaacagagaacgtccatcgggatcttttcatgaacagatagcttagcaagcttagctgggcctgttgtagaacttgttgattaaatgactgggaatcctaaaagggttggggtagtgtctccgcatggtcagaggtgtcagtgacatctaccctctttttcttttcttttttttttgttacttaatttaagcagcatccctctgcttttctttgtctttattaattgtcctttgaaagatggtaaatatatggcttctccagttgtggtctttggtgctccttcagagaaggctggtatttaccctctagctttcccgatttgaactacgtcaaataatgaccttgccccacccagctctttttcttttttggagaggttgtcaccatgagcccctttggaaaaaaatccatctttctctattattgggggaaagaacactgaagaaacaagactttattcccatgaaaaatttacaaagaaaatcaagaattttttaaaaaatttgaatactttctaatcaaatgtactatacacatcaggaaaaggaaaaattaaactggatctattaggttggtgcacaagtaattgcagtttttgccattaaaagtaatgatacaagtaatttgccgttacaaaaactgtaattacttgtgaaccaacctaataagagtcttagagaagatctaataaaggaagcaaaacttaacttctactttgaaagattaaaaaatgctaacccattatactttgagttcttaagatgttaggatgtgtctggatggtactaagtacttatttttatttttttaaaataatttcaacttgtgttttagattcgagggggtacatgtttaggtttggaaaactacaaagcctctttgatatggatgaggggtccccaacccccaggccatggaccagaactggtctttggcctgttgggaactgggtcacacagtaagaggtgagtggtgaacaagcgagcaaactttcatctgtatttatagccactccccatcacttgcattactgcctgagctccacttcctgtcagatcagcagcggcattagattctcataggagtgtggaccctattatgaactgtgcatgtgaaggatctaggttgtgagctccttatgagaatctaatgcctgatgatctgaggtagaactgaggcagtgatgcttgcccagaggaatggctgcaaatacagattaacattagcaaagagctttgacttcacagagaccataataaatcatttgcttgcagactgttctagttcattttcatgctgctatgaagaaatacccaagactcggtaatttataaaggaaagaggtttaattgactcacagtttcacatggctatggaggcctcaggaaacttacaatcatggtggaaggggaagcaaacacgtccttcttcacatggcaacaggagagagaagtgctcagcggagggggagaaaaacctttataaagccatcatattccaagaaaactcactcactatcacaagaacagcataggggaacacccccatgatcgaaatcacctcccacaaggtccctcccccaacacgtgggtattacaatttgaattacaattcaagatgagatgtgggtgggaacacagagccagatcatatcacagactcatatcaaaacccttttagtaggtggcaggtaacaattaagctgcccctggtggcaggctttatagtgccaagtgagttcaggtacttcaattgtatagctacatctcatggcaggctttatgtcagaatctgacatttattttagtttgcacatggcccacccattattttacttaccactttcatgtacatctcttttttccactgtgcactcatctccagcacgcttttggtaagcccacaagctaaccctagccaaaatgggtatagaacaaacatcactggagatcttccttgcaaagggagaaagaccaaataatgagagagcagaagactctaagactgccaacaaaaagaaagctgcatttaaaggaaaataccaagggtcctacataaattacacgttcattacaatagttgattcacattctccaagcccactttgtataatatgtggggactagctatccaacaaagctgtgaactctttaaaacggcttcgccacatggaaaccaagcaccctgtattaaatcacaagactttggagtttttcaaaagaaataaacatgaaaacagagaacagaagcaattatcgaaggccaccatttcatcaaatgtgtctgcactgagagcatcattcttaatggctaaccacattgctaaagtaaagaagtcctttactattggtgaagagttgatcctgcctcctggtaataatatttgttgttaacttttaggagaggctgcaggtcaaaaggtggcacatgttcctcttttggctggcaccgtaactagatgaattgatgaaatggcagaggatattgaggcacaattgctaaagaggatgaatgagccactgtagtattcaatccaggttgatgagtctacccatgttgacaacaggtaacaatgcttgtttttgtgcaatgtggcttttaggaggatgtgcgtgaggataagtcatgtgcattttgttttgccaaccaacactacagctgcacaactattcaagtctttgaataattatgtatcaggacaactgaattggtcatatcgtgtcggtgcgtgcatggatggagcagctgtcatggctgcgtggctttctggtttcactgcttgggtcaaagaggttgcttctgaatatgagtctacgcactgtgtccttcatagagaaatgctggctagccaaaaaaacgtcagcagaacttaacaacattttgcaggatgtgattttaaaattaacaaccacgttaacgtacatgcccttaactcacgtctgttcatgcagctctgtgaggagatggacacagagcaaacacatctctcagacacagaagtgagatggctttctatacgtagatccctggccagagattttgagttatgagagccacttcagaaatagcacatttcaatgacacagaatgggatacaaaacttgcttacttatgtgacatattcaacctgctcaacgaactcaatctgtcgcttcagtggagaatgaccactgtgttcaagttggcagataaagtggctgcattcaaagacaaactggaattatggggcaacaagtgaacatcaggatttctggcatgtttgaaacattagcagagattttggaagagatggagccagaggcttctttctcccagcttgtgcatgatcacctaattcagcttacaaaagaatttgagcattacttcccaaccacagaacacccccagactgggaaggaatggatccgtgatccatttgtgaataagccaagtgaatcgactttgtctgtgctagaagaggatcaactgctcgagatcacaaatgatggtggccttaaaaggtatgtttgagacaacttcaaatcctaatcatcaaggtcaaataggtgtgacaaaagcatccaaaagcctgcttccatttccaacatcctatcttggtgaagcagggttttctgcagtgacagcaaccaaaatgagattacggagtagactggacataagcaacataagcaacacatttcgggtgtcactgtctaccatcacccacagatgggaccatctagttgcaggaaaacaagctcagggctcccactgactctacattatggtgagttatatatttatttcattattatatattacaatgtaataataatagtataaagtgcacaataaatgtaatgtactagaatcatcccaaaaccatctccccaacccctggtccatggaaaaagttgtcttccatgaaaccagtccctggtgccaaaaaggttggggactgctggtatagattatattactgcctggattttacagacaaggaaattgaagcttattattgtaacttgtgtctaaagcttgtgaatagaggagcaggcttttgaacttggacattttgtatttagccacctattcctaacatctcccttatactactagagagaaggcaagtggtttctttgctgttcaggtatatgccaggttcaacagttcccaatgttacctctttatgaaacaacaatggcaaccaaaacaaaaaccttatgccacaattattctgtcatctggatgttgttgtattcttccatgctaaaagggtagctttgtgatataagttggaattttgtagcttgcctttacttgtacactcaatgaccctgaatcagaagaagtagctatcaaaggtttgagagttatctgtgccaatgatataatgcttttcttcaaggtacattcattcatcagatatgtattgaatcccataatgggaagggcattataaagttgggtgggcatagggagaaatatttgatgtagtttctactcacaaagacctcatagccatttgggacagcagaccacaaatgaataaattacaacctagcatagtgtgtgccgtaatgtaagctgctagatactttttttcttacttcaacttattgcagaactaaaaccaatatcttcattttggctctgacttggaataaatcttactctgcctcctgggacagtgaaagctctgttgagaaactaataagttcggcccaaattctcagcagtgtgcttgatgaaaaataacaaattttgagaagaagaaaagaagtaaggcagttcagcttactagaacttgatccaaatattcagagaaaaattcaggctttggttatctaaacaagcaggtggagacagttaagaaattagcataagttaaataatgaaacattcattatttcacaattgaattactaaaatccttggcataaacatacttctatgtcacatgctattttattgttgctaatagaaaacagtcatgtataatttagagagatactttaattagaatatcaattatttccaaatatataaaaataataacaaatagacaagggcatctttagagccctaaatttcagcagcactgtatgtttagtggaatgtgacactttagaatgagttttcagacattccaatatatttctgtactttggatttttatagagtggaatgccttggtcattttttagagttttgatagtatattcagtattcttgcaaactacggataaagtaaatgactgttcaaatatttgacaagcactttataaagaaaaatatgaatgatataaaatagagaatatagtataatgaaaaggcacagcaaataccttctgttatatacactcatatttctcagtctctataacgatcctctaagatattatgcaatattgggagacagatgaattgacaagagatagtgaaaacgatatttataatggcatcaccagcagagcaggaaaagccacagagcagagcagatggggaataaagttctttgttctattcggtggacttccattcacaatttttcccataatttgtaggtggacctcattcagcctgcagcttccctctaatcatgggaggcagagtagcaaattggacaagctctctgtgaattccaaaagctttggatctgaactctggccctgccttttactaacttggggattttggacaatcagtttcatccttcttttacaaaatgagaaaaatgacgtatgcataattcctatcattgttgtaaggattaaatttgatgacatatgccatgacaagatttttctccctactttaccagctactcaagccctaaaccagctgtctccaatttctcatctttgctcaatgtcctcatgtaatccacaggaaagtccaactaactctgcttccaagacaaatcttgtatctgttcatttttctccatcttccctgataccttctacaccaggaattcttaatcttggaactattgacatttggagtcatgatcagctacataattcacaagacccattgcgaaatgaaagtgtagggtatcttgttcaaaatgaaggaaaaatatgaccctaaaggtactaaagtgtcacgacttttcctttcctctgcagtctctctcttgacttgtcatcaggttaatttgctattcaaatataattctaagttttaaaaaatgttaaattactagcatgaatgttatcactcatctttatattatacaatgccagctttaaatgcaaatatatgactatttaacttgcatgcagaatcgccaaaattatacaattagtatttcatagcttgtgtatgtatatgtattttgttcttaccagaacagtagaaacactgcacaaaactaattcaactgctttcatttaacttcctgatgtgtgcatattctaaattcactctgattaagaaagaagaaaaaggaaaaggaaacaaggcttatcctatctttcttccactttccttcaatattattattttcatagtaagtagttggctaacacagagaagtaacaagtaagaaaggatacataaggttcctaagcatgtgtgtttcttcgaaagccttggcctactttctccattggaagccatttcaagcagaaaacatagatacttgaggcctccggtcctgcttactcaatcacagatgtaacatagtgacattgaactcactgtgagccttgtagaaatcccacagaccatagatccgctggaattctgtgctcattgtttatggccaacagtgaacggcggacacacacaatgcccctgtctctatggcatacaggcatgctttattgtcccaaaggatttcacttacaaatcataagttccatgataataatttttatgaaatgtcaagatgacaatagcatcacgataaatctagtgtggcatctttgagtgtgggtgggaccctgtggagtcatgaagccatgaagctgtccccgttaacatgggaaaattctttttgtggggggctcttctgcacaccatatgatgtttagaaccattcctggcctctacccactagatgctagcagcagtgaccaaaggtgaatatttaaggagagaaatgttacaactccaatgtctctttggccatttttaatactggaatagtcaaagatctggagaaagaaggctgctgggaatcagagtgccccactctctacttatgtccagatgataaattaaaatggaaatgacattaccaaaaaaaactttaataacaagaaaagaagaaataaaagcccttaagaaattaatcaataaagacttcagaataggaaacatcaagatgattttaaaatgatttagtcaaacatttgccaagtgtgaaaaaagtcactcaaacggattgattagctgaatttatttaagacagttgagctcatctcctcttagacacaatctaaagatccattatacactcatgttttttaatagattcatttatattttattgatacataataactgtacatagttatggggcacatatattctgatacatgcatacaaagtgtaataatcaaaccaggtatttagggtatctatcacctcaaacatttatcatttctttgtgttgggaaatttcaagtagtctcttctaactattttgaaatattcatgaagttattcctaataatagtctctctactgtgctatagaacactaaaacttatttcttcagtctaacagttgcacgtttatgcctattaaccacctcttcatcatccttagcccttcacacactttctagactccagtgtctaacattctactctccagctgcatgagatccatttttttagttgccatatatgagtgagaacatgagctatccatccttatgtgcctggcttacttcacttaacataatgacctccagttccatccatgttgctgcaaatgaaaggatttcattctttttttgtggctgaatggtattccattgtgtatatatgccacattttctttatccattcatctgttgatgaacacttagactgattccatatcttggctattgtaagtagtgctacaataaacatgggattgcagattatatattcatttacaagacaaaatatacttggccccctttatttgtaacatatatacctgaaattttcatgtgaaaggtatgggatttaagagaaaggtgtgtgattatcttttctaggagttagtgacagtttggcaaataagtttttcatctagactactgacttatttatatcctttggatttgaaagaagattcaaatagtagatgacttcacaggtaaattcttttttttttttcattttttttctacatttgtctccctccctacttcttctctgaaattagcatatatttattaaacactactgtcaggtagggcatgagtgcgaaatattttataagacatagtccctaccctcaaggaatttactgtctagctatgattcatgtttttgttatttcactagttttctcctcaatcatctgtcactatcatcactcctattatcatctcatgaatatcctaatttccctttagcactatattataaacctattggaccaatttatctcaactcttttaaaactttcacttagtagtctccaagaaatttcaggacttgagaataatgaaaattaatatctttaaatttgcaacgtgccttttctttcactgcaaaagcaaacagtgcacaattttcgaatgacttcaaagtgcaaatgggaaagctgcaattgtaatgaggaaaaagaaatcaaataggattcaaatattgtcaagtaagccttcatcgtggtgggggtcttggtgtctttgtggtgattgaaatacttgacagaaaattgaaagaaaaaaaacagaaaatgtgattgagaattgatttaagagggtgacaaactcaacaggacttctaagtcatcttatgtaaaatgctgtggaagacagtgaccacttcctctcactgacaggcggttccctgtgctgtcaatgagcttccctcaaggctggattaaatacactctgggaacttttgaattaggcaggagaacctgctcagtaatttagagaatttagcactaataaagactaagatgattgtacataatgggattgtaggattttagcaatcctggtttagatgacaaatgctaccacgtaaagcgttttatgacaacatatgttataagagattatacttattccctgtggagctttttcacctccattttagctactcttagaatctgtactgaataagggaaataattgaggctgtgaaatttgattcttttcaaacactatggggaaaatgttaaataaatctgcataaaagacatccacaacataaagttgagaagcttagcttacgtgttaatcattgctttgtgctgtttgcaaaacaaccaccaaatttggcccaagacaaagaatattgcctcattaacaaatttggcaacgctacagtgacagtaatcacatttttattctattttcatattcgagacttcaaagcagcttaaaaaatattcattaacaaagcaggttgcagcatgccaaccagtagctgcatcagcatagtcagatataattttgtgagctttacctaggagggcagagtttagctatagccacaggaaatatacacacacaaagaaacatgttagataagattaatgaaaatgttctcttaaaaataaatgagtttctcaatgaaaggggaaaaaatcctgcaacataatttgtcctttggattttaagtggtgtggtcaatcattaatgagaaacataatttaagaaactttacaaagactgaattgttgctaaatacaaatatataaaatggtgaggaaatatacaaaatgtgccaagtttttcaaacggattcaaaaaattatcaagtacattaaaacatttaattacaaaagtaaaaaatgcagtaatatgaatgaaacaatgagagaaatcaatttcaaaacccagtgcgatgcggatgtggtggaattgtatgcattcgtattgaaaagggtatgaaagtgagaaaatcagaaactggtgtctcaaagaagattgaggcaaagggctagactggagcaaggacacgaactagcagctgtcttaagtcagtacttgcttatctttctgatgccagtgtgactgcaagtgtgacccaggttacctaggtttgtgtactcaatcccatatgtctgaaatgaagccaatcttacctgtatattttgtgggtgatgcattcatctatacacataaacatgaagatctaggaaatgatttattttggcttccaaattaaaccagaagtgccaatgtagaggaggatcagtagcccactgtgctcttgataatgggtgatgtgcctcactcataggtctggccattggctggggcaatgggagctattggggtcccatgtggccaacatctggtagatatcttaggtttcctcagataatattcagatgccaaaaaatcatggtcctttagtacatttgttgtaactgattacattgaatccactctgagccatttgaacaccttatctaccatttacctatctatcacctatctttacctatctgtctgtctgtctgtctatctatctatctatctatctatctatctatcatatctctctgtctgtctgtctatctatctatccatctatctatcctatctatctaagtatctatctatgtatcatctatctatctatctgtctgtctgtctgtctgtctatctatctatctatctatctatctatctatctatctatctatgctatctataaactaacaggtttagttagtgaaatgaattaataagacctgaggaataattatgtgacctagactagggtcacattagattatagagatcatgaaacaagttgtttgcatcattggatatgactgtttctcaaagtttttctaatgtcacagttggtactggaaatgttctttcctcgggtgaattcaaagagacaccagagatcttaacagtccatagtgtatatgctgagagcaaataaactgagtcagtaatatacataatgatcatcaaaatccaaacattgaccagatagctcaaggtgttctaaagctataataggcatgtaacacattttctgtcctgcaacaagtatgtaagtatgtgtgtttatatgcatgtttgttttaaaaagtgtatctttttaaataaaagacttggagtcatttataagtaatgcatataatgaaataaaaataaataaataataaaatgaatgccatttgatctagcaatcccactactaggtatctacccaaaggaaaataagccattatatgaaaaagacacacacatatgcttatagaagcacaattagcatttgcaaaaatatggaaccaaattgaatgcctatcagccaacaggtggataaagaaaatatggtatatatacaccataaaacactactcagccataaaacagaatgaaataatggcatttgcagcaagttggatggagctggaggccattattctaagtgaaataactcaggaatagaaaacaaagtagtgtatattctcacttataagtgggagctaagctatggggatgtaaaggcataagaataatgtaatggactttggggactatggaagaagaagaaaggtgggaagggtgggaggggaggtgagggctaaatgactaaatatcaggtataactgggtgcagtgtacactgctcaggggacaggtgcacctaaatctctaaaatcaccgctaaagaacttatccatgtaaacagaaaacccctgtaccccaaaaacaattaaataaaaaaatatgaatgcaggcagagatatctacctcataatctaatgccaagactactggctaaatataaatacataaatttattttgtctaaaaaaaagagaatgcctaaaatataatgaagccaagactaggaaaaatatgaatgaaataaaatgctaagtaaaagaaaggagaaaaaaacaaatcttatatgaaggatgccaagcattcacaatttctatagtttactttcctgatgtctaaagctaaaagagaaaaaccagctctattgggctattcagttgtaaaatgtcaaatttcattcttacatccattctgagaaaagaaaggcaagttcttacttccaaaactgtaagtgaaagaaatgcaagcacagaaaaatcagatgccaaatacagaatcacacaattgcttattgaaagatttgggattaagaccaagcatatcagttcctggccaagtgtatgtttcctaatctcccaggttagctaggccagtagctactacgcattatctggggttagaggagactggttttgcttcccaaatggcaagtgatacagcaatggacaatgacacaagagctctgtgctcgtgtttcttatagtctgtagtcacaggatcacacatggcacccagagaacactcgggactcaacaagtgtttgttgattaattaaatacagtttgcctcctacagcattcgtgatttccagtacaaattaacagagtagaacgccgtgaaagaatatcatccttccagtaagcagctagacttttattctcattgagctaggaatgcatatgaataaacatattgttaaccattgaaacatgctcatttcagttcatttggccatgactctggctcatttttcctggcctctttcaatgtattagtaaaatcccgacttattcatttgactgaggatagcatattcctgagagttatgtgttgatggaaaataaaaaacagatgtgtatctacattactaatcctgctattaaaaagcaactgaacactgaatgatgccttaagatgtgacaaaagccaacctgatctcacctgggctcgggctgggttctgagatggcctcactcacaggtctggcattcaggtggagtgatggaagaaattggaaccctcatttcaccaacatctagaagttagtttagtgttcctcacatggcatttggatttcagaaacatcaggagtataacaagcaaaaaataaaacaaaaccaagaattttcaaacttctgtgtacagaatggttgctaatgggagaaattagaaatactggagccatttttgtctttttttgcagtcttctagaatactagtttaatttcactttttttttctaattgccttgtaaaatacaagtgagttattaaattaacttggctctttttcctgttaatgtattaaagataccttataaatcaaatgaataagaatgtaatgaggcactattatacctagcactaggtgatggcaagaaggaaaaagggcctctactgttttcattagtttatcatacatcatggtttccttgataaatcgtgagattgctgtcaatattttttgtttcttgttttctttttcttaaagagcacacatttattatcttacagttccaagtgttagaagtctaaaataggtctcactgagctaaaatcagtgtattggcgggtttgcattcctttctaaggactccaggggagaattctttttcttgcttttccagcttctagaagccccttcaattcctccaggccacttcctccatcttcaaagccagcaatggccagccaagtttttctccatcacaccaatctgactcttactcctctgtctcccccttccacgtttatgtttttttatttcaataggttttcgaggaacaggtggtgtttggttatatgaatatgttctttaatggtgatttctgagattttggtgcacctgtcaccctagcactgtctactgtacccaatgtctagccttttatcccttaccctcctcccacccttcccccaattccaaattcccaaagtctattgtatcattcttatgcctttgcatcctcatagcttagctcccacttatgagtgagaacatacaatgattggttttccattcctgagttacttcacttcaaataacggtctccaatacaagttggagagattttttatcaaagaaaaactactgctgcaaactgttctctttagacctgggtgaccattgctcatagaaaggatgaagtaacaatgttgacaagcctttgtcaaaccagagctactgctagtattggggttaaggccaggatcaacaaaacgtatattccccacaggtggctgccccttggtatttggctgttctcacactgctccaaagaaatacttgagaccgggtaatttataaggagaagaggtttaattggcttatagtcccataggctgtagaggaagcatgctgctggcatctattaggcttcttgggagccctcagaaatcttacaatcacggcagaagccaaagggggaacaatcatgtcacatggtgagaatgggggggacagagagtgtggaggcgcaggtgccgcaaacttttaaatgtccagagcccacaacccacgaggacagcgccgaggggataatgctaaaccatttataagaaacacactcccatgatcaaatcacctcccaccaggtccccccttcagtaccggggattacaattcaacatgagacttgggcagggacaaacatacaaactatatcacccttcatgcttatgctttctaactgtttaacacttaaagagcatgggaagaaacttattttctattagaaaatttttatctttattaaaatatgagagatttattacacacactcagtgtaacatggcctttgaacttaagtttgctgtcattgttcttttttcgttgttcataaactgagattgttcattactaataccctagatgattctagtcacctaaattctttatttaaaaataatggaggaggtataaaaatatgttcaggaaatatattcatgctactcagtgaagactgtagaatattacgatttagcacatggaatatagaattgacttcctagttgcaatccaagttcttccacttgctatttgtgtcaccacaagcaaattattttaacattcttaagcatcacatttctaatttgaataatagagacgataatttcaacctccaaatattgatgtaagagttttaaaatataatgtgcgaagagttcttaacataaactcaccgttcaataaggtggagctgttatcattaatgtagtttatgagactgttatttccattataaacttataggtctttagatctatgaatttaatcaaatgatcttacttttggacaaatttaaaacaacactgaggggagatgaaataacattgctggaagaatgtacacttttatttttagaactgcatttttaagaaaatatgcagaaaacataattctgaataagtagatgaatatgtctctgatgttcttttgaagtatgaactcctcttctaccttcaattttaactcttacatttcaagtaaaaaacaggtcatccaaagcatcctttatgtcagacacaacactggcagcagcaacccctattactaagctctgttagatactttatcatacaaatatttgaatctcatgttgccattgaacatctcatatttttatcgatatgatgatattttaaaaccccataatagtgcctacaagatagattcacttttaatagaatttatctatgcagcagctaatatagtgaaaagtaccgtgatctatggtatttgggggtggaaaggttgaacctttgtctagcattgattatgaaataatttgcctattaaaactatagagatttattaatctgtgttagcatctgctctttcatttttaaaatattttatttacataaattatcaaaagtctgttatggatatatttgcctctgtgtataaactctcctccctgaagagtcttgtaatagttttctcttctttcttgtgcaatgcctattctgcagtcatgtagtcgaggccttgctctggctgtactcacaggggctacctggaaaagtcattcagttgcatggaatactgagttgtgtcaataaacgctttctcaatagctttcttttctcctcctgccacctgccttcccactccaccccctagtctgacattctcaggttgcattaattctgtctcatgttctctccattagtgtgaattatttgttatattttgctttaattgccatccactgtagtcttttttaactctctccatctaattttgtccattccaccttcattatttctactcttttcccaaatctctcccaaggcacagattccccaggctctcccttattttgctagaacatttagtatgtttcctttaatttttaaatcccagtaatgactgatgcttccaaacactttggatattgggattttaggttaaagatgattcatggtatgaattacaaagaaatgatttagttcaaagtgactggattagtgatttagaggagactaaaatttaagattacttaaggtaggctcgggagaaaaaaatacaaaactaatcataaaattttgcctaaggattatgtcctctttgaatatgttccttattcccaaaacatcctttggctgtaaatatagataattcagttttatagttttacaactattcagttaatttacaactccttaaaagtgaggttagtgtcttacactcactgagaaacatccccaaagtcttgggatttcatcttctgtctttcaagatttatttcattatgaagcaggttgctcaccttccaaaagtggaaatccttcatctgtaaaacagtgttaatgatgtatacttcagagtcttagtatctagggatcacagcagcaaaatcaggaactaccataattgctactagcatttggagaaaaatattccacagtgtattagaaagcagaggtgttggtgttagtgaaaggtgggtttgagtatcagctcatgggacatactaatggcctgatcttacatttgtcacttataccatatgactctgttctctcatctagaaaatgagtatcatgggttaggcgaggtggctcacgcctgttattcccgcactttgggaggctgaggcgggtggatcacgaggtcaggagatcgagaccatcctggctaacacagtgaaaccccgaccgtctctactaaaaatacaaaaaattagctgggcgtggtggtgggcgcctgtagtcccagctactggggaggctgaggcaggagaatggtgtgaacctgggaggtggagcttgcagtgagccgaggtcgtgctgctgcactccagcctgggcgacagagcgagcctccgtctcaaaaaaaaaaaaaaaaaagaaaagaaaaagaaaatgagtatcataatagcgctgtattagaagacaccaatgcctgtgctcagcagagcagtggcatccacattctctttttgtgcatagttttccagcacagagtagaacgcaccaaatgtgttgattaactgattcctataactttgaatatatcattaaggaacacaaactaagtaggtcagaagactatagtagataaaagaagaagaaggtacaattaatagtgatattgacacaaaatgacagttctcaaaaaaaagttcacgaatctgtataatgatcaagattaaagaaaattttactttgaaaactaagtttggtaattatatttagcggcaaaaaaaatgatgatcaaaacacttccagttaacacaaagaatttaaagttgtgattagcttgtagatagaacttgaatttcattttgagaatgattgaagtttgggttaaagatggaactcaaagaacagcaatctgcccacttaaaaagttactgtttccttttttcatattaaagtgttttattctgtaatgacgtactgagagacagaaactcacccagcttgggttaaaaatcatacaggatccccatgtttctcttttcggttcctctttacaatgggcattccactatgagatagcacagataacttggctgagaactcttcatttacacacaagatgcacagcctggaggtatctcatagcccttgtcatggactgaattgtgcccctcccaaattcgtgtgttgaaatcttaaccctcaatacttcagaatgtggctgtatttgaagatctggtctttaaagagataaaatgaaggcattagagtgggctctaatccaatatgactggtgtctttacgagaaggcattaggatgcagacacaaaggggagatcatgtgaaaacactagagaaggatggtcatctacaagccaaggagagaggctgcagaagagctacatccctgacaacaacctgctctaggacttctagcctccagaactgtgagcaaataaatttctgttgttcaagacttgcagtcatggtatttgttatgacagccttagcaaaataagacatccgtgttcacactgtctccagcactggatgtaggaaaatctcttttattatcttattccaaaatttgctcaatatctgaaaggtaatcttcagattcagatctgtgtgactctaaacaaattttgaaattttatacatattgaaattttatacattatatatgtataaaatatatacatatatatattgctaatggtaaaactattacatgaacctagcaaaattatcacttgggcttaccattgtcatttttactactaataatgtaacttttagggttgaatgtaccaacaacacttttaaacattctatataatattgcaagcagttaattttgttgggtagtttcataaggctattttttatcctcctataaaatatttgagtttttaagggaagccccccaaaattgctgtatcagaaaaaaaatggttttgtaattgtgcctctaactctaaaatggaatattaaaaatgatggataaaattttcacaatagtactttaagacatctagaaatttgacagatgattgtcacgattcaatccctttttcttcatgttttgcagtataaagcaatattttaattgagaagcatttgacaaaacagaaatacatgctgtatacctctttatgcatctgttgagatgttcttaaagtcagcattgatttgcaaaggccaagtgccccacagcccactggagaagactagatacaattccacaaatgcttactactgtgtcgaaatttgtagcagttgctctgattttaggtatggatatgcagatgaataagtcatgtctcctttcgtcacagattttacagtctggtggagagacaaacatgtttaatgttatttagcacagtatgtgctatgagagacacctgtatatatcccagggtttatcaccaagtgaaaataagtgatctcaggttgactgataccttagcacagagtaaaatgaatttgaggcaggagcacgttttctaaatgtttttgtgtgctacaaggcaaagagaaaacatactgctcaagaaataggagatagttggggaaaaggcaatttatacatgaaaggtatgagaagcaattctgaaaggaagatagagataagaaataaggcataaaactaccacccactaatcgcctttccccaaaaaaatgaataagcaaaggtcaagatcaggggctttgaaaagagaaatgcttgaactagaacatacacaataggtaaaacatatttgcattggatccacaaatgcagaacaacccccgatatccccaagccaacttttcaaatttttataaaaatagactagaattaggccaatttaaatcatcacttatttgttgttgcagccaacatttggatagttattagcatcattcattcctgaagcatgtattgaatgcctactatgttccacacaattcaataacaaataaaatcaagcttagagccaagtgaggctctaataacttcgaaatggcgatatcttcatctatcctatttattgagaattgtctatgtttagagcacggtagcagggtacaatatagccaaatgctgtcgctctacataggaaaacacaccgagttttatctgctactggttttcagctgccagcagttctggaaaatttgagaattgtctatgtttagagcacggtagcagggtacaatatagccaaatgctgttgctccacataggaaaacacaccgagttttatctgctactggttttcagctgccagcagttctggaaaattgcatcctaatgacagatgctactatttaaaatgaaaactgattttttttttttggtaaaagagactgagagaaaaacaagttttagacaaattccaaagcatgaaagaatgctcatcccaaccatttctgtgggaagaatatctagaatgtggttggcagccaaatagccatataactgtgtaattgcaagctgagtagagaaagagactagcgtcaagtgggagatattccagggacaagtagaaattcaagggaaaaacgcaccgtggggtcacagaataagtcttttcacaaatcctgtgacaaatgctgtttgccacatgtacttaatatctaattggaaagataattctggctgtctttagctctcagggctcttaggagtttgatgtgacatacaggtgttaaagtacgtaaaaaatgttaaacaccagataaatggaaaggtttgtgattaaaaattaagtttcaccgcattgagaaatgccacaagtaggcagacttgcagaagtattgtcttcaaagatgtggaatgagctatgtggaatgaaccaagaataaaacattcctcataattgtgcccatgcttaaagccattgccaccagcagtaactttatcaaaagagggcataatcagtcagaagcaaacaatttcaaatcactgcaaatatcatgtgacccatctgaagagccattttgccacacttttaaatgtgtttttctcctgatggatgattaaataggcagttaatgtcctttttccttgagtgattgaaggacactaagtcaaaattacaatttagacaagacaaggaattctgcactgatgttctaatagcacacgatatttgaaatgatgatttatactccagtccttcttgacaggatgtgcctcatgctgaggatgtctgtctgtctgtctgtctgtctgcctgattcattggcacatgtctttttgtctggacttagtactggttctccatgaagtaggaccctttacaactagaaaacttacccttacccccaccatgtctctgggctgaaaactaatagtcccaccaaaactgtggccagagttgttggaagactcttcctataattaatgtcctataaacttaattctcttcaacaaacattcattagatactaactctctttgttaagtactatagactacacaccacacaaggataaacctccagaaatttatcagctgctaagagagataaaccatgtacatcagtgtggtaagatattttgtattaaccatctgcctctgctacccctcctcctgggtcctcacacccactctgtgtacccagttagatttcatatgccaatttccttggagaagcactccatggagaactgagaaacaacaaaatgaaatgctttgctcttaagttctaatgatgaaatccatggagatcttgatccaaataaataaataaataatctatgatccagcttgttatctcccaactgaaactacacaaaggatctacagagcaggtgaaagaatgaggcagtggtccacattaactaaaatgagcttgataaggacagaccgctgagccccgcttggcaggcgcgtcagtaaccagcatcagggagtcagtggaactgttcttctcctacggaacctcaggtcttcgtgcagataagccctgtacattgcctgtgaaaagaagttctatcagctttccttctctttgtcatttgatgaggctttttaatcactttaaactcccagctcccatcaccgtatcttttttatgtggacaagcctctttccaaaaacccaggacacaggatggagtcctggaccccccaaaaaatggcagtgatgggaagggaaaagtcccacaaccaagaaagatgggatttagcagaagcaactgaaaatcttccactagttgaggcagtgctaaaaccaatgctcatttgacacaaatgttttcttaggcgtattccatggaccaccaatatactgtaaggtgaaagtgtctttattattaaaaattcataattccatagttaagcaagctctcaaatgttttatattctaaatccttccataaatgtctcaagactccaagaaacatatagtaggggaaaattacaatttcccaaatttaaacgatcacaaaattctttgtcaagaaacatcaatcttacagtacactaatgttccatggacaacagtcttgaataaatattatttaccatgaaatatattgcgtatctattatgagttaaatactaatctaaaagaataaactagaaagcagtgttaaccttaccagagacgcagattaaatgttgcagagattcaaaggaaagaaacctcattcctagccaagacgtataggcggtgatttcaggaacatggcatttaggtatggtcttgaaaatcaggcagcttttgaatattggggggtggatgggggaaagttatgctgtgatgagaaaatagcagaacaggtataccaaggggaagagaaccagcatgaagaagagaaagtagcttttcttggctgtagaataggaaacccaaacagattaacagatatgacaaggcagaagaggctgattggggccaaatatggggagcagtgatttcaaaacaaagtttgatctttacttcatagaaataaccatgacctgctccaggttaataagcaaaataatcacacttctaaggcatgactttcacatcatccaattaacatattcatgatgcacatattatcatattgcattcatgagtaacgtagagttaaccctccagttaaaactgtgagacagaaaaaacatattttttgtcactaccctttttttctgctctgtgcaacttcgctagaattaactgtggtcctatcttctgagtacatactaattagacttcctgccacctaagaatctttgctatcctcatttttcttcctcatggatatttttcatttttcctcacctctctctgctattatctatgcacctctccacttttcaattattctacatatttaacaagttcccaagagagaagagtgtccaactggtgcattttatttgacaatagctggtatttatgtaatgagtgctgctatgtggcaagtttttcttgcatacatttatttttaagaaacacacattaataattcccctgtgcaagagatgaaggtaagaggtaatagtaatttacacaatacaaaccagaagttccaatttatgcctgtcagactacaaggtgcattcgtaactctggtaacaatttatttctgggccttcagagacaaggttgcttaccttcctaagtaactctaattaaaacaacaacaacaaagttttaaggaggttgaggatgaaaatttggccttagaaaaaacaaaggattatctaaggtttgcctattccgttcattcaataggccactctgcttaaaaatttaagaattcgctaaacctcagtccactctgttaacaatattcattggaatattaaatgtttatttatttatttatttttgtctaaaggatatttgggaagtatactgtatcaaagcagcagaaaaggagctgtaatagttacttttcagtgtaatactaagcagttaatttttttaaagaatgatttcgcggatttttaaataacctgattttataaggtaagcaaaacctacttaataaatgaaccaagtctaaaatctacctataacttaccagcagaaaacttaaaaataactacattattatatttcaaagtattcttaaaaacttgaattagcctctgtaaaactgtaaaaatacaaaataattgattaaggaataatatataaaagatgggaaaggacatagcttatgagaagaaaaaattaaatagagaaaaggaaatagtgtgatactaattcagttgagtaaaaattcagttattcattgtttttcttaccagaaatatgacagttaggcaaactacttaaactctgtgttttagctttctcatctacaaaaagagatatgaatagttcctacttcctatatagttgttgagaagttacaagtagttcataattgtcaagggtagaggaagtgttcaggatgtagtatgagccatttaagtattgactactattgttactaaagggactgaaaatgacaactatgagtattttgcattttgcttgaaaaataaaacgacgtgtggatacaaaagtattaaatatttgcaaaattcacaatctatgaagaattacacaaatgtggatgacaatggtcgaagaattgaagcactatggtgatcattagagactcaccaaaccccttccttctccttgggcacacagtaggatttcatttctcagccttatattgcaactaggtgagtccacgtgacttgagtgttgtccattggaacatgcacaagaggtatgtgggtcacttccaaatgtaaaatgtcaaaatctcccacagtatccttggtgtgttctcactcctcatatcctgggcagatgccaaaggagatttcactggcattgggagatctcagagacagagagagcctgtgtgctctaatgatggtgcagtgaacagcctccacttcccaacttgccatctcacattttgatcacgtcatgaacattttttgttttaagccactttggtttcgaacttatttttcacaggaattagcctactataactgacagagtaacgaaaaagtattcaaacaggaattgggacacttgtgtccaaattgcctttctcacgtttactaactatgtaaccccagggatttactcaatctctgaattttcttttctttgctgtaaaactcctattataaaagttgtaggtcttcaatccatcttgaattaatttttgtataaggtgtaaggaagggatccagtttcagctttctacatatggctagtcagttttcccagcaccatttattaaatagggaatcctttccccattgcttttttttctcaggtttgtcaaagatcagatagttgtagatatgcagcattatttctgagggctctgttctgttccattgatctatatctctgttttggtaacagtaccatgctgttttggttactgtagccttgtagtatagtttgaagtcaggtagcgtgatgcctccggctttgttcttttggcttaggattgacttggcgatgcgggctcttttttggttccatatgaactttaaagtagttttttccaattctgtgaagaaagtcattggtagctttatggggatggcattgaatctataaattacattgggaagtatggccattttcatgatattgattcttctgacccacgagcatggaatgttcttccatttttttcgtatcctcttttatttccttgagcagtgttttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagtttaaggagattttgggctgagatgatggggttttctagatatacaatcatgtcatctgcaaacagggacaatttgacttccttttttcctaattgaataccctttatttccttctccttactaactgccctggccagaacttccaacactatgttgaataggagtggtgagagagggcatccctgtcttgtgccagttttcaaagagaatgcttccagtttttgcccattcagtatgatattggctgtgggtttgtcatagatagctcttattattttgagatacgtcccatcaatacctaatttactgagagtttttagcatgaagcgttgttgaattttgtcaaaagccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctgaattcggtttgccagtattttattgaggatttttgcatcaatgttcatcaaggatattggtctaaaattcaattttttggttgtgtctctgcccagctttggtatcaggatgatgctggcctcataaaatgagttagggaggattccctctttttctatttattggaatagtttcagaaagaatggtaccagttcctccttgtacctctggtagaattcggctgtgaatccatctggtcctggacgttagactaaaaccataaaaaccctagaagaaaacctaggcattaccattcaggacataggcatgggcaaggacttcatgtctaaagcaccaaaagcaatggcaacaaaagccaaaattgacaaatgtgatctaattaaactaaagagcttctccacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgacaaaatgctcaccatcactggccattagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccattccgttactgggtgtatacccaaaggactctaaatcatgctgctataaagacacatgcacacgtatgtttattgaggcactattcacaatagcaaagagttggaaccaacccaaatgtccaacaatgatagactggattaagaaaatgtggcacatattcaccatggaatactatgcagccataagaaatgatgagttcatgtcctttgtagggacatggatgaaattggaaatcatcattctcagcaaactatcgcaaggacaaaaaaccaaacactgcatattctcactcgtagatgggaattgaacaatgagaacacatggacacaggaaggggaatatcacactctggggactgttgtggggtgggggatggggggagggatagctttaggagatatacctaatgctaaatgatgagttaatgggtgcagcacaccaacatggcacatgtatacatatgtaactaacctgcacattgtgcacatgtaccctaaaacttaaagtataataataacaaaataaaaaaaaaaataaaggtggtaggaaataaatagtatagtttcagggcttggaatggagtgtaaatattgtaatggacagttaaatctaaatgtagcagtaatttagtcaatacttacatagcactgaaatgtctatattgggtaggacaattagtaaaatcatattttaacaataataacaactatttagttgcctgaatatttcacttttcaatagctgatttcacaagaatgcagctctcaaagatatcgtgttgcttttaaccattttctccagatacatggtatcaatatattcaagaaaagaacagggttttatttttttcctgatgtctttgcaccaattttcccaatttcttttctaatagagtagcttgtatttaatatgcacaacaactgcaggtcattaattctctgagtctttcctaaatcaatcctctggatgtggactagaatcttaatacagttttagtagttgggaatctcatctaatttattacatggagagaggtatgacacaggaaaaatgcatattaactatgtagatgaatatgttttttttttctttccaagtatctgttttcttttcaaaatgatcatgaatagatagctacctaaggaaggttgtcacattagcttaatcaatatagaaattctatatatgaatatatatataagaatatagtattatgcatgcatgtattttacagctagttgtctattttctagaggcagctagacagtggtgaagagcaagtttcagctttgaggttttttttaactttttattgggaaataaaatagacaaccacgaaaaaaatgcattaaacattgatgtaaaaattaacagttggatactaaataaactgttgtacaactatcacatataactagaaatttaacaacagtaccagcacctcagaagccctccatgtgccccttctcaattaaaattcctccctctacccgatgaaaccactcttttaacttttgtcgtaatgaatttcttgctttcattatacttttaccacctaactatgcatccttaaacactatagtttaattttcatgggtttttgaagcttatgtaatgaaatcatcagttttattcttttctaattttttctttaacttaaaaatacttcataagatttattcgtgttagggccaggcgcggtggctcacgcctgtaatcccagcactttgggaggccgaggtgggcagatcacgaggtcaggagatcgagaccatcctggctaacatggtgaaaccccgtctctactaaaaatacaaaaaaaaattagccgggcttggtggcgggtgcctgtggtcccagctactcgggaggctgaggcaggagaatggcgtgaacccgggaggtggagctggcagtgagccaagatcgcaccactgcactccagcctgggtgacagagcgagactccgtctcaaaaaaacaaacaaacaaaaaagatttattcgtgttaatttatgtagctgtagtttgtgcattttcaatgctgtataacaattgtttgaagatgccacaatttttatatctgttttactgttgatggacatttgggttatttccaatttgggactattacaattgtgatgccattaacatttttgtgatagtcaataacaacgtacacttaaatttttgtcaagagggtaggacttcacattgggttcttaccaaaacaaggtaaaatagtaaaacagaataataattcttgtacgtgtctcctggtggtcttagtggtcatgtgcacatctgctattggatgttgccttagaggtagaattgttggcttagaagtatacaatttatattcctaccaacagattatgagtaaaccagtggctccccttccttaccaatgcatgagcattctggtgagtatattatactattgtagctttaactgtcatttgattgattgctaaggaaattgaacacatatttatgtttctcagaaatttggattttctcatttgtgaagcagctttgaagtctttgctcttttttgactgggttgtttgtcttctacaattgctatgtacattctgcatatagtgttttgttcatttacgtgttgcaaatattttttctttcattctttagcttatcccttcatcctcttcatgtttcattttcatttgacaaacagaagtccctaattttaatataattttccaacttcttctagtatggttattaccttttgagatgtgtttaagacatatttttcaaatgtgaaggttaaaagttccccaaaatactatctatgtaatcttctttaaactttgcagctaaatagctttaaaatttagctgtatgaggtattttcaaaaagttcatggaaaatgcatattatgaaaaaaactatgcatgtatttcaaaagtttttgcaccaaaataaactcagactaacttattaaaacatgcctaaacaggatctagtttgaggcactaaaaaggataaggtataagttataaaagagcatctatcagaaaaacatgaattgtgctaacattgaagcaagaacaaacatcaaatttataattaatggtgaaagaatggtgaaatcagtgatggtttacaaaaagtctatggaaaaaatgccccaaataagtcagcagttcacaaatggataactcgttttgtttttttgtttgtttgtttgttttttgtttttgatacggagcctggctctatcacccaggctggaatgcagtggcatgaactctgctcactgcaagctccacctcctgggttcatgccattctcctgtctcagcctcccgagcagatgggactacaggcacctgccaccacacctggctaatttttgtatttttaatagagatggggtttcaccttgttagccaggatggtctcgatctcctgacctcgtgatctgcccgccttggcctcccaaagtgctgggattacgggagtgagccaccgcgcccggccacaaatggataactcattttaagaagggatgagatgctgttgaagatgaagctcatagttccaggtcattcacatcaatttgtgaggataaactttattttgttcatgtcctaattgaagaggactgaagattaacagcagaaacaatagctgacatcacagacatctcaattggcttagcttacacattcctgactaaagaattaaaattgaatgtgcaaaacgtttgtgcccagatcagccacagaccagggcagagctttcagtgaaaattttaaagaagtgggatcaagaaccttaagctctttcttcaaataataataatggtagataaacatggctttaccagtactgtcctgaagacaaagcacaatcaaagtaacagctaccaataagtggtgtggtccagtcaaagcacaagcagaccagtcaagagcaaagattatggcaacagctttttgggatgctcaaggcattttgcttgttgactttctgaagacccagagaatgacaacatctgcttatcatgagagttctttgagaaagtcagtcaaaacttaatcagaaaagtgcccaggaaagtttcactggcaagtccttctgcaccatgaaatgtttctgttcattcctctcatcaaacaagggccattttctgagactttttgatggaaaaatcatttatcatccaccttatggtctatatttggctcttcctgattcctttttgtttcctatgctattgaagttgttgatttatttaagtaatgtgatcaatatcaaatttcatttttttcaaatggatgtctaattcttcccacatcatttattgaagaactgtctctttgctactgtgcttcaatgctacctgtgtcataaatcaagcatttaaaaatgcaacagtctatttctggactctgtgatcgttcagttgtctgttttccaatcctggtactaatatcacattttcttgattgctattgctttaaaataagccttgatgtcaagttaagaaactcctctcatgttcttttttcaaaggaatcgtggctattattgacctgttatttttatgtgcattttagaaccagctcgttaagttctactgcatccccaaataaaaagcaagctggtatttttaaaatagactttattttttagtgcaactttgtgtttacagcaaaattaagaaagtacagagacttccctgatactacgagctcgcacacatatataaccctccccattataaacactccccaccagagtggcacatttgttacaactggtaaacttacattgacataccattactaccccaaatatattgtttaattaagtttcactcttggtggttgtacattctatggatttggacaaatgtgtaatgacatgcatctatcattatagttttaaacagaatattttcactggcctaaaaatcatctgtgttccacgagttatccctccctcctccctcattcccagaaaccactaatctttttattatctctatagttttgcctttgccagaatgttatatatttggagtcatacaatatgtagactttttattggcttctttcatgtagtaatatacatttacattttcttcatgcctttttatggcttaggagctcatttctttttagtcatgaataatattctattgtctgatgtaccacagttgatttatccatttacctactgaagggcatcttggttgcttccaagttttggtaattatgaataaagctgctataaacatttctgtgcaggtttttgtgtgaacaaacctgtgagttaataccaaggcattcaatgaataatatggtaaatgtatgtataagccttggaaaaaattaccaaactgttttccaaagttgtactattttgcattcccaccagtaatgaataagagagctcgtgttgctctaaatccttgtcagcatttgatgttgtcagtgttttgaattttggtcattctaatagatgtgtagtggtatatcattgtttcaatttgagttttcctgatgagatatgatggggagaagagattctttgtcctcaatatctcttctttgatacagtgtcttttggtattttcaattagactgcattatatctcaagatgaatttggggagaattgtgacctttgtctccacaaaattatatgttgaagccctaaccatcattgtgactgtatttggagatggtgtctttgggaggttattaaaacaaactgtgatcataaaggtggtgccataaccagataggatttgtagccttataaggggagaaagagtgtatctctccatgcacatacatcaaggaaaagctgtgttagaacacaagaaagtggctgtctgtaggccaaaagaagaagtctcagaatgaaatctgccttacaggcatcttgattttgaattttccacctttaagagcaggaagaataaatttgtgttgtttaagctacccagtatataatattttgttatcaccatctgagatgacaaatagattttggtaccaggagtgaaatactgctacaacaaatacctaaaaaggtggaagtgactcaggagctgggtaatgggtagagactgaagaagttttgagatgtatgccaaaaaaatatggacattaagagtggtttcagttagacattagaaagaaaagaggagagctggagagaaaacttccatctttttagagactatatagccatgaaaagaatttgataaaaatatgaatgttaaaggccactcttgtgagatgtcaaatgaaaatgaggaacatagtattggaaatgacaaaaagtgagacttgttataaaatcgcaaagaacttggctgaagtgtgtttgtgttctagtgtttggtagaaggtagaactggcaaggattgaaatcaaatacttagcttaggaaatttctaggcaaagtgtcaaaagagcagctttgtttttcctgactgcttatagtaaaaagcaagaagagagagatgaattgaggaagacattattaaacaaaaaggaactggaacttgaagatttggaaattctcagccaattcatattgcaaatgttgatgataaagtatgtactgaggacaacaccaatggtgtgactggactatcacttgataaaatgtatgtaagattatactaacagaaatacagcaagtatgaactgaagggaacaaagataagatgaaatgaatgaaggccatcagactcattaaatttcacaggatgagtagatagaacaatttggctgcaaatgtattctatcctttaaaaagagagagaaatggccccaagataatttagagattttcagggccactaccttggttgcaacaagctagatagttgggggcagaactcgctagcagagccttggcagcaggttcttagggatgaggttttagaggcaggagcttagggatgagaccctaagaacaggatcaactggcagattttatagagccatcaaagccaagggtttctatttctagatattttttatttcagtcttttcacatatgatatttacatggtaaaattttatttactgtttattgctggaattagatataaattgtgtttgctgacttttgccagcaaccatgtcaaaactcttattaattctaataatttctttatattttatcattgcattttaatacacactttagtattatcttgccaatttctgctaaaaactacctgagattttgtaggattgtgttgagtagacaaatttgggtggggggagtgggtattacatttttaacaataataaatatcttgatctgttagtataagttgcttttctatttacttagatctttaatttctttaaataatgtttccatttatggtgagacatcttcacttctttggattaatttattcctaagtattttattcttttgatgctgtcttaaattgaattatttacatttttagtttattttattgtatttttaacttttattttaaattcggattacagatgcaggtttgttatctgggtaaacttgtgtcatgggggtttgttatacagattatttcatcacccaggtttttagcctagtaccctttagtcaatttttctgatcctctcccttctcccaccctgcaccctccaaaaacaaatatcatttaacctagcaatcccattactgggtaggtacccaaaggaatataaatcattctatttttttattttttgtagaaacagggtctcattatattgcccagactggtcttgaactcctggcctcaagtgacctgctggcctcaatctcccaaagtgttgggattacaggcttgagccaccaggctcagcctgtatatagattatataattgatttttgtgtattgatagttacatcctgcaacattgttgagcttttttattagttataataactttcattttatttcttaggatattctgtatatataaaatcatgttaactacacataggataatttacttctttcttttgtatctgaatgtcttttattttattttcttgcctaattgtcctggttagattgtttagtacaatgttgaatagaagtcgtgaacctgggccgggcacgggggctcacacctgtaatcccagcactttgggaggccaaagtgagtgattgcttgaggccaggagttagagaccagcctggccaaaatagtgaaaacccatctccactaaaaatatatacaaaaaaattattccagtgtggtggtgcgtgcctgtagtcccagctactagggaggctgaggcatgagaatcgctcaaacctgggaggtggaggttgcagttagcggagatcgcaccacttcactccagcctgggcgacagagtgagttctatctcaaaaaaaaaaaaaaagaaaaattagtgaacctggacatacattcttgtattgttcctcatcttatcaggataatgtatagtccttcaccatttttaacgtgatgttagtttacatttttcacagacaccttttattagtttgagtaagttcactagttttccgtgttcattaactgtcataaaaagaagtttgtatttttctaatggtttttctgtagctattgagatgaccatgaggttattgttctttaacctattaatataatacattatattaattgattttcagctgttgaaccaaccttgcatcctcaggataaattcccacttggtcatattatataatcctatttatgtgttgctggctttgttgtcctagtattttgttaggttctctatttgtatgaaaaagagatatttatctgtagctttcttatggtgcttttgtgttgtttggtgtcaaggcctcatagaaggaggttggatatatttcctcattttctatgttttgaaaatttgcgagagagaggtgttatgcttcaaattttctctagaatttactaatgaagccatttgggcatttatttgtgggaagttttaagatttttaatgtattccctatgatttgtttcaatccattcagatattttaatttttcttgaatcagtcttggtagtttgtttctagaaattattccctttcatataagttatcctaattttgacttacagttttttatagtattcactttcatatttaaaaaaaaatatttctgtaaggtcagtagtaattttagcaatgtaagtcttctttattttttttcttggtcggtgtagatagtgtttttaatttattcatcttttcagagaaccaaattagattttcttgactttctctattgtttttcttttccattaatttctgttctaacttttattattcccttctttatacttgctttgtattaaattgtttctctttttcctgtctcttagcaagaaaaataacgctatttagttgggatctttctcttttttaaatatagaatttacagctatatatttatcttaaagcgctgcttttgctgcatctcatagaatttagtatgttgtgtctttatttgcatttatcttaaactattttctaacttcctatctgtgagcattggttacttagaagtattcattattacttttaaatattcctgcatattcttaaatgtccaaaatttccttcttattgatttccaatttagttttattatggctggaaaacatgtatgatctcaattttataagaattttttcaggcttgttttatgacagcacatatgttctattctgcagaatgttccatgtgcacttgagaggaaagtgcattttgctttaatggcttcggtgttcagtacgtatctgctatgtctagttggcttatagtgttgttcaaacatgtattttcaaattcttatatttccttgctgatcttctgtctagttgttctacttattattggaaattgagtattaaagtttccaactactattgttgaagtgtctctctcttttattttgtcagtttttttaaatataattttggcttctgatattagtgcatatatgtttgtaattgttacaccttcctgatgtattgagtcttttatcactataaactattgctttgtatctctggtaatatttattttttgttttaaagatgatttcatctgaagttaatgtaggcactctagctctctcagggttgctatttgtattgtatgacttttgaaatatttgtactcaagctagttgtatctttgaatctaaagcatatctcccttccaaagtgtataattgttttgatggttcttatctagtctaatgatctttcactcttgattggattattcaatccattcacatttaatgttattattgatactgttggatttgcatctgctagttttcttttggtattgtatgtctcacgtctctttttgtttctctgttcccccatactattttttcatttaataaacatttcctggtattaattttaactatatcttttagttacttgcttagtggatgcactagggtttataatatataccttaccttatgagaattagcatcagacttatactatcttaattccagtgagctggatgagttttaatcttataaagctctattccttctttcttctttttgtgctactattgaatattttatcatcaattatgatgttttctcttaagcttttttaggaggcaagatggacaaacatttcaataaatcactatttcttaaaaatctggaatgaatattaaattttaccagatgctttttctacatttattgaaataattatataatttattctttattcagttaatgtgatgaattatcttgcttgattattttttctgtatcaactttgcatttctggaataagtacatattgatcctgataatattattattttaaaatattgttggcattagtcaattaatattttactgagaaatttttatctatatttgtgagtttggctagatgattcttgtcatattttagtactgagtttactacattgtcaagttgaagttaattaattttttataatttcttaaagttttttttcttaagtttgaaagaaatcactactaggaatatatttattccatctaagttttcaaatatgaatttcaaaattttggaatttgaaatttcttctcaataaactatattatcgttaggcagacatgagtatgaatctggtttcacccacctatcagctatgagaacttagaaaattcagttgatttctctgatcttcagttttctaatgattaacacatggataattaatagtacctattgcatttctgatagcaaattttctatatggactactcctgatggtacaaattatttaaaattcaagataaaatgtataaataattctttagctggaagagaaagcagaaaaatcctcaaacagtataaaacatcagtacagagctaactttggccttgaggcatctgtgaatctccagtagcttacaaattaggcttacaaaacctaaagccaagtaggataagactccacaaaaatccagattccctaaaatgcattactcttgatagaatcttgggaaaaatcttgccattcagtaggaatgtgtggagatgtatagcgttcttagtctagatcctgagtaaagtagaaaaaaactagtgctctccaagaagtcttagctacaagtcagaagtcaatgagttgggactagaattcacaagatttttgtgccttagaaaaaagaaaacaactgaagtcaatttctgtttaaagttgttctgagttggcagtgtacccaggtatctggaaagaacaaacacaaatcttctttataggaagcactttcagtctgacctgaatgtgtttacagagaaagtttaaaaggatataaatatatgcacacagcaggaaacatctaaaaaaataagccgctataagcaaaagtcagcagacgtaatgaactacagactcagtctgtaggttctgcatatactaggtcctagaatcatccaatactgaattacatatctatgtatctatatctatatataaacatgtgtgtgtatatatatatatttatatatagctgtagatagaattaagactttatgaagaatagagaactactgtagtataattttggtaggctttaggcacttaggccttcctgcataaataaataaataagataaataaatgtatacacacacatataatttatattttatgactgtgctggtataagcacaaatatattaatattacatatcaaaacattttcttcaatccaaaggttattttatttcttctagttttataataattaaaacattttaaggaaatgtgccaggagccctaggcattgtacctaatggataatttggcccttggaggaagcaataagatggtattgacagccagatttagaaagtaaccaaatagaatttttagactttaaaagatttaattataaaaattataattttaatagtggcctaataacaaattcgacacagctgaagaatgaattgttataataaactgagagattttaaaacacgttttctcatttctaatctaataatatttttactacattctgatttctatttactaagcagtttgtggtcattggccttattttgtgcctagaactgtgttatgtgggattagggtataaaacagaaaagctattcacatatgtaattcctgtgatttgaaaattcccaaaagttttgtgcataagaaatctggagcaacgatctttaaaatagactccacatatctatcctttaaaataaaatagttcatgctcaaaaaaatccagcactatttggaatatagggtttaaattttgatacatttttttcaattttgttttgagctttattttctaaaatgatctaaagaatcatttcctttgacttcttcccactatgcagggaagtaagactttgaagaagtatatggcttattcttgttctttaacattcaaatgtggctcttatccccactatatctaaacactttttatttttatatgtacacctcattaagtagatagtaagtactcttaaatgaagcaagacaccagtgcagtctctttattccttcacgtgactaatatggtcttgccacatggtatatgtgaaatcaatacacttctcaatgcttcttgtttatagaaaatcctcactttgattttattgtttgattcttttatgttctcttattttttttcacttcaatttgtcttttataagtgtcttgagtattcttacggtatcaagttgacaagtactagcattcaagaaattatgcaatctgcttttgtatgactttgtttgtagagccctaatgaatccatttactcatctattctattcttccatagaaatttattaaggatccactctttgtcagtcatggtgcttaacactaagcataaaaaattttaaaagacagaagttctctgtcctcccagatcatagatgaacaataaacaggtaacaaatggaaggattgattcatcattgcaaggttcataagctgggtatcatcatggagaatagaaaaatacaggtatctactttggatacagttttcagaagggggctctctggagcagtgacattaatttggggcaaaggatgagaagaaaccagccaagacaaagcttggcagaaagcaatcccggcagagggaacaattatgccaaaagcactatgtgggaagtaagtttagtggccaaggaactgagagaaagataaatcatactgagctttggggccataggaggtagactattacagtgagaagactctgaggttttgttaagcagatgagtgagtgagattaatgtttacatcagttacacttgctgctctgtagagaatgaataggagaggcagagagggagagaacttaggaggctgagagagcagcctcagttagaggttgtgaaggctttgacgaggctccaggggaaatatttttatgtttctgcacattcagggctttttgagtaaattttactggaacttgagacatggccttaaagagtaagatttggaagttaaattgcaattgattgaataatgatatgccgttcagagagatagtcctccactgcacaattattttatcctcatcttagatacatacatttgcactcacacacacacacacacatgcatatacatttacatttcaaagagtaagaaccaaggagacttcaaaagttgaatttgtttatttaaggagtaaacattttctctccatttctcaggggaggagtgaggacaactttccctctactatataaccactgtgattcatattttcatgattccacatctactatacagatcctgccttgtacgatgacatctagctctccaagaatcagagcaaagaatattcagtgaagtttgctatgaataataactaacctgtatgtgcctcaggaaacatcatgtttacattcataataatattactaaatatagatgttaaaaacttagcactgtgagaagggaggcaagatggcaaattaggcatagccaagaagagcttctcccaccaagagaaacaagaccatcaagtagactagcatattcccaacagatctttgaaaagaaggcattgagagtggatagaaagaggatacagacctggggctgaagcaggaggaagctgaaaaccctgcaaggggttgctgagcaccaggactcattttggccccaagcagctcccagggaaaaggtgagtttgaataggcatagagtggccccctctcatcacagacctccagaatcttagctgcagcagactacatgattctcatggatatttgagctggcagggaactgcccagagagttgatggagacagaattgtagcctgtgtagagcccaaagagtttgacatgggaacggctgcagtggatcataaccttaggatcccatcctccaaggcttgccatgctcctctaggtggctttagcctgtgttggctgctaaacttggacagaacagtgctatcttgtccatgggatgtggccaatatgatatgagtacccctctgtcttcagatctattatggggtccctggctgggtgtatctgcttgcagcgcagcctcagctgccaagccaagatgcttaccggcagccatcaccatagctcttttcatggcagacctctcctaacagttggatagcttctgtaagtgggcatccaccagctagtacccatgcacagccttcccccatcggcgtgcactcgcctgcagcctcctcctgctgcttttcaaatggatacatgcacatgggtcctgccatcacctaccacccccgcactgaagcacttttgccagcatcccccatcggagtgttgttgcaagtggactgggaacaccttgggtcctccagtgcaggaagtgcataacctcgaggggccagagaaaaaagccgtaagactggtcccagtccttcagggttagagcacaaatcctaggattgctgagctgagccttgactccgtgaaatcatccagaaataaagccgatcatctaaattcgacttataccacagccaaaagcaaaaagccccatccaaagtggcaattttaaagattaaggacacttcagcccaaatagatgaggaagaaccaacataagaattctggaaagtctaaaatccagagaacctccaaacaactatagtagctcccagcaatggttcttccatagactaaaatggctgaaattacagacataggattcagaatctggatgacaatgtagattaatgagattcaggagagaaatgaaacccaatccaaggaatctagggaatccagtgaaatgacacaagcaacacaagagctgaacgatgaaatagccattttaagaaagaactgaattgatcttctagagctgaaaaactcactacagtaattgtacaatgcaattggaagtattaacagaatagaccaagctgaggaaagcttctcagagctcaaagaccacttcttcaaatcaactcaaacacaaacaaattaaaaaaataattttaaaaaatgaacaaaacctctgggaaatatgggattatgtaaagagaccaaatctatgattcattggcatcctagaaagagaaggagaggcaagcaacttgtaaaacatatctgaggatattgtccacaaaaattttcccaacctcacgtgcaaatctagaaaattcagctaaattaaatgagatgctatacaatatgaccatccacaagacacgtagtcatcgtattctccaaggtcaatgcaaaataaaagatattaaaggcagctagagagaaggggcagatcacgtacaaagggaaccctatcaagctaacagcagatattttagcagaaactttagaaactagaagagtaatgcctatattcagcatccttaaagataagaaatcccaaacaagaatttttttattcagccaaactaagcttcataagcaaaggagaaataaaattctttttgaataagcacatgcttacggaatttattaccaccacctgcccttacaagaagcccttaagggagtgctatacatggaaatgaaagaccattacttgtcaccacaaaaagaagtatacagcccactagactataaagctactgtacaataaagtctacacaacaaccagctagcaacagaaagacaggatcaaatcctcacatatcaacattaaccttaaacccaaatgggctaactgctccacttaaagggcaaagagtggcaaacaggataataaaacaagacccaactgtatgctatcttcaagagacccatctcccatgcaatgacacccataggctccaaataaagaaatggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggtgggcgcctgtagtcccagctgcacgggaggctgaggcaggagaatggcgtgaacccgggaggcggagcttgcagtgagccgagatcccgccactgcaccccagcctgggcgacagaacgagactccgtctcaaaaaaaaaaataaaaaataaaaagaaatggagaaatatctatcaagaaaatggaaaacaaaaagagcagaggttgctattcttatttcagacaaaacagactttaagccaaaaatgatcaaaaaagacaaagaagagcattacataatgataaagggtttaatttgacaagaagttttaactattctaaatatttgggtacccagctctggagtactcagatttataaaacaagttcttgaagacttagttaactacactgtaacagtaggagacttcaacactccactgacagtgttagatatcatcaggcataaaatgaataaagacatttaagacctcaatgcaacacttcacaacatggaactaacagacatctacagaacaatccatccaacagtaacataatatacattctcatctgcatatggcacataatctaaaatcaatcatatgcttggctataaaggaattatctaaaaattcaaaaaatggaaatcatacaaagacactattggatcagagtgcaataaaaatagaaatcaataccaagaagatctctcaaaaccatataattacatggaaattaaacagcctgctcctgaatgactttggggaaagaatgaaaataaagcaggaattaagaaattatttgaaactaatgaaaacaaagatatagcataccagaatttctgggacacagttaaagcagtgttaagaagaaagtttatagcattaaatgcctacatcaaaatgtcagaaatatctcaaattaacagttctaacatcatatgtagaggaactagaaaaacaagagcaaaccaaccccaagcctagcagaagaaataaccaaaatcagagctgaattgaatgaaacttacacatgaatccataaaaaagataaaaaaaaagttgatgttgtgaaagcataaataagaaagacaattagctagactaataaagaaaaaagagagaaaattcaaataaatgcaatcagacatgacaaaggtgacattaccactaaccccacagaaatacagaaaatcctcagaggtttttatgaacaccgctattcacataaactacaaaacctagaagaaatggataaattcctggaaacatataacatgctaagattgaaccaagaagaaacagaatacctgaacagaccaagaatgagctccaaaatggaatcactaataaaaaatctaaccagaaaaagccctggatcagatggattcacagtcaaattcttccagatgtatacagaagatctcataccaaatctatggaaactattcaaaaaatcaaagaggaggtattactctgtaactcattctatgaggccagcattgttttggtaccaaaacctgacacagacacaagaacaacagcaaaagcttcaggccaatattcctaatgcatatagaagcaaaaatcctcaacaaaatacaagaaaatcaactggagcagcacatcaaaaagctagtccaccacggtcaagtaggctttattcctaggatacaggattggttcaacatatgcaaataaataaacgtgattcatcacataaagagaacttaaaaaccacatgattatctcaataaatgctgaaaaggcttttgattaacattccacatcccttcatgataaaaaccttcaacaaactgggccttgaaggaatacacctcaaaataataaaagtcatctatgacacccacagctaaaaccatactgagtgggcaaaagttggaagcattcccctggagaaccagagcaagacaagaatgcccacgctgaccatttctattaaacatagtactggaagtcccagccagaataatcaggcaagagaaagaagtaaaagtcatccgaataggaagagacgaagtcaaaccacctgtctttgcagacaatatgattctatacttactaatttccatagtctctgcccaaatgttcctagaactgataaacaacttcagcaaagtttcacaatacaaaatcaatacatgcaaatcaggagcatttctatacaccaataatgtccaagctgacagccaaattaagaacccaatcccgttcacagtcctcaccaaaagaataaaatatgtaggaacacagctaaccaaggaagggaaaaatctctacaagaagagttacaaaacagtcctgaaagaattcagagacgacataaacaaatggaaaaacattccatgctcatggataggagtcaatatagttaaaattgtcatacttccaacagcaatttacagattcaatgctattcctatcaaactaccaatgtcatttttgacaaaattagaaaaaagctattctaaaactgaaaccaaaaaaggagcctgaatagccaaagcaatcctcagcacaaaaaaaaagctggaggcatcacctgacttcaaactatactacaaggctacagtaagcaaaacagcatggtatttgtgtaaaaacagacacatagaccaatagaacaggtcagagaaccctaaataaatctacacacctgcaaccatcagatctttcacaaagctgacaaaaacaagcaatggggaaaggactccctattaaataaacggtgctggtataactggctagccacatgcagaagactgaaactgggcctcttcctttccccacatacaaaaatcaactcaagatggattaaagacttaaacataaaacctaaaagtataaaaattcctaggagaaaacctaggaaatactattccagacataggccttggtaaagatttcatgacaaagaccccaaagcaatggcaacaaaaacaaaaattgacaaatggaatctaattaaactaaagagcttctgcacagcaaaagaaactatcaacagcataaacaatctacagaatgggagaaaatattctcaaactatgcatccaaaaaggtctaatatcaagtctatagagaacttaaacaaatcaacaagcaaaaaccaaacaatctcattaaagaagggcaaaggacatgaatagacacttcccaaaagacgacatgcatgtggccaacaagcataggaaaaaatgttcaatatcactcattagagaaatgcaaatcaaaacagcacaatgaaataccatcacacaccagtcagattggttattattgaaaagtcaaaaaataacatgtttgtgagggtgcagagaaaaggaaattgttatacattgctggtggggatataagttagtttaaccaccatggaaagcagtttggatattctcatagaaatgaaaacaatctaccatttgacccagcaatctcattactgggtacttacccaaaggaatgtacatggttctgcattaaagacatttgcatgcatatatccattgcagcacctttcacagtagcagggacatggaatcaaccttgatgcccaccactgttaaacagcataaagaaaatgcagcatacatacaccatggaatactacagagccatcgaatgaatgaagtcatgtcctctgcagcaatgtggatgtccctggaggtcattatcttaagcaaattaatgcaggaatagaaaaccaaatactgcatgttctcacttatatgtggatgctaaacactgagtacacatgtacacaaagaggggatcaatagtcactgggaattacttaagggtgcagggtgggaggagggtgaggaccgtaaaactacctatcaagtagtatggtcactacctgggtgatgaaatcatttgtacaccaaaccttactgacacacaacttacctatgtagcaaacgtgcacacgtacccccgaacctaaaaaaaagaaagagttggaagaaagaaaaaaaacactgtcattggagatgacaaaaagttgaaaaaattaaaatatatttgtaaagagattccaaaaaaaaaaaaaaaaaagacctttctgatggattaaatgagggttgggggacaaaagaaaggagtcaatgatcactccaagttttattgagatgaggaaagactgagggaggaggaggttgtggataaaacaataaaattctgttttggtcaacttaagtgtaaaatatatatgaggcataacatcaagtttttaattatgcaattggatgtgcatatctctggctagaaaaaaaatcaacttgaagtcacactttcactcttttgtctcactgaaggctataattcacaagcatgttatgcttcctaaacgacagagctcagtgactactccactagtttaattgactgaagaggactgaaagaagataagaattccagaactagctcacaaactagtcttttgacattgaaggtgttagactggaaaacagtgaatatcttaatcaactctgtaattctgtgattctaattattttttaaatttttttcattaatgaatccatgttggttatataacgcaagttgcaactgtatccaaattgttcctgtaaagttaaactcaatctagtagactttctttctaagaagaaataatcagccaaagtttgcagacatcaacagttctggttaaaaaattgcttctaagaaaacacctcaatatttcactggtcttcaataactattacaatcaactattattctgatagttgactggcataactgagtagttctcatttgatttattgtgtagttgcattctgatgatgttttgagctgaaggcatctgaagatatccccagtcacattttcagtgcctgggatagaatgattagaagagacaggtgccagttggtcacctctccctccacctggccttttcatatagctagcatggatttgctaacagcctggggatctccagacagaggcttctttcatagaagggagaagctgcagtgactcctcttatttagtcacataagtcacacagcattaattttataatattttactgatcttaacagtctttggcccctccacattcagggagttttgagaaataaactccatctctgagtggcagaatggctagcttcgggaggggtggagaggattgacagtggttatcttggaaacaatctagcacatccctctgatcatcatctggtttgaatgaaaaacaatagttttttcatatctcagcctccagtcaggggtgctgaccagatggaataattagtgggctgctaaccagaacacatgttctaaggaagaatgtataaggctgattctctcatccagctgtgactcatacctctaaaaagcactccgaggctggcatacctgacagcaccctactttggtcatgtcctctcccatctccatacgtgctagcaccttcaatgtcaaaagactgattagtgaggcagttctggaattctaatctttcagacctcttcagtttaattaactagtggaggagtcactgaacaagtaggaagcatactatcttgtgaataactatagcctgtggtgagataaaagagtgaaagtgtggtttcaaattcccttaagactataacacattgtaatttttttttctagccagagatgtgcacatccaattgcataaatgaaaacttactgttatgcctcataaacattttacaagaaatggaaaccctaccatatttgcaatctgacctcccttgtggctaatcatggtttttccacttttatatttttgagaattctagagcacagaatctccccagtctactcaagaacagtagtccttaaactgtggtttgggtacacatggcaatacaggaaccgatggtgatacaggtaaccatggtgacacagaaaatcttctcatcagggtaattgcaggaagagttttaaaggaatccatttccagatccttaacatccatatgtgctctttgtcaaatttatctgcttgagaatgaaccagcattaatgaattctttcttttaatttaccaaaaataaataaatgataaactaacaaataaataaagttcttcacccacgctaaatcttacagtgatgttgtaaaatccaccagggcttcgaacaaagaagaaatggaaatgttggcttaaggaacattttagtatttaatttcagaaacataaatatgcaggatttcctgacttgatatgtattttggtgggggacaaagcttgctgtaaggtattttggcctatttgtcggtgctgtaaactcacatagcttaagcagcataagttagtgattctttgaaatgtagttggaatgctttaaagaaccatcatacatttcaaagtacattgtataaaacacatgggtaaaattttacataatgcatttcaaatattgtgtgtttaactcaatacacaggtgaaatcgtttttcaaattacattataaaatgttcatcccagttatatacattcatattatttcatcttgtaatagtttctgggtatcataaataagttatattaatttagactcataatgaaaatatttagatgtcaaattaaaatgtgtagagaatatgtagttttatcaaaattctcttaagggttgtataaactaaatgaaatgctacttatgctctatttcttatcactgtattcatctggctttattgaattacttgttattagtttgacttcacctttggaccgtaggtcacattactgcaaagataatatctgtctattatggctgtatccaagatacctaccacaaagcctcacattactagacattcaatgagtgaattgaatataagcatgaatgaatgagtgagtgcatgagcaaagcagcaggtatataaaacacagcagccttttcccttgtttaaacttttattgattattttctgagccacctactctactactttttgaggtttaatgcctttatcataatattatgtcatctattttgcaaagtgctataatcatattagctgaagagtgtatatgttaaatgctatttgactatttgactttttaaagagcagttatattgagatataatttacataccataaagttagcccttttaattttcagtgtaaaatttaatgtaaaattcagtggtttatagaatactctcagaattgttcagtgatcattactatctaattttagaacactttcattacctgaaaaagaaaccttatagcagcagtcacctccctctcagtttatgcaaccactaatctctgtttcatagctttgcctattctagacatcttattttatttacttatttttgagacagtttcactctgtcactcaggctggagtccaatggcatgaactcagctcactgcaacctccgctttctgggttcaaacgattctcctgcctcagcctcctgagtagctgggattacaggcatgcgtagccatgcttgttaatttttccatttttagtagagatggggtttcaccatgttggccagactgacctagaactcttgacctcaagtgatccacccgcctcggtctcccaaagtgttgggattacaggtgtgagctacagtgcccagcctagacattttatataagtggtactacacagtatctgatcttttgtgactggctctttcacttagaataatactttcaatattttttttcatgttgtaccgtgaatcaacaatttgttttttaaaactgatgaacaatattatattttatggatttatcacgttttgttgatccattaatcagttgatggacatttgggttgcttctacgttttggctactatggctaatgttgctctgagcatttatgtacaagttttagagggacatatgtttctatttttcttaggtgtatacctaggagcagaattattggtttacatggtaactctgtttaacaatatgaggaaccaccaactctattccaaattggcatcattcatgagtatatttttatggacttaatgaccatttataacacctttttgggggaattgttaattcaaatcctttgctcccaaaattggactgtctttttattgttaaattataagagttctttgtacattttggatacaagtctgtcatcagatatatgatttataattttttttcccattctgtattttttttcttttttcttttttttttttagacagagtgtcactctgtcacccaggctggagtgcagtggcgcaatctgagctcactgcaaactccacctcccaggttcaagcgattctcatgcctcagcctccccagtagctgggattacacgtgtgcgccatcacgaccagctcatttttgtatttttagtagaggtagggtttcaccatgttggccaggctggtctctatctcctgcctcaacctcccaaagtgctgggattacaggcgtgagccaccacgcttggccttttttccttttttttttttttttttttttttttgacagagtctcactctgtcgcccaggctagagtgcaatggcgtgatctcagctcaatgcaagctctgccacctgggttcacgccattctcctgcctcagcctcctgagtagctaggactacaggcgcccgccaccacgcctggctaattttttgtatttttagtagagatggggtttcactgtggtctcgatctcctgacctcatgatccgcccgccttggcctcccaaagtgctgggattacaggcgtgagccaccgcacctggcctttttcactttcttgatggtgtactcaatagcaaaattttagacaatttggatgcaatacagtttacctatgttttcaattatccctcatgtttttggtgtcatatctaagaatattatttaatttgttttttatttttatagagacagggtcttgttatatcgccctggttggtcttgaactccttgactcaagcagtcctcctcccttaggctctcaaaatgctggggttacaggtgtgagccactgggcccagcttgattcttaataattattgttgaaaataaatataagcattgccatgctgattaacttgctttctgtggctgccctcacttacaatgcaaattttacagactcctctagacatttagctggaactgccatgtgttttccctaaaaccagctcataatagagctgggctcaccataaatccatttcctactattcggttgagatctgcaggcacttttactttgtaaaatggtcttgctcacgcctgtaatcctagcactttgggaggccaaaggcaggtggattgcctgagctgaggagtttgagaccaggctgggcaacatggcgaaaccccatctctctgaaaaacacaaaaattagtcaggcatggtggtgtgtgccgttaatcccagctactctggaagctgaggcatgagaatcgcttgaacctgggaggcagagtttgcagtgagctgagattgcacactgcactccagcctgggcaacagagtgagaatctgtctcaaaaaaaaaaaagaaagaggaaaaagaaggaaaaaaaagcccttaggggaacataagtactgagagtcttagcaagcaaagaatacatgttttgagatgaaattgagggaaaatagagagtatagtgtatttcggaaaaggaaataagactggtttgttggaggacacaccagcatgatctctttcttattatccttgggatagatttcccaaatgatattctagcccctcagggcaacaacacaaaacacagcaaaaaaaagacaaaaaaacaaaaaacaaaaacaaaaacaaaaaaactcacagcatttacaggagtaaaactaattgtaatcatatgattcaaaagagcagtgcttttatactttcatatgtatacagattacctgttaaaaacataggttggctgggcacggtggctcacgccagtaatcccagcactttgggaggccgaggggggctaatcacgaggtcaggagtttgagaccagcctggctaacacggtgaaaccccgtctctactaaaaatacaaaaaattatctgggcatagtggcgggtgcctgtagtgccagctactcggcaggctgaggcagaagaatcacttcaacctaggaggcagaggctgcagtgagccgagatcatgccactgcactccagcctgggcaacagagcaagactctgtctcaaaaaaaaaaaaaaaaaaaaaatcagtcaggtagtgattaagcaggtatggaatggggtcttcaaaagcctacatttttaacaagctgcaggtaatgatgatgctgttggtcaggaaccaaactttaaactttaaataccaaagttgtggaaggcagaagggagcaaagagttcattccctccttcagaaggggagaaacattcactttgcaatcaggctgtgtttatcgagatgactgacattttttgcatgtgttcagacttaaaggtcagatctgtttccttctcagcagctgcgtgggaattgcttatctcgcactttctgtatggggtttgattacctaagtgaaccaagaagtttcacaatattttggagaaaaacacttctagtagcatccaacatgcaacattttaaaccagctatgaaatggcaggcttacaaagtcaacttggaatcacatctctggtccaggcaaagggaatgaaaacccagagactatctccccgagagccctgtagctgtgtgtgaatgtgtacgtgcagggatatggactgtagaccctgttacaaatactaaatatctgtttggaagaaggctgtcctcacatgtgccgctaaaatcatccacaggctagtcttaggccaaacggtaaaaggaaagaagcctatccttggcaattattcaagcagacagtctgacaagctttcctgagtgtctagtacatactaagcacggtattcatgtcccaggtacagagattaacaagtctctgatccccaatgcacatggcttgatgggaagtctggcattgaaatagacaattgcaacattgtaacgtgtgtggtataatagagatatacacagactggagagaggtccaattcagcctctggaggcagaaagctcaggaataacttctcagatgtgatgcttgaatttgttgcccattttttttatttttcctcccaagtgcctttataccatttaagggactcttctgcaaagaagacggaatttaaggtaacttcttcacttggtgttattgatggtggcatatgatacttggtccagataacgggcctgaatttccaaaggtattcaccactgcgagctattcttaaaatctaagaatgaattgacaataatagagtttcacctactaggaagacagatcatttgggggctagagtgcttatgttccagtccttaaaagtcacatcgctggaatgactcctgatgtttgtcagaagctggatcagatcacaaaagcccttccttggagcaagaggcctccgccaggactgagctcatttacttgacctgaccctgaatttccgtagtggagacaagcctcaggaaaatactaactgcctgctgtgttcccatactacaaaagagtgatctgtagaagtgacaggtactttccccctctgggagagaagggtccatgtgttctcctgcctggaccctctagcaagctacttaatatggaatcacacccctggaggagataggcaaacccttgaacagccaggtcaaatctaaaaggcaactgcctctagctgcagaggcaggtggcagcttaaagtggcaccaagtcataaaatgatttcccttttgagcttgggggaagatacaattttttttttttttttttgagacagagtctcgctatgtcccccaggctggagagcagtggtgcgatctcggctctctgcaagctctgcctcccaggttcacgccattcttctgcctcagcctcccgagtagctgggactactcgggcccccaccacgcccagctaattttttgtatttttagtagagatggggtttcactgtgttagccagaatggtctcgagctcctgacctcatgatccacccacctcagcctccaaaagtgctgggattacaggcgtgagccaccgcacctggccaggggaagatacatttttaagcagcattccaggctaatatgggagtacatggatgcaacactgtatctcatgctggattagcagccctggaaaccagagctgtctcttaatcaagactaggtattgtgaacccaggtaatctgaggcaggtctcagttaatttagaaaggtttttttttttgccaaggttgaggacatgtccatgacatctgcccaaggttgtcagggcatagcttggtcttacacattttagagagacatgagacatcaatcaatatatgtaagaagtacattaattcatccagaaaggcagagacaactcaaagcaagcctccctccccaccctgagggacttctatgtcacaggtggatgagacacaaatggttgcattcctttgtgtttctcataagtctttccaaagagggcaatcggaatatgcatccatctctgtgagcagcaggatgactttgaatagaatgggaggcagatttgccctgagaagttcccagcttgaaagggcccaagacattttcctttcacagtatcttagtccattttgtgttgcaataaaggagtatctgaagttgggtaatttataaagaaaagaggtttatttggctaatggttctgcaggctgtacaagacgcatgacactggcatccatatgctcagctgctggtgagggcttcaggctgcttcaacttgtggcagaaggcaaaggggagccagtatgtgcagagatcacaaggcaagtagggggagtagggggaggttctaggctctttttatcaaccaactcttgtgggaactaataagagtgagatttcaccaaccctccccaccagggaaggcattaaggtattcacataggatccacctccatgacccaaacacctcccatgaggccccacctccaatctccaacttatgaggtttggggagacaaacatccaaactacagcattttgcccctggccttccaaatgtccttctcactttgcaagataaaatcatccctctccaataggcctccaaagtcttaacttgttccagcatcaactcaaaagctcacgttccaaagtctcacctgagactcaagacaagttccttagagctgtgagctgtaaaatcaaaaataagttatttgctttcaaaatacaattattgtacaggcattaggtaaagattctcattccaagagggagagatgagccaaaagaaagggataacaggccccacacaagtctgaaaatcagtagggctgacattaaatcttgaatctccagaataatctacattgactacatgtcccacatcctgacacactggaagaagaggtgggctcccaaggcttagggcagccctgaccccatggctttgctgggtgcaatccccctggctggctgctgtcatgggttggagtagaatgcctgtggcttttccagcctgagggtacacggtgccagtagctctactattctggggtctggaaggtgatggttctcttcctgcagctatactagatgtggtcctagtacaggctctcagtggtggctatgcttctgcagcaggcttttgcctgggcaccacacattcccatacatcttctgaaatctatgtggaagcctccaagctttcaccactcttgcattctggacatctacagacatagcacgaggtgtatgcttccaaggcttcctgcttacacaccccagagtggcagcctaagccatgcctggggctctttgagctacatctggagctggaacaacaggagctatcgggggaaccagcccccaatatttcaacgtaggttcttttctattttccctaagtgtcagctggtctgagaaataaagagaaagagtacaaaagagagaaattttacagctgggcctccaggggtaacatcacctattggtaggttctgtgatgccccctgagccacaaaaccagcaagtttttattagggatttcaaaaggggaggtaggtacaaacagggagtaagtcacaaagatcccatgcttgaacggacaatacaagatcacaagggcagagaggcagagcaagatcacaaggccagggcgaaattagaattactgatgaggttccacgtcctgctgcgcacgcattatcattgataaacatcttaacaggaaacggggttcaagagcagatgaccagcctgactagaattcgccaggctggaatttcctaatcctagcaagcctgagggcattgcagcagaccagggcttatttcatcccttgtcttcaaccgcataagacagacactcccagagtgtccatttagaggcctccccctgggaatgcattctttcctagggttattccttactgggaaaagaattcagagatatttctcctatttggtttctgcaagaagagaaatgtgactctgttctgcctggccccataggcagtcagaccttatggttatctcccttgttccctgaaaatcgctgttatcctgttcttttttaggatgcccagatttcatattgttcacacatgttttacaaacaatttgtgcagttaacgcaatcatcacagggtcctgaggcgacatacatcttcagcttacgaagatgatgggattaagagattaaagtaaagacagccataggaaattataagagtattgattgaggaagtgataaatgtccatgaaatcttcacaatttatgttcagagactgcagtaacgacaggcataagaaattataaaaatattaatttggggaactaataaatgtccatgaaatcttcacaatttatgttcttctgccacggcttcagccagtccctccgttcagggtccctgacttcctgcagcagggagcagtatcccagggaggcacaggaaattggaaccccaaacatgtccccagaatctattctgtcctcctaagcctctgggcttgtgatgtgggggcagcctcaaagatttctgaaaagcctttttgacctttttttctattgtttgactattagcacctgactccctttagtcacgttcatctcttagcaagtggttttactgcagtacccttggatttctctccttaaaatattcttctctaccgcatagccaggctgaaaattttctaaatatttactctctgcttcctttttaattataaattccatctttaggtcatttcctcgctaccaaatcaggttgtaagcaattgaaagcagccatgtcacttcttgaaggctttgcaccttagaaatttattctctcagataccttagaacagcattcttaaatttgtcctttcattaatcccaagggcataaatgcaatgcaggaaagttctttgctaaggctaataaggatgacctttgctttactttccagtaagttcctcatttccatctgaggtgccatcagcataacttttactgtctatatttctatcagaattttcatcacaaccattgtcttagttcatttgtgtttctataaaggaatacctgaggctgggtaataaattttttaaagtttatttagcttatagttttgtaggctgtacaagaagcatggcagtggaatctgcttctgacgagggcctcaggctgtcttcaatcacagtggaagatgaaatggagctgttgtttgcggagatcacatggtgagagaggaagaataaaagcatggagatgccaggcccttttccacaactggccctcatgggaactaatagagtgagaacttattaactactgcaagaatggcagcaagcagttcataaaggatttacccccatgtctcaaacacttgccaaaatgctccacctccaacaatggggaccaaatgtcaacatgaggtttggagaggtgaaatctccaaactataccaaccacttaatgaatctctaagaagtttccaactttctcttgccttattgtgttttctgagtcctccaaaatcttacagcctctgcccatcaacccgttccaaaaccacttccacatttttaggtatctttatagcaacatctcattccttggtaccaattttctgtctttgcttgtttgtgttgttataaaggaatacctgaagctgggaaatttataaggaaaggggttttgtatggtacattgttccactgattgtgcaagaagcacagcactagcatctgcatctggggagggcctcaggctgcttccactcatggcagaaagtgaagggaagccaacatgggcagagatcacacactgagagagaaagtaagatgcagtgaggccatgccttgctctttctaacaaccagttctcatgggcactaatagagggagaactcattaccatgaggactgcactgagccaggccaagtcattcctggggtgtccgccccaatgactgaaacacctcccatttggccccacctccaacatcaggatcaaatttcaacatgagatttacggagacaaacatccaaactatagcactgggtaactgggtggcaaagagtgtgtatgattggagtagaataatcaggggacttaggagtatagaccaacattagaaatctgctgccatttactaactgcctgtcctttgacagtaagttaaccaagctgcatgtcaggatcttctgtgaaaaaaaggagtaatagctgcatcagttaaggttgcccagtaaaatgttggaggtccagttaaatttaaagttcaaataaagaacaaataactttttcacataagtgtactccaattgttgcatgggacataattatacaaaaatttattcattgcttttgaaatccaaatttaacagggacattgcctttctgttcgctaaatctgacaaccttagagttcatcaggataggctagtttaagccaaagtaatatttagttttagaatcttgctggcaaattctattaaacaatttgttgttcattaagtgtcgtccccagaaaagcagcatctgtgtgtcctagaaacatcggaaatgcaattttagacctactgaattagaaactatggctatagagccaggcaatttgttttatcaagccctccaggtgactctgatagactaaagtttgaaaactactgcacacatttgcagaacatctaaaagctaaacatttttctgtcctgtagcccaacaatttcatgactaagtatataccaagagaaatgagtgcattattcactaaaatatatgaatggagttttcataacagctttatatacatcatggcccatggctgaaataacccaaatatacatcaacaggagaataaataaattgtggtacttagaacatggcacaaccctaaaaagaacaaattttttatatgtgaaacaatctgggtgaaaatttacagacaatattttgagtaaaagaaacacgacacaaaagaatatgtatgttctatgtgattttatttatatacagttcccagatcaggtgaatctaatctattttaatagaaatcagaatagtgtaactggggttgggatgggtggctgtattgactgggaagagaaatgaaatcttccgaggtgctggaaatgttgtacatcttcacctggttatggttatactggtgtatttagatgtatacatttatacatgtgttcatttaagattaatacaccttatatatgttatacctcaaaaagagaaaagaaaaaataactaatgaaacaaatctcagtgcctaaaagaataaaaaagtatgcctcactcctactacttactactttaagcttccatcacctaacccggggcaatcatttgtgtggccttatctatctttaagtgggaaaagcagtacatccttcatagagggagaaagagcagaatagttatgaactatcttactgactccaacacacctacttcttgaagttctatgtaatagacatagtctcatttattcatcctctttttttaaaaaaaacttacactatgaacaaagcactatgttagccatgtgagattcagtgataaaataaaatggtgttgctcttagggagcttatattcaaagaagaaagacattaaaagagattacataaataactagttagaattatgatagatccagtaggattttgaccacttgccttcatcattttcttaaggcattggtgctgcctgggtacctcttttgcaaccaggcaacatcagccaagatatgcatgacacaatctgaaacatcctttctcaccctcttcaacacctcagcagctacatgagccatcaccagttcataaacggggtaaaaagtagaactgtcctagccagtagtttagtggaagacactgagattctaaactgcattagaagctgaatgcaaaattcaaaatatttcagcaggcaaaagaaagtcaaacagggcttaacattcactactggtcctctgaaagcccatgatacaaccaactattgcagttgattgactaaatttgcaagagtagaagaaagagaaatgtgaaggcagaaaagcaacagcaacaataaaaagtatcaaagggtgagagctatatgataaaaataactagaagaatagccaaacatttggaagagaggttctcttacttggtcatccatcagaattgccttggggactgtttacaaaggttgtcgggccctacccacagaatttctgattcagtagatccagagaggggcctaagaattttcaccgcaataattctcaggtcatgctggtgtcgttagtcaccacacattgagacattgctgaacacacactgagaattgctgatctagaggaaggaaggaaatgtaacactgaactgctctcactttccttctattttgaacaagctgctattattctgaaacagaaaacttagacgttctgcctactaatgctattattttttcaagttcaccattaaaatgtagggatgtggtaacagctgtgaaacctcttgcactacactgggtcttccttgagtccactacaaagaaataaatcagtgactcttttcttctttattcttcagttgacccttgaacaaagaaagggttaaggatgtgaagttcaggctcatctctgaggtaaaaatccaagtataacttttgactccccaaaaacttaactactaatagcctcctttgactggaagccttaccaataacataaacagttaattgacacgtgtattgtgggttacacttattgtatactatattcttacaaaaaagtaagctagagagaagagaaaagaaaatattactaagaaaattataagaaagagaaaatattcttactacacattaagtgggagtgaaacatcataaaggtcttcatcctcatcatcttcatgttgagtgggctgagaaggaggagaggaggggttggtcttgctgtctcaaggatggcagaggcagagtaaaatctacaaataagtggacccctgtagttgaaatctgtgtcattcatgggtcaactctgtgtgcgtgtgtgtgtgtgtgtatgtgtgtattaattcggtttagactacaaagggcaacccgctctccaggaaccaagactgatgctggatgatgccatatatacaagatggcatataggaggtgatcatggaggaccttcagtagcagaggctaggaaccacagggttgaggggaggaggtaagtgaaataatggggctaggctagaatagaaagtagtatcatagcgttcatttttatattgcaaatatcttttctctgtgcccttataaaataatatttaaatgtgtttttaatcagtcctaagtaattggcaaattattacatcatcatcataatcatattttctcattcatggaaaagatatttactgagcctttaatgaatgccaatcactgtgcaggttttagagattcactcgtgaatgaggtaaatctactccatgtacttaactgatagagatttaaaactatactcatgtaaccatgtcattcattcccctgtcaggacaaccccgctgcttcccattttcattcctctacatttaattacaacccggtcttctactctaatctctccctgcgatcttgatctatgagatacttgccccttcgtcatcgtttcccttctgttgaaagcaaacctcctctcaatgcctgtaagccccattcaccttatccattctataaggatcatttcagcccttatttttactgaagcctcttacctccactttagtccaaagtcggaactctttctaattttctgtaggacctaatgtgcccattaggcatttaaatgtacacattcagtattgaatttttattgagccatgttatgtgtaagtagtattgtccctttgcaattttcatctatcagaattatggataagatttgctgtcccttcataaaattgtgtttccatggtagtgtcatttaaaggtgaatcattttctcataggaactatgagtgcaatttggtggctgccttttaaaaaataggctaattcagtcattctcaaatgcagtcttgatcagaaatgatcctttcggttatttgctcaagtgtgtgtgtgtgttcaggtcccaacccaagaccaactatctcagaatttccaggtaatctcagaattttgagataacatggcctgaggatctatcttttaaacaagtgcctccagacaatcttacgaagaagcaagtttgggaaccttctggctgcacattaaactaaaaaactgaaggtttttttttttttaaatcagtatcctagaataattaactcaaaatctccaaaggtgaggttttcctggcatattttcttttctatttttacatctttctgtgacatttatttatttatttgttttaatttattttttatttcaataggttttgggggaacaggtagtgtttggttacatgaataagttctttagcggtgatttctgaaattttggtgcacccatcacccaagcagtgtatactgtacccaacatgtagtcttttatccctcacctgcttcccaccctttccccaagtccccgaagtccattgtctcattttatgcctttgcttcctcatagcttagctcgcactttaagagtgagaatgtacaatgtttggttttccattcctgagttgcttcgcttagaataatagtctccaattccatccagttgctgtgaatgccattattttgttcctttttatggctaagtagtgttcgatagtgtatatatatatgtgtgtgtgtatatatatacacatatatacacatatacacatatatacatatatatgtgcgtatatatacacatatatacgcacatatatatacataaacatatatatttttttatccactagttgattgatgggcatttgggctggttccacatttttacaattgcaaattgtgttgctataaacatgcatgtgcaagtatctttttaatataatgacctccttcctctgggtagaaactttgacatgggattgctggatcagacggtggatctacttttgtttctttaaggaatctccacaccttttttcactgtagttgtactattcactatacactattacagtgtagaggtattaactttttactgcatccatgccaacatctattattttttgattttttgattatggccattcttgtaggagtgaggtgttatcacattgtgattttgatttgcattttcctgatcattagtaatactgagcatttttacatatgcttgttgaccatttgtatatcttctttaaagaattgtctattcatgtccttagcccactctttggtgggactgtctggttttcttcttgctgatttgtttgagttctttgtagattctggatattagtcctttgtcggatgtatagattgtgaagatttttttctcactctgtgggttgtctgtgaactctactgattatttcttttgctgtgcagaagctttttagtttaagttccatctatttatctttggttttgttgcattggcttttgggttcctggtcatgaagtctttgcctaagccaatgtctagaagggttttctgaagttatcttctaggatctttatggtttcaggtcttagatttaggtctaatccaacttgagttgatttttgtataaggtgagagatgaggatccagtttcgttctcctacatgtgacttgccaatcatctcagcactatttattgaatatggtgtcctttccacactttgttttgtttgctttgttgaaaaaaaagttgcctgtaagtattcggctttatttctgagttcagaaagtgggggatgtgaaggagcaggaaagatctgcaggactgtcatcagggccagactcgctgcccagttcaatcctctggaaggctgcacagatcccacctgtttacccttaaggtttcacgccctcttgaactctctcttcaaagttctttccaactttctcttgtggcactggttgactattggtcttgtgccggtctttagctttaattggagtttaccaccaattaactgcactgggctgcattcccaagcaacctgactccaggaagatctgggctggttcaccttttatggccacactactctgaacgtgcccaatctcttctgatctcggaagctaagcaaggtcgggcctggctagtacttggatgggagacctctgccatattttctaaaagccgtctttgttccgaatgggcaactaagttaagaaccactgcatagtgtaacttatgagcaagattgctgaacagtcagtgaaaacagggagtttagtacaaagtctcttcatgtatatttcctccatagaagatgtgggagaaccttaaattaaaagaatactcaccaactgccaattcatttcttgtaagtaacatatacacatttcagacaaattggaaaactgaaaagtataggaaagtaaataaagtcactcattaagtcagcattccccatgagcactgtaatctatttcatcctaaccattttatccacagactatatacacatctcccaactgtcggtttgtaacaaaattggttttatttttgtgtactattttaacatacctctttctactaatatagaatatgtattttacatgttacttttttctaaaatatgatattaaggaatatccattattaaatgggtataaaaattgtttagctaaaacctatttctgtaggtttttccattataattaatgccaccataaatattggtacatagggttttatatacgccactggtcattttccagcattattgaagaagataaatataataaaacatacaactctttgtcaagtaaccagaagtggattactgagttaatagatgatcaaataatttttattttctcttcagatatatagtagcagcttagcaaaaattcatggagatatctttttccattgctgtaatgaacacaatttattacaaatatattttaattggctaattttccaagtgaaggagttgtacttaatttatttaatttgtatgactaagaagtgacatttttccttaggcatttgtctaattcttccttttgcaaattgcccatttacactttgtcccttttttttttttttttttggtcagaggagactttttgcctcattaatttgtaggaaatccttacttagtaagtaatagtaagcttcttatcccttttttgctctcatcatcatcctcccacttttaaatcttttgttattttttaaactttaatcaaagttattagtccttggggagagatttctagcttttgatattatatttgcttttcttaatccaaattcagatatttattaattcatttactttctaactttcctgtcacttcatatgtatatttcccatacttatgagtgtgtatacagaaatacatatgtgtgtgcttttaattattctagaatgtattgcaatagataaatgtctactgtatactatattcttagaaaaaaagctagagaaaagaaaacattattaagacagttataagaagaagaaaatattcttactagtcattaagtggaagtggaacatcattaagatcttcatcctcatcatcttcatgatgagtgggctgaggaggaggaggaagagcaggtgttgaaaggggggggtggttaggcatcctcttgttcatttttagaaatattcatttccctcagtgctatttacaaaataatttcaactatttcgctaagttgtgtactgcctttattatatactaaattttttaaattcttttttcctccatttactatcttgttttattgacctgtcttatcctgacacctgtttcacattgtttaaattattgtgactaccttaatagatatgactatcgggatgcacaaaacctacctacttttgcttttataataaatttaagcaattttgtgtcaaacttaagatatgacttaaagataatgaaagaaaaacccaagatatagttaaaatctgtcaattttaattgatatcaccaatatttaactgaaattctcctcttaatttttaagaaacttacttcacttttgtccattcatgttgtataaacaccttagaacttgtgttcacatgtctttggataatttctgtgatttcattcatttctcaccctgtctgcttagagggtggctgtggactttacaaaatacttttatttacagctatggctcataccaaatatgttttagtgaaataaatatttgatttcagtttgtatatcttatataaaaatataatccataccaaaattttctagaacacatttattgcacaattgaagcctgttagtctacagtggatcatgaaatacaggcctataataatctaattgctatccatagtaagagactcttctctggtctcttgcagtgtgtgcttatctaccttgtttatgtattctgccaacttctttaagtctgtattttaatccctagcagttgggtaaacattcataacgtgtgtgtaacaattatttctgaactgctctcctttcaaaagcattgataatcgaaggttaatgcacaatcgaattttttccttcctggatcaagcctataactgtaacactgtgaaactctcagaaattgctctattacaccaagaagcttacactgctctttgacacacaacactttggatggtctgactatcttgttatgttccgattgctacagtaatcagttagaggccagacacatgttttattataagagcaaacagagtgtatctgctctagggatcagagagagagaaagataccagatttgacagcagcagacttctaaaaacagactgacctgaaatataaatttctggagctagagtagttagtgttgtgacaatcagtttacatctaaataacagaatctacaccagagaccactcagcaaaaaaaaaaaaaaaatggtgttttaataagattcttgcgggtttgcatttcttcagccaatacacagcatagcaaaccccagatcaagatatgaaactttgtctttaccttgtgttgagagaatatcacttaggtggaaaagaaatgaaaacgtcaggctttgataatatagcattaaatgataaactgtactgccgagaaagcaaagccattatgttaacagaattgtgcattactatgacttgtgtttactcctgtgctgcacacattttatcctgcctgtgaattctactctctggcctcttaaaaagattaaaagctgtaattttttcttgaatatatctcctaagtcactaattacattccctagactcttacatccttattcatgtgaccatttcttgtattttacaatgggactattgtcagcttaacaatctagctgtaatacccagggaaggccacacactctcaatgctaaatcacattaccgaatacttttttcttagaacttgttttatcgaccacttgagaaggtttaattgtaaaagtgctaaatgagaatcgaaagaatttgttcttttttcttaatttgaagttgctttgcttaaacatgtaatgatgcctgtgatatgcatggcatcaaaataatgcatagacactattcaaatctctgagtgacatgtgtcttaggtaccaatcttgttgtcaaatgttcactcccagggtatttgctgaaaggcttggatttcatttagggactcagttcctgttttcttcttctcaattggataccattcagttctaaaatctaaagatcaaacagttacccagaggagcttctccatgaacaatcactctttattccataaatgatccagatgttcccaggaaattagttattccttggatattacaagttaagtgaaagattattttctaggtattacactattggggatacattgctaataagcataataatattatttaaaatatctggaggatttaatgatctccagttcattttaaatttttatatgcaggaataatatagttcagtgatcctgaaagttgccgtattgcaacagatgttaaattgttgagattaattcaatgtcatgaaaatatgctcttagcagaaaacaattagctgccattcacttaccatctataccaggtaatagactcagtgttgacaagcaatcaaaaaggcacattcctagttgctattatgaggcttgtattcattctgtcacacctgtgatgatctctataggggtgctgagaaacatgaggacgtggtaaaatttcagaactatgtattcagaaaggctttgggaaaaacatgaaatcaatatggagactatgataaatgtagctcatatgacctctgttctgaacattttgtcagatcaaaaagtatgatatgttggccgggtgcggtggctcatgcctgtaatcccagcattttgggaggctgaggcggtcagatcatgaggtcaggagatcgagaccatcctgggtaacacggtaaaaccccatctctactaaaaatacaaaaaattagccaggcgcggtggtgggtgcctatagtcccagctactcgggagactaaagcaggagaatggcgtgaacccggcaggtggagctagcagggagccaagatggtgccactgcactccagcctgggtgacagggagagattctgtctcaaaaaaaaaaatgtgtatatatatacatatatatatatatatatatatacacacacatatatatatacgtatatatacatatatatatacatatatatacacacacatatatatatatacacacacacacatatatatatatatatatatgatatcttgatatctgtatcccatcattaaatattttggccaattcaattggttcattccgcatgggaaggatggttgaaagattgtggccaggaagaataagtcaatctgtcttttgattacatagattagccatttttttttcaaaattgttgtttcagtagtcggaatccctggtgcagctactctaagatctgttcctatatgcattattatctgcaaacattcctacattaattgacttgcccctcagtcaacttcaacatccattgctcttattattgccttttactataaatatattagtgaccattataccttgctcagtgtaacagaaattatatatgctaaagaacaaagtttttatgagcaattacttagaaacaccttagtaagtcatgttttctaaaaattaggaagataactgaattagagtgaaataattattgtctttcactctttgtaaaaatgaactgtttttcttttgtttattatgctttaagttctggagtacacctgcggaacatgcaggtttcttacataggtatacgtgtgccatggtggtttgctgcacccatcaacccatcacctacattggatatttctcctaatgctatccctcctctagccctccaccccccagcaggcccaggtgtgtgatgttcccctccctgtgtccatgtgttctcattgttcagctctcacttacaggtgagaacatgcggtgtttggttttctgttcttgtgttagtttgctgagaatgatggtttccagcttcatccatgtccctgcaaaggacacgaactcatccgtttttatgtctgcatggtattccatgtcgtatatgtgccacagtttttttttctttgagacggaatcttgctctgtcacccaggctggagtgcaatggtgctatctctgctcactacaacctctgcctcccaggttcaagtgattctcctgcatcagcctcctgagtagctgggattacaggtgtgtgccaccacgcccagctaatttttatattcttagtagagatagggtttcaccatgttggtcaggctggtcttgaactcctgacctcatgatccacctgcctcggcctcccaaagtgttgggattacaggtgtgagccaccatacccggccatgtgccacattttctttatccagtctatcattgatggtcatttgggttggttccaagtctttgctattgtgaatagtgctgcaataagcatacacctgcacgtgtctttatagtaaaatgatttataatcctttgggtatactgtttttctgattataatttaagtcacaaatattatagaaaatacagaagttataaaagtattttaaaaatcagccatcactctaaagaaaaccatcattaagatgttaacatatttcttttcattgtttttaaaaattgttgagactataatatatgaacaactgcctcactgcagttacataaaactttatagcaccgtgttttcttaggttgttattatccgactttcaacataagatgttatggctgcacagtgtcccattgtgttagtatgtggtaatttagttagcttggttttttatcttttttgctatcataatataattctatgttaaatatcttagggtaattttttaaaagttcaatttctttatgtgtaatagtttttcaggagtaggatactttgaatttgtgcattaaacatattcttgaaccaagactgaaaatgttctttccctgggtatgcacatttaaagtagatatttccttgatgttgcaaataatgtaatttatagacatatttcacatttatagaccctacactattaataatatgattcattattacaacagtagtgtatatagattccaaatccatttcaacctttaccagctttggataactggtctaattttacaggagaaaaatggtgcatttcataagcatttcttttctctgatactagtgaatttgattcatgcagttgtttgttaaacatccacctttcatatctttaaatcagttatttgttttccatcctctacattttgggcattccttcccttaataagttttgtgaattatattttttcttatccaaacattgaaaatatatggtcatcatacttttaatcaggcatcatttgttttactaaaggaaactttcttgagccttaggacagtgttaaagacttttctgtttctataggaaccatataacgtaacaatgactatcactgaatgagcgctaaggtttttacattaggcattttacatacactatctttttaagtcctcaaaacagcactacaaaataaatattgaggttgaaggacgtttaatagctacaggattttttttgttagacttgattttttaaatattcttatccagtttcataatcaggagtttttgcaatgacttaggtgaatttaaaaatgtccccaagaatagacataagttgctagaacaaaacagcttagaaatagatccacacaagtataatcaactgctctttgaaaaaggagcaaagatgttgctgcaatggagaaaaggttagtctcttcaacaaatgatattggagaacttgagtgtccatatgcaaaaaccagaacaaaagcataaaacaaaacacctagacaccaattcaaaataaattgtatacctacaggttacacgtaaaatgcaaaaccaaaaaattcctagaaaagcgtgaagcagaaaatctatgtaaatttgtgtttggtggtgatattttagatacaatactaaaagcataatctgtaacaaattgatacgttgcattttattaaaagtaaaagcttctgctctctggaagataatgttaagagaacgactagacaagctacagactggaagaaaatatttgtaaagtatgtatctgataagggattgtatgcaaaatatacaaagaaatcctacaattcaacaataaggaaacaatcaatttttttaaatgggcaaaagatctgaacagacatctcaccaatgaaagtacacagagggcaggtaagcatatgaagactctcaacatcattttattggaaaattgcaaattaaaacatttgtagcttcggccgggcatggtggctcaatcctgtaatcccagcactttgggaggccgaggcgggtggatcacctgaggtaaggagttagagaccagcctggccaacatggcaaaaccctatctctactaaaaatacaaaaaattagctgggcatggcggcggacacctgtaatcccagctacttgggaggcttaggtgggagaatcgcttgaacccaggaggcagagattacagtgagccgagatcccaccattgcactccagcctgggcaacacgagggaaactctgtctcaaaaagcaaaaacaaaaacaaacaccatttgtagcctcacagtggagaaacctcataaacattaacttagccaggtaaacaagatcataatcaatagtaatgtcatattgataacatgtactctaagccaagtccaaacatgagaaaatatcaggtaaatcccagatgatgacattctacaaaacacctgaccagtaccactcaaaattgtcaaggccatcaaaaacaaggcgtctgaaaaactgtcagccaagaagaacctgaaaagacatgtcaactaaatgtaatgttgaacactgaatggatcttggtacagaagaaagaacttaggtataaaactaagaaaatcagcgtaaagtatggactttgctaaacaatagcctattgatattattaattgtagcaaatgtaccatattaatgttaaatgctaatgataggggaaagtgggtgtggactatatgggaattctatatagtatcttcacaatttttctttaaatttaacactattctttaaaaagtttttttaaaggaggatctaatggatatggagttttagttttgtaagatgaaaagttctagacctgttttacaatgtgaaaatatgtaacactactaatttatacactgaacaaatagttaagatggtaaattttctgttttcttccacaattaaaactaaaaataaaatattttaaaagtctctaaaaaacaagtaaataaaaatatcccctattcatgtaatgtttctcttttatactgttaatgcagtgaattatgttttctgagtttttgtgtaaaaccaatcttgaatcctagcataaatccatgttttattatcctttttatacatcaatagatttttcttgtttatatttcatttaggattttttttgttcctatcttaatgaaacatagggaattttcttcttatttctcggaaggttcttgtcaaaggtttgtatcaggattattctagcctcatagaatgtattgggatgtgttcctttctttcttttttgctgtaagggttatatagaattggcattattcttcctttaaatatttggattatttttccaacgaagacatgagtttgtagttttatttctgggaagaatgttaaatgtacattaaatttcataaacatatctagaaatatttacatgttccatttctccttatgccagtttggttaagtggtactttcaagaaatatgaacatttcatctaaacgttcaaacgtattgcatggtttttatctgtttgtttaaccacttaaacctagagagctgtgtcaaaatattcaagtgaattttttttttagttctgtgtcctttttagttgatcatttgctgcttcatatattttgaggctaatcagcaacctgcgtatctgacctggattggtgattgttgttcctttatgttagctttatttatcaaaatataatgtccactttgataacacaaattttaatttttttttctggtaagcacaataatctaacattattttccatattggcctaatacacaattttttccatcgatgaatctcttggtgttttttttttaattgatcatttataaaattatttgagagtcaatttttttatgtgaatttgagtttcaggtcggtcataattgcatagtcatatttattactactagtttatttccctcaaataaaataagttccgtcatattggtcactacctattctccatcctcattccaaaacaagatttgttgaaaatctcttgtcattgttttggttaacattacaatttcaaaagttaataattttttatattcctcatatttctttgtttttaactgtagtgatttctgataaaaggcctttcaaagagggctttagttagatgacatttctgagtctgagttaactctaaaaacatacttatgtttttaaataattttgatagatacacattttaagttcaaagtgtgctttttttcctggacatgtacttcttgtttgtgactgtgaagctcttttcctcaggaagctttttgaattttcctttggctttttgtgttattgaatgtaatttgatatgttcataagtctcccctccccaccttatctttttgtttctgtatactctgaatcattttaatctaagatcttatagctctctttagttttaaaaaattattggtcattaatccttcaaatattcttctctttatatatttttccctcctggactattattaattcaatactgacatttctatatatatattctctacatctcttaccttatgtttcttctattctttttatttccttatcccttccagttgcattctgggagcgtgctttgacttaattgttcagctcactcgtttgttctttagttgaattcatttgacagttcaatccttcaattagttaattaatttaatttttaatgctttatacccaatgtttctatttgttttttctttagaaattctcatttttacttgacatttccaatattatttcttatctctacaaagataattattattcctctttaaaattttatattttcctgcatcttattttacccttatatagtttgtcttaaaaatcctgctcatcagctgtcttgaattgttgtcctatggttcattgtctctgggaggtcacagtcacttatactcctctcaatctgggaaaatgtgaaaaattcagaccttatttttttccctttttataattttaaataattaaacatttcaaaacaaaaatctaaaatatcaaaatgtagactgaaccacttctgtttgtctgcctcataccactgaccatccttcttcctcagggatcttgcttgttttttgttactatcttgtcaagtaccaccattctttctgaggaaggagagagtatattagtctgttttcacattgctataaagaactacctgagactgggtaatttagaaagaaaagaggtttaactgactgacagttctgtgtggccgaggaggcttcaggaaacttacattcgtggttaaaagcaaaggagaagcaagcacctccttcacaaggcagcagaagagagagaaccaacaaagggggtagtgagacactttgttttttttttttgagagggagtcttgctctgtcgcccaggctggagtacagtggcacaatctcagctcacttcaacctccgcctcccgggttcaagtgattctcctgcctcagcctactgagtagctggaagtacaggtgtgtgccaccacacccggctaatttttgtatttttagtagagacggggtttcaccatgttgcccaggatggtctccatctcctgaccttgtgatgcacccgcctcggcctcccaaaatgctgggattacaggtgtgagccaccgcgcctggcccagtaagacacttttaaaccatcaagtctcctgagaactcattcattattaggagaacagcatgggggaagcacctccataatccagtcacctcccagcaggtccctcccctgacccatggggattacaattcgagatgagatttggatggggacacggagccaaaccatatcagagagtattgctggaagccactagtacctattgttaaccactttctaccccagctattattagctaggctgtaagacttctcaaacttgagtgtttttcagaagtacttggctagcttattaaaacacagattgtttggcttcatcctcagagattttgattcattagggcctgagtggtgggccccaagggtttgcacttgacatggacccagatgttgcaatgctgggtctgagtctggaatcacatagagaatgttcacatttattaccccaaattctctgtcttgggttgggttagccctgctgttgttgcttctgtttggtctctctcagtgctgatgattgaaagaggcatcacttcacccagtacaatggggtctgatggggagggaggaaacaatgtgagaattcttccccagcctcaactcttagctgctagagctctttctgccatgctggcattctataatctttccaagggttttcacagttttaatttagtaactagaacccatcaaattccttgtttctctgtggcatctcctttaagatagaatccagagtagaaagccaccaacctatgttggttcatcatcttttcagaaatttgaagtctaatgtgacttaaaaaaattcttaaaaaaactgttgaataatatgattttcatatagctatatgccaattactttgataacttcttgtgtttaagattatctttcctaactagctataactatagtaatgtaatgcaagcctatcttgtctaaactcagacaatgtatttcagtgatatgttttcctttatcatctttagaagcttttttttgtcattaatgtcaaattgccaagacaactaccctatgtgggtaaaaaataatgagaccacaccttgctttttttttttttttttttttgagagggagtcttgctctgtccccagactggagtgcagtggcgcgatcttggctcactgcaagctccgcctcctgggttcatgccattctcctgcctcagcctcctgagtagctgggactacaggttcccgccaccacgccccggtaatttttttattttttttttgtatttttagtacagatgggttttcacggtgttagcaggatggtctcgatctcctgacctgtgatctgccctccttggtctctcaagattttttttttaatacaacatcttgaataccttttagattctaatagctgtacaacttagaacacctttgggttttctatcttcacagtgtacttataggaccctatcttgttatttaggttttaaagggactgtattaacagaagaaagatatgtgtctccagagcatgaatgattttgtcaaatccagaacagggtttcaaacactgaaaaatgtcagattattttcaaacactagaaaataaatgatatggaaaaacaatatatgacaatgaggcagataagtgttcatttctggtaatgagggcccctggaccacttatttggtaggttggcctaacatttacatttatgtcaattctttggactataaggaaagcatctcttatggggatgacaatagcaagatacagcgctacaatgaaatctaattgttattcactattgcactggaatgtcaatgaggggatgcattgttcaaaagctggcattggtaaagttattaaattgattggttcatgaaggaatatagtacattagtgagctactcatctgtgaccgagagtatgtattagaaagcgtgccttcataagtttccaacatcataaatcaaggcaagatttagtacacaacactggcaggaagcggcaatcatatattttacaaggctcagctcaagaaagctcaaccttcagtcatatttgggtcagtattttatatttataatttgctccatactattgtcatgtttattatatttggttcttgtacaaggaatttataatatgaatatgattagaactgagcgacaaaaagacaatccctgcagatttctattgagtttcctctatgcttggtaaataaagtgtatttttttgacttttaattatatatgtttaaaaagtgattgtaaccaattttgcattcattcccacgttgcttccataagtaattattctaagttattagatataaatctaaatattgtaaaacaccctaaagctagagtgaaaaagaaggttttttaataagaagaacagatatttttaagcagtaaaattagaattttattttcacatttatactattctagcccgaatatctgcttcttttatcaaatcttatctggtctttcttatctgaatgaatatcacttctctggattttattactttgttttaaatgttttagcactcttaactaatttcacctcatattagagttttacacatatccacttcctctacctattctgtctacctattgacaacaaaaagcatatctggttaattaaaatacttccttttctttcccctaatacacttacagtcatttacgagtttaatatatcttgtgaataaattaatatttatctgatgtcaaatataagaattcataaaacatcaaacaaatgttttggcttaacaataattattacataagtactatattttataaatagtaactaatataagtagtttacacatataatttcggtgctagaattcagtatataattttattagttaccaaactaacatattaaaatctcatattaaaatctcagaagatacttttagtgttataaaataatctaagtaattaataaatgtgtattgtgtatgataaagtttccatgcataagtttacaaatacaagtgcttatatataaattatattattaatgatatatatatgcaaataaattctggaaatacatttacataaaatgtatacacacgaaatcaaccttcttatattcaacaatgctttcccatgcaaacaaatgtaaaaacacctgtaaacattcctatattgtttctctgataaaacattaacatgttagatacagtatgatgtgttaggatgtgcagtagccacgtggattgatagttgggttctagactcagcaacaccaagagccaccactcgtcatttaggaaatagcctaacttctctggtcttttctaagctgccttgtaaaatgagtgtatgaaacttcgatctctaaaatatctatgccaaatagaaaaatctggccctaaatatagtcctaaggctaccatatttttagcagtattaagagctcctggtgtctgtctgtgtatagacattagtgtgaatacaacatgtgttggggaagggtgagatggaaaaaatacacacaagatatactctatcaggaggaggtaaaatttggccagtgtaggtctaggtacacagtagttgatgagcaaacagttaggacatgcctagagttctttaaatttgctagtcagccacagccatgtgaggaggagttgtcattaaacagagaattaaaggatagaagagccaattctgtccattagatatagcctttctggcaaatgaaacaaaaactgcaagtgtgtaaggccaaacagagcttgctattctcttttgaggctttttttttttctggatgttgttaatttgtcctatgtgtctgtaaatcattaggagagaatgtgtcagtacccagtaatccaaaaatcttttgtaaataccattaaaatattaaataatatatgctttaaaatccttcaaaagtttaaaaaaatctaattttattttacataatcaaataatagaatcagagaactgaagggcatctttataaatgtagcccagtggttttcaaattctgcgctatagaaccattaggctcagtttagcaatcccataaggcacttagttaaaattacgttaataaagtctatcttttttattatttttgaagttgtaattttaaatgggaacaacttcaaatgtcctataaaccaaagtattaattaactggataccattaatataacttctgcttcaaatctgactttttgttttctgagtctgaggactatggaatagtttttcttgctctcacatgtgtatgtgtgtgtgtgcgtgtgtgtgtgtacatgaacatgtatgtcatgtgtactaaatgattatttattaaggttgtaactcagtattgttattattctgagcgaaggtctccacgtgcctactcccattaacttataaagatgagtatcctgttacagcatgtgcatgtcatatgtaattgaattttatctaaagttaggacacatatttcttgctatgtgctataattatggtcaataatagattgttcaacaacaagaaaataaaaaatattttcttaatggtaccgtattatgaatgttctaatttttaaaactactgattatttaatgttttgtttgttatttattatactttgattcaaattttgagtttataataaatactgtgattagtgtttgaaattttgaagcaacaattgcttcaaatttttagaatcattttggtgaaaagttatgctacatataaaattgcttaaattattcacagttacttatttgcatgggtcaagacttcttggaattgttcaaccaaaacaaaatgtagaaataaaataattctgccccagaaaaaccaatgagttaaagatgagattaagaagtccttttttttttttttttttgatacagagtctcactctgtagcccaggctggagggcagtggtgctatctcggctcactgcaagctccgcctcccaggttcttgccattctcctgcctcagcctcctgagtagctgggactacaggcgcccgccaccacccccggctaactttttttgtattttttagtagagacagggtttcaccgtgttagccaggatggtcttgatctcctgacctcatgatccacccacctcggcctcccaaagtgctgggattacaggcatgagccacagcgcccggccaagaagggcattttttaaataacttaagacaaatgaaaatggaaacaccacagacaaaaacttatggcatggagcaacagcaattctaatagggaagtttttaagtaagtaaatcaaaaaagaagaaagatcccaaataaacaacctaacattacacctctaggaactggaaaaaaaagaataaaccaatcccagagtcagtagaaggaagaaaataataaagataagagcagtaataaatgaaatggagactagaaagacaaaggaaaagaacaatgaaactaagtgtttgttgtctgaaaagataaaccaagttgatatacctttagccagactaagaaaaaaatatagagagagaaaggactgaaataaataaaattataagtgagaaaggagatactacagctgaaaccacagaaatacaaatagctatgagagactactgtgaacaaatacatgccaacaaatttgattacccagaagaaatagatatatttctggaaatgtataaactacaaagatcaaatcatgaagaaatagaaaatctgaacaaacccatagcaaggaggttgaataaataataatcaaatgtccatcaaagaaaagccccgaaacaaatggctttgttacaggaatagggttccaatccagacctcaagagaggattcttggaccttgcataagaaagaattaagaaagtaaaggaataacagaatggctaatccatagacagagaagccccgagggctgctggttgcccatttttatggttatttcttgatgtatgctaaacaaagggtggattattatgcctcccctttttagaccatatagggtaacttcctgatgtggccatgcttgtgggagtgtagcagtgaggaccaccagaggtcactcttgtcaccattttggttttggccggctcctttactgcaacctgttttatcagcaaggtcttcatggcctgtattttgtgctgacctttcctatctcatcctgtgactgagaatgccttaaccgtccgataatgcagcccagtgggtttcagcctcattttacccagttctgctgaagaaggagttgctctggttcacaggcctctgacagcttcacagccgaattctaccaaacatttaaaaagaaactaatactaatcctcctcaaacacttccaaaatattgaagaagagtgaccattttcaaactaattttacaaggctagcattagcctcctatcgaaactaaataaggactctatgagaaaataatatttcaggccaataaccctgataaacataggtgcaaacgtcctcagcaaaatatagcaaaccaagtttaacagcacattgaagcaattattcaccatgatcaagtgagatttatgcttgggacggaaagatggttcaacacacaaaaatctatgaatttgatacattgtgttaatagaatgaaggactaagctatatgatcatttcaatagacacagaaaaagcatttgacaacatttaatattttatcatattaaaaaactctcaacaaattaggtatgaaaagaatgtacctcaacatgataaaggccatatatgataagcccacagctaacatcatcaaactaaatggtaaaaagttgaatgcatccctctaaaatcaggaaaagacaaggatgcccactctcaccacttttattcaacatagtactggatgtcttagctagagtaataagacaagaaaaagaacaaaaaacattcaaaaaggaaaataaagagtaaaattgtctcaatctgctgatggcatattcctatgcataaaaaaccctaaagaaaccaccacaaaaccgtcagaactagtaaattcagtaaagttgcagtatacaaaagcaacatgtaaaaatcagtaacattcctttatactaacaacaaactacctgaaaaccaaattaagaaatctatcccatttacagtagaataaagaataaatttaaaaaaaaaacatgtaggagtaaatttaactgaagtgaaaaatatgtgtattgaaacttttaaaacattgatgaaaaacattgaagaagagacaaataaatggaaagatatcccatgttcatggattgaaaaagtttatatattttaaatatccatcctacccaaagtgatctacacattcaatgcagtctgtatgaaaatcaaaatgtcatttttcatggaaagaaaaaagtgtcctaaaatttatttgaaaccataaaagaccccaaatggtaaaagcaattgtaagcaaaaagaagaatcctggaggtatcatgctacctgactttaatacctattgcaaatttatagtaattgaaacagaataatactggcataaaaacagacacattgacaaatggaacagtatggagagcccagaaattaacctgtgcatttatggtctattgatttttggcaaagataacaagaatatgcaatggagaaaagacagtctcttcaataactggtgtttggaaagctggagatgaaaatgaagttagacccttttctcacaccatataaaaaatatcaactcaaaatgaactaaagacttacatgtaagacctaaaactctaaaactattcaaaaaaaaaaaaaaagagaaaactgcatgatattgatctgagcaaaggtttcttggatattagcaaaaaaacacaggcaacaaaataaacaaataagaatacgtgaaaataaaaagcttctgcatggcaaaggaaataatagagtgaaaaaacaacccaggaattgggagaaaatatttgcaaaccacacatctaataaggggctaatatcctaaatatttaaggagctcaaacaactcaataacaagaaaataaataacccattgaaaaatgggcaagggatctgaacagacattttccaagagaagacatatatattttgtaatatatattttgtaatatattttgtaatatattacaaaattctcaacatctctaattagcagggaaatgcaaatcaaaaccgcaatgagatatcacctcacatctgttagaatggctattatcaaagtgacaacagataagtgttgaagaggaaatggaagaaggggaaactttgttgttggtggaaatgtaaactaatacaatcattatttaaaactctatggaagttcctcaataaactaaaaatagagccaccatatgatccagccatttcacctctggatatagttccaaaggaatggaaatcagtatgttgaagaaatgcctacacttaagtgttcattggtgccttgttcacaatagtcaagatgtggaacagacctaagtgtacatcgaagaatgaatggataaagaaaatgtagtgtacatatatcaattaaaaatgtagtgtacatatatccttaaaaaagaaggaaattctgctatttgcatcaatgcagatgaacctggagaagattatattatgtgaaataagcctggcacaggaagacaaatatcacataatgtcccttacatatgcaatctaaaatgtcaaactcatacaggtagagagaatggtggttaccaaagaccggagaaggattgggaaaggggagatgtagatcaaagggtatgttaaaagaaaaacttcagccgaattaaatttaatggggtttaattgagcaatgaacagtttgcaagctgggcagcccccagaatcacagcagattcagagagactccaggggtgcctcatggtcagaacaaatttatagacaaaaaaaagagacatgacctacagaaatcagaagtgaggcacagaaacagctggattggttacagattagtgtttgccttatttgaacacagtttgaacactcagcagtgtatgagtggttgaagtatggctgatgggattggccaagacgcagtattgttacaggaacatactcttgagttaggttttcaatcttgtctacctattaagttaggtcatggttcagccacaaggactcaaatatagacgtaccgagtccttctcaggccatatttagctcactttaacgggtacaaagtttcagctgggcaggaggactgctttttagtgatctactgcacagaatggtgaatagaattaatgcattgcatcttttaaaattgcttaaagattagattttaaacgttttcaccaaaaaagttgataagcatgtgaggtgatggatatgttaattagcttgatttaatcattctataatgtaagcatatattgacacatcatattgtacccccaaaatatttacaattattatttgtaaatttaaaaaattaaattgttttgatggtatattattgatggtgtcatacattacttttgactttaaatattggtatattagaatagcctcactgtttaattgaatgtttttataataagccagtataatagatttgatattatgagatgaatttgaagttatacatgatttttctgttttacaaatttgtgttatatacaaggtaggctttttacattttccagggttaaaaaaagggggtaactcattgatgtagatcactctattatttctcccaagcttgttagaggtacagcaaatgattttcagatggagaatgagattctctcagacttttacaagctagttgttttgattggttgtttgtttgtttggtggtttttttggtttgtttttgtttttgtttttctctgagatggagtcttgctctgtcacccgggctggagtacagtggcccgatctcagctcactgcaacctccacctcccggttcaagcaattctcctgcctctaaaacacagttttattgtgataaatttacattttatgtaatgaccaatttaaagtgtacaattcactagttttaagtatattcacaatcactagtctgtctgagtccatagatttgcctattctagacatttcctctgagtagaatcttacagtatgtggccttttgtgtctggtttctttcagttagcatatatttccaggttcatccatgtagcatgtgtcaatactctggtctttttgttttcaaagaatatttcatggtaaggatatcacacattttgtttactcattcatcagctgatgaacattttgagttgtttcttctttttgcctattatgaataataacactgtaaacatttatgtataaattgtatttgaacataggatttcatttcttttaaatatatacctaggagtggaatcactgggtttaagagtgactctattgtttaacatgttaaggaaccgccaaactgttttttaaactggataccacactgccaacagcaatggatgagcattccatgttctccacattttcatcagcacttgctattctctctctttttcaatgtaactgttctgtgggatatgcagttgaatgctattatggttttggttcgcagttttctaattactagtaatgtcaaatagcttttcatgtgcttattggccattcatttatctttgttgtagaaacatccattcagatcctttgcctagtttttaattgggctatttatttttttattatcaagttgtgagacaccagcagtgtttgaggattctacaaactagtttaaacctgtggtcatcattcttgcataacatacataactccatttttaattaggaaaaaaaattaaccaggtttctgtagctaagcaatgttcatcttatatgtgaatacccagtcagataatataacttactgatactactatttgaagatttaaaaatacataatttcatctcctaccaaacccatttgctagctgatattttagtgcctttccaaaggcatgacaattattttcctatgaactttcattttgaagaaggaagttgaaaacaaagagatgttactatggctctcattaccaaagtctacttccaaaagaaaatgatagaggaatatgaatttagaaaatatctcctatgtctctggttgtacagagtgtatgtgcgtatatatatatatatatatacttttgttggatggaatatgaccagtgatctgtggaaataactgctggaaaaccaaaaaattgggatactatttgcaaagttaatatttttacacctgttaattttactcatttaagaaagtataaataattttatcatgcgttcatttccggtgcctggaacatgaaaaaactaaaatataattttaagtttttcgcttactcaggtaaaacctcattatctaacctcaagaccactgaaatgaaaatccagttgtaatcataataacactcgcacagtggtgataggttatatccatacagtttctgctccagtgaaattccattttaagaaaatactctatgctattcagtcgctggacattcattgtaataagatgtcatttgtataagcaatatgaattgcattcttctgtcaagtggacataagttcaagtatgggtgactttgagaaagattctatacatggtagctgaccaatttgttttggtggctatatagcttaaatataacaatggttgatattctatgaaaaatagacaacaaaaaaatctaattgtcattgtttaaatttaaacagataatgtcaaaactccagaaaatatgtgacatctgctaagtaataattctctacatctctatacgcctttttttttttttttttttttttttttttttttttttggcagagtttcgcttttgttgcccaggctggagtgcaatggcgtgatctcagctcaccgcaacctccacctcccgggttcaagcagcaattcttttgcctcagcctcccaggtagctgggattacaggcatgcaccaccatgctcagctaattttgtatttttagtagagacgaggtttctccatgttggtcaggctggtctcgaactcccgacctcaggtgatctgcccacctcggcctctcaaagtgctgagattaaaggcatgagccactgcgcctggccctgtatgtgcttttttataacattatcttatgaaatgtaattggagcattcatcacattgtaattgtacctttgtgtgtgtttgtgtttgaatgcgtgtgtgtgtgtgtgtgtgtgtgcgcgcgcacatttcagagaaacctgagaaataattgtatggaaataattaaaggtatcttatgaaatgtaattggaacttttatcacattgtgattgtacctttgtgtttgtgtttgagagtgtttgtgtgtgtatgtgtgcatttcagagaaatctgagaaataactaagggtatggaatgtatgctttatcttcattttgccagtacctagtacaatgtctgacatataaaagtactcaggaggccgaggtgggcggatcacctgaggtcaggagttcgagaccagtctggccaacatggtgaaaccctgtctggactaaaaatacaaaaattagccgggcatgatggcgagcacctgtaatcccagctactagggaggctgaggcaggagaattgtttgaacccgggaagcaaaggttgccgttagctgagagcacgccactgaactccagcctgggcaacagagttagactccatctcaaaaaataataataataaaaaataaaaggtactcagttccaattcattaattaattactatagttgctgctgttagattggctgctactgctgctgctacaaatactatctctgctattgctcactattatttattgagggctcattatgtgctatactctttttacttcttctcacttcatcatcgtaagtatgtggtactcttgtattgctttatcactgaaaaaaatagggtcacacaaaaaaataaagctggggagaggttaaaattattttatcaaggtgagtattttggtctgctttgtttttttacatttgtttccttgtgtgttttgcatatataatttcctcagaaaatgtgacggtaaaagaaactaggatccaacatatgtttccaaataggtcatagtgaatgggatcagacatgtgaaaattcattcaatctctcatgggcatcgggcaagggaaagggacatggggttgtacatgtgatatctttagttcaaccacctaggaggaaaaagtgtgctttttttcttgttttatttgcctctctgccacaaacccatgtttcaaagcttgttcaaaatgaatactcaataaatattattgataggcagcctacctgccacacatcatctttgataagtgaattataatgacaatactttgggttacgatgtctgccctttgagagaaagagaatttaaagtaaccacggcctatctcagcttgctggagatataaatctcttggcacctattagcataatctacttatggaagagacataaatgtggagcgaaagggttgcaaaatgatttgttgggtactattgttgagccctaatttaaatcacttggttttctccattattattccaaagcctcatctgaatccttctgacattgaatgtactttataggaacagtatattcctataacttgtaaaatctttaatgtaagatttatattatcttcagtaagatggatgagaataattactttaagtcttgttaagttcctcaaccaatgctgttacaaatttgtacaacagaaagaattaaaatgtcacaagatatatttctgagcataacaatcacagcatttaaaaatattcttaagcatagtatttttaaacaaaattcatggattatctttgcatatacttatacacgaggacagtatggttttcttgaaaacattagttacaaccagctttcaggttcatttttaagtatgggccatattgctgtatgtgaaagctgacgtttcaccagagccacagggacgttaaagtttaaaacagcaaatgtaaaatcatgccactggtcatttgataaacttgaaaagagaggacacaaatgtcagtatctgtcaaagtaaacacaattcatttttttattcatagcagggaaagtcatatgtcaaaggaaaaaaagcgtaatttgctgtgagaagaatgccaaggaaaaggacaaaataacatcgattcggtagttagactgaatatacaagaagtaaggaaaaatgtgtattaacacatatatatcagagatgtaaaatttatatgaggtaccaaaacatcatgttatagattcccttctctacataaccaggctgatgctctgtgccaatgtaaataggcccaattattaccgtttctagtgcagcagaaagcaaagagattcacagaaaatactgccttaggctgtcaccatggtggtctcagcaggggctgagctaagcttgagtctacaggactgacccaaggcttgaagaaaccaatgagggtaagacttcacacagagggtcgtgtcgcaagggatttgctaaagatcaaatcctggtgaccaagaaaagcccaatagctagataagaagtgaagtctttgaagcacacctagcagaacagaactagaagaggagttttccaaggtaaaactctgcaaatattctttgaagcaaagatacagagaagatgaaagattttataaaagcatttttggctccttccatggggatagaaggagttctttatggttgaagaagtaagtaggagacaggactaataatactaagaacccacccatagacctttcactaagttactcgatttccattgccttcaagtaatatatttgattgccttatttgtaaatgtgatagctaacttgtcttccttacagaacacctgtgaagattaaatgtgactatgaacataaaagcactctacaaaattaaaatgtatttacaaatggggaattattattctgttaattttcttttattttccttcctttcttcttttcttacattcaacaaatatttcatgagcatctagcatgtaccagacattcaatgccctaagtgaacagtcaaatcttcttcctctagggagctcacattcaaactggagaaacgtaaaacgaaatgctgcagtagatgggactagtgctacagaggacagtaaataagaaaaaaagaactggagcaatgataagaagtgtgggggtattgaaattttgacagagtatccatggaagtcttccccgagaaagtgacattttatgcaagactaggagacatgaaagaatgaatcatgcagatttctaggagaagactatccaagcagagggaagagcaatcgcaaaggccatgaggtggaagaatgttaacatatctcagaatctccaaggggagctatatggttggagcagatagagggaagtaagtaggatatcagtttagaaaggcaatggagcagcagatcacatggaacctttagggtcatggtgaaggttttggcttttcctctcagtgtgggagaaacaggacatagctaggcaactcagtttgttacattgagaatagacagaagagaaccgatggttaaaactgggctcctgttaagaaatatactgaaagaattcagttgtgaaatgatttaatgtggaaaagagtggtagcagtggaactgttgagaaatgttaagatttttggatataagaataaggtagactcaacaggttagctggagtcttgggtgaaggttgttaacaaagagactaagtagtctgagcaaacagggggctagagttgacattaactgagatgggaaaactggagagaagaaattctagggaggaggaagtggtaagagttcagtttgggactttctttctttctttctttcttttttttggacggatttttgctctcgttgcccaggctgtagtacaatgcatgatctcggctcactgcaacctctgcctcccgggttcaagtgattctcctgcctccgcctcctgagtagctgggattacaggcgtgtgccaccatgcctggctgattttggtattattagtagggacggggtttcaccatgttggccaggatggtctcaaactcctgacctcaggtgatccacccaccttggcctcccaaagagctggattacaagcctgatccaccgtgcctggccagtttgggacattttaacttagtagaggcatattaaacatccaagtggagatatcaaggagacttttgatataaatctgaagattaggagagtagatttggttgaattcataaatgtaggcattgttagagtagaggtgaggtggtctgtaaatctaggtgattggttaagaccttcaagggagtaagtatggacagagtagagatctacaaattacctgagaggcatacctatgtttccacgtcagaaagataaagaggaggccgggcgcggtggctcacgcctgtaatcccagcactttgggaggccgaggtgggcggatcacgaggtcaggagatcgagaccacggtgaaaccctgtctctactgaaaatacaaaaaattagccggggacaatggcgagcacctgtagtcccagctactcaggaggctgaggcaggagaatggcatgaacccgggaggcagggcttgcggtgagccgagatcgccccactgcactccagcttgggcgcagagcgagactccttctcaaaaaaaaaaaaaaaaaaaaaaagaaaaaaaaagaaaaagaaagataaagaggaacaagcaaagaaaaccaacatgggacaatcaaataattaggacagttaggacagtgtggtaatttgaaaaccagatacagaagatatcccggggacagggagcaatgcactgtcaaatgcttatgattcagttgtatgattcactgcaacctccacctcctgggtagatggttgaatgaggatgaccacttaccacctgctatggtttggtttgttcttgcccaaactcacgttaaaatttgatcccaaatgtggcagtcttgggaggtggggcctagagggaggtgtttcagtcatgggggcagatcctttatgaggacagagtaatgccctcctgcagggttacttttttgcactccagtgaaggggttagttcctgagagtagcttgtttcaaagactctggcttcctcagtttctccctcttgtttcctctctcaccatgtaatctctgcacacacctgctccccttcctctttctccaatatgttgaagcatctggaggccctcaccagatgcaacaggctgatcttgaactttccatccattagattcatgaaccaaataaacatcttttcttcacagacagcccagtctcaggtattctgttacagcaacacacatggactaagacagcaccacacacaacaatgcaaaagccatttatgatcttgaccagaggaatttcacctcaaaggtggaggcaaaatcatgataaagttagtttaagaatacaagagaaggctgggtgcagtggctcatgcctgtaatcccagcactttgggaggccatggcaggtgggtcacttgaggtcaggagtttgataccagcctgatcaacatggtgaaaccctgcctctacttaaaatacaaaaattagctgggtgtagtggctcatgcctgtaatcccagctacttgggaggctgaggcaggagaatcgcttgaactcgggaggcggaggttgcagtgatccatgaccacaccattgtacaccagtctgggcaaccacagcaaaactcggtcccaaaaaaacaaaacaaacaaacaaaaaaagagacaagagagaaagtggagacagcagggtcagtaatattttcaatgagttttgctaccaagagaagcaaaattaataataataataggggatataaagttgagccaacattcttattttaataaaaaaaatcttccattaggcagcattcagaacagaggaaaacaattgataattattggaacagtgctatggagcaagtgagaaggcatggatctggtgtccaagtgagttgtcctgagatatgtttgggaactctgctctgtggaagcaggaaggccagcagagtttgtggacacagatggatttttgggtgaatgtggtgcagagagcccgcagaggctttcttctgagtggtctggattctcagtgaaatttgaagctaagaggaagactggcatagagggttgggcttaggcagaagtggtatatcaagataagtgcatggaattggggaatgggggacaaggcagggaaagtatatgtgaggaaattactatgaatgatcatgtaagcaaggtaaaaaggaaaatgagaaatgaatggtgcagggtgaaagtgaagaatagtgaaaggctggaaggtttataaatcccagggaggtatgttttcaaagctgcttattggtcgtgagacccaaaagtcttggtcattccgtctgctaaaaagtcttcagtttctttgtatccttatcgcctctgccttatttaacattatcattatcattatcattatcattattattattcccagggcattttccttgcctcttctagagtgctaaccaaaatatcacagaacagcatcatgagcatcacttgggggcttattagaaatgcaaattctcaggcctcgacttaggcttatcgaataaaaatctctaggactggggctcaggtgattcttctgcatatcaagtgtaaaaatctctgctcttactgcatataacatacaaaaatctctgtccatacagccacccaagggattttccacataagcaaacctcattatgttctacttttcctcaaaaaaatttgagcctgctttacctaaagcataacatctaaaaatgtgtgcttagctcattcccatatttacacctgtgctctcgtcttgttgataatatcttcatgtcttagcctctgctgttgttggctctgaaaggtattccttatcttgctatacaggcagaaaaaaatttattcagttttcacatttaagctgagacctgttctcattcctcttggtcagctcagatgcttttaccctatgctttcaccaaactttatatagacttcaattttaataggcatatcattatattattaatttttacatgtattgccctccactaaacagaaagctccttgatggtaagtatatttttcttttatctttgatgtccagcatctcaatcagttattaggcagtcactatatgttcttggaagatgaataagatattccaaagtaaagtggtttctgcatttagatgctctgccatgtctgaatgtgacttacaataatttattatatgttatacacatccagaaataatgaacaatctgtttataaagtctatttccttacaccaggtcatttatgaatatgttaaataacaagatacttataatactttcatttttcatatggtaaagccaaacgtttactaatttttcagcaagactttgtgatttgagtgaattatttttcttgaactataaaggatttttccaaccattcagattctttccccagagtacccttgcagtacctgacaatatttgcctattactttgtcaaggcaatgtgagtgtttctgtggttttgcaacaaggtttgccaatttgaacaatgattgaagtcatgataatgacctcatcaatttcacattctagactgagccaaccaattccgttcagatttgttatgcatttcatttcatggggccatactaagcaaacactttcctgttaatctttgacaggtgggccaactgacacatttaaacaaatgaagtctttttatttattgttggtagattaatagaatcatctgataggtaaaaccccaaaaattttggtgtagtttcaacacttctggctgatgtcatatacttgtcacacaataatgcagactcatattactcttgaattattacagtaaatgtgtgacgtggtataaaaaacagaactacataatactctaaagtattaaaggcatatgaaattttggggaagactacttgttttggaagagcattactaagtttacaaaggaatttacatagcttcctttagtattttgacaatataaggtcattgtttaaattttgtttttctaaattatacagagattatatcaggaaatatatatatgtgtgtttgtgtatggtgtgtattcacacacactcatacacactaaattaaaggaatgagtcaagaattcttttacaaaattataaaccccttggattgatacttccaaggataatctgcttgacttcttgaaattcttgacatctgtattctgtcttccttggcacatgctagactgccctttccagcattcctgtagctatgtgtgatgatgtgactgagttctggtgaatgcaatgtgaatggaaatgatatgtggttcttccaggcaagaaccaaccaaccaaacaaacaaacgaaaaaaacactagccgacttttcctgtcattgggctgaatgaacaagagtccagggatctaaaggatgcacctggctccaaactgtttcaatagagaagaaagccccccacctccagtccccactaaccctcattaaattacgatctaatcaagatatttgcattgttttaaaccactcggattttaggattcatctgttatagatgctattattatttgccttaattatcatcactggaatctactctcaatagccaacagtcagtcttatcccaccctttatcctaccctaggtatggttgaatgtctaggttctgcttggcaaagatgatttagacaataaaggagaaaaactggaaacttggacagcgatcaaggcagaggatggccaagcttagcctggagcatgcacaagttttcaacataattgcaggcttagttatggccttaggatgaaataagtggaaagctaaaatggagaaataaattaagacaaaaatctagatatgacttaggtaaaggtgaagtctgtgacaatgatgagaacttgctccagaggttttatagcacataggtttactggtcaaagcgatattttagcagctctgattctatgtagctgattcatattttaaaagccccaccttataagagtaaaaactattttctgtattggtagtatttttatttatcgaactcttccaatatgtatttgatgaaaatgataggttgtttgccacattgaggagaaatagggacacatcatatgcaggccagatagtggctaatctcctaataattatcagattgtctctggacaagggatcaagtttatctgaactttacctacaaccatgccagctaagcagaactactcatggattttcagttttttcatttaaatttgtatattaatatgtgatcctaagtaatgatgtatctaaagcatctttgtttactttacactaaataaattaggatttaacaatacagttgtacaatttgtttttttgtccaaccccaagattattgatctccaggaactgaatccccaatgctcaagtgattcaacactttaagacaggcaagtaatggatgactgagttaaacacaaggtagagagcacatggaatatgcatctaactggtttaattaagttagttccatctaactaacttccagactaggaagctgaggagcagcaacaagaaggctctgtttagagggtcattagtaaggaatagacaactcaattaggtaatccagggagatacattttgtaacatgtgttttataaacataactcagctcaatacatacccgattgaaataaaagagtaaaatgtgagcacctcttgtgtgtcagttgtgacgcctcatgttttactagtgttatcacatttagagcttagggcggtcttgcaaaattgacaagcaatttgagagataagaaaactaattcaaattttgaggtcacatttggatactatgatttatggcttgctagtcactttcacaaagtgattttttacagccataatttaactttctatttttttaaatcgatttacctcttgtcttggcaaataggtaaactggattataattacatggtaccatcataggttccccagaaaagggtttttttaatcctctcaaaatcaccaccacttgctcacttatattttgaatctgttttagaaaacataaaactttctttctattattagagctctagctttatatgtaaaaacacctttggaagaactggcacattaaaattgtttcacacagagatgtaaatgggtgccaatcttcattaagtttgctgtgacataaacaaaattatactttttctatatcatgactaaaaagtaaaagagcgaaagtagactaacaaaatggagagaaagatgccataagatttcgcaagaaacacaggaaaaggggggcaagggatattaaaccaaaatatgagattaattcccactttttctaaggcacaacttcagatgtttaatttttcattactaaagaagataacgatcaacctttaaaaataattgtttttccatattatctttatatctgttttttatagtgagacattcatgttttgttcattcacttccatgatgcacaccttgcactgataaaatgaccaaggcacccccaggactcatcatggatggtgacgaaaatcaagcctgaaaacttggattcagtgtgtcatcctttatagtagcacaatttagaaacaagttagactattatgaataagttgtttctccacagattattttctgttttgttaaaaccccatttagaatgagattgattgaatggtaatcacaactattctagttgccaatcactctttgggcttcactttttgttattgtcctagagggtcagcagctgtgaacttgttctcattaattttcctgacaagcgctagtttacatagaaatggttgagtccaaactcaggaccaatttgaattcatttgaagttagggaaacaactgattagggcagacctctaaattcaacagatgttacattcagttttgcaaactgatggagattgaagatccgtggcctcagtggtttataattgcactctagcacacaattgattattgtatattatttgtcatttatatggtatgaaagcctggagcctttgactcatagatgaatgtgtcagtgaagatgctttaggtatcctactcaacccacccttatacacaaaaagacttatttacctagcaggaatctagaaacagggtggatctcaggatgatggatccattgattccatgccattgaggactgcaacacatatttccccacagtgccagtttcatcctgtattgactctcatggtgaagaatggttactatcagcaattggacctacatgtttctttgtatatatctaaaagctgagaaagaaggtttctcttcagtattctaatcaagaaagtgttctatgatttagcttgattggattgtctaagtcacatgtcaatagttaatagtgactgcgactggggaaatataatgtgctggttatattgcactaatgcacataagctccataacagaagaatagacgcattgcagttcttttggaaggacgaaggggtcaatatttgctaatcacacaaccaaaaatatcaacgatagcctctgtccagcatccagaacacagtcaggctttgttcttcatttcatttttgcattgcattttgtaattttgtttatttatttttatttttgcagttaatgaatagtaatatagtcatataccatgtaatcatgttttggtcaacaacaaatttcatgtatgacagtggttgcataagattataatggaactgaagaattcctattgcctagtgacatcacagctgtcttaatgtcatagcacaatgaatttctcgtgtgagtgatgatgatgctgtaaacgatcctgctgtgctgccagtcatataaaagtataccacatgcaattatatatagaacataatccttgataataatgttactcgtttatatatttaccatactagatttcttatggctattttagtgtgtactcctacttattaaaaaaaagttaactgtaggccgggcacggtggttcacgcctgtgatcccagcactttgggaggacgaggcgggtggatcacgaggtcaggagatcgagaccatcctggctaacacggtgaaaccccgtctctactaaaaatacaaaaaaattagccgggcgtggtggcgggtgcctgtagtcccagctactcgggagactgagacaggagaatggcatgaacccgggaggtggagcttgcagtgagccgagatcgagccactgcactccagcctgggcaacggagtgagactccgtctcaaaaaaaaaaaaaaaaaaaaaagttaactgtaaaacagcctcaggcaggtctcttaggaggtatttcagcaggtattgttatcataggagatgacagctccatgcacgttactgctgctgaagactttccagtgggacaagatgtggcagcagaagaccgtgatgttgatgatcctgaccctacggaggcctaggctaatgtgtgtgtttttgtcttaatttttaacaaaagctttaaaaagaaaaaaactaaaataaataaacttaaacatagaaaaaagcttagagaataaggatatgattaaataagatatttttgtacagctgtgccatgtgttttaaattaagtgttattacagaagaatcagaaagttaaaaaatttagtttataaagtaaaaaactgcagtaagctaaggtaaatttactaccgaaatttttaaaaatgaatttaataaagcctaggtgtgcagtgtttgtaaagcttacagcagtgaacagtaatgtcctaggccctctcgttcactcacaacttactaagtcctgcaagctccattcatgataagtgcaccattgtttgccttttacagtacttttagtgtactttttctatgtttaggtatgtttagatacacaaataccattgtgttacaattgcctgcattattcagtagagtaacatgctgttcaggtttgtagcctaggggcaataggttattccatgtagtcttgggatataggctaaatcctttttatccttttttttttttttttttgaagcagagtctcactctgtcacccaggctggagtgcagtggcaagatttctgcacactgcaacctccccttactgggttcaagcgattttcctgcctcagcctcccgagtagctgggattagccaccatgcccagctaaattttgtatttttagtagagatggggtttccctatgttggccagggtgatcttgaactcctgccctcaagtggtccacccccttagcctccaaagtgctgggattacaggcgtgagccactgcacccagccgggatataagctagatcctatatagaaggtagtggtctatacaccttcaaggtttgtgtaagtaggccctatgatgtttgcaggaaaacaaaaatcacctaacaaggtatttctcagaatgtgttctcctcattaagtgatgcataactgtaaaatgatagtaagaaatatacatatataataatatataaaaaatctgtcgtatccataaaaattaaatggaatgttttgagaggcttgacacaattaagtggttaaaaactcttgtagaattcatgttaaagaaaaaaatataaaactgacaggtgagatagaaaaatatctagaaggatttgcttttttttttttttgagatggaggttcgctcttgttgccccagctagagtgcaatggcgcgatctcagctcactgcagcctccatctcagcctcctgggttcaagcgattctcctgcctcagccacccaagtagctggggcgacaggcgcatgccaccacgcccagctaatttttgtatttttagtagagatggggtttcatcatgttggccaaggtggtctcaatctcttgacctcatgatccactcaccttggcctcccaaagtgctgggattacaggcgtgagccaccgtgcctggctgaaggatttgcaatcacattattttgcaaacattttaaatgttttaatgttttactcttcttttaaaaaaatgaaattagagaccatagaaaatatattgtggcatgattatactgaaaggaaaaatttgaacttcaactaggggctatgcactcaaagaagaaacatttctcctgcatcaaataactagtgaatggtgtctagtaaaaatgcgtttgtgctaatacaaaaatgttaagatgtgcttattatttctatcttaacttagcatttttaaaatcagtgaacaattgctttatttatttattcatttatttatttatttgtgatggagtctcactctgtcacacaggctggagtgcagtggtgcaatctcagtgcgctgcaacttcgacctcctgggttcaagcaattctcctgcctcagcctcctgtgtagctgggattataggcatacaccaccacgaccagctaatttttgtatttttagtagagatggggtttcaccatgttggccaggctggtctcaaactcctgacctcaagtggtccacccaccttggcctcccaaaatactgggattacagatgtgagccactgtacccagccaatcaattgctttaaataagaggacatttaattttaagttagaagtttaaaataaatttaaaataaaccaaataagttttacttgatttaatgaaagtgaaataatttgaagtagaattctgaactttgcataaatgtttattatatgaattttttaaatgctcaacaatgtttacaaattaaaaatcattaaaatgttgtaatcaatttaaactacatatttcatttttacagcattagttgattctttgctgtgaaatacatgattagaacttttttcccctccctaattttttcttctaccttccctctgattttgttgctttattcagcatttatataccattctatagctataatttttctattattttgtctgttatatttaaatagattcaatgcatactgcaacttctaccatggtatctccatttcgtagttattttaatgtatttcttggctgaatttatcattgggcaggtaattttttcccaagaaaaatgtgagtgcaatattcctcgaaggcttttcttgttcacatttgaaaatgtctgcctgttgcctttttcctcaaatgataatgtaactggaaataacacagaattgttgaatcatactttcctttttaaactgtggatagttttacattgttttctagcatagaatatttcagtggagaagtttgaaaacagcatactttttcccccttgtaagtaacttctctgcaaaaaagtatttcttcatccttgaagttcaataaaagatgaattaggatggatatgcatgctggtggttcagtgataaattctcctagtattttatttattgtgcctatttagtttgcaggttcaatgatctctcatttcaggagttttttcctatgttactttcctcattactattttccattccatttgttggattttctacttggagagcatcaattatctttaccttcaatcttctttgtccatcttccatatctatcatcttctaattgctttgttctctcggtctttttcttcacattcactctgattaattccatctatgccagcagcttgatagtcaagaatcctactttgtttattttggctttcattcatttattatattaatatctgtagcaaaattgttttgatattcagtttgctttgataatttttattctgctacttattaacatttttctcttttattgaattcatgtttatattaaatatgtttacatcttgtgcaattgtctctgttgttttatattttgtgtgttgtgatcctctcaacacacaccctacccttgaccaaacacgcttgcaaagttatatgccatttttaaaatctcattcatcattaatttgggcagctctgtctacaccttctatttactttgttataatgtaagtgaatgaattcttcacactttcaccatcttatctagtacctttgcttttcctttgaaattattatttgaacggtggatactaaaaataatctacttttttatacctgaagtcatgaagacagctttatcttggataaagctgagaccattccttgttggagcacatagctccattctcttcttcgaaactgaatgttttgtactagagccagctctcctagacaggtaggggttctgcaagtcagcaacctcccacacctgtcccccacctcaagaaagcaatcactctgagtttttctacctctgccaaagtcctacattgctgtgtaaaatcctccaatctcaagagctattttcattctaaaaattttccctggtttacttctagtattcttaatatatttctctccaaactggagaaatattattaaggttatcagctaactcctcttctttcctcgatactgttgtacccaattccagaattttcttttttcttttttttttttgattgccactttttgatgtttatatttatttgctgatggtgaatcttatcaaattttttaactggttttgtgcttttttggtttgcaaatttgggagggagattttgcaatactgcctccctctgacatcttaatgcaaaatcatctgatctctaaaattctaccagacatgacaaaaatgaagtaaaagaaaagaagtacaagtgagtgagggtattagcagtttttcagtaattaaaagtagcatgatgaatttagcagtttggatcgctgtcctgacattggcaacgttaatcagtaaagtttctacgatgacggaaatgttctatatatttcctgtccaatatggttaccactagccaaatatggctattgagcacttgaagtgtgactggtgtgagtgaagaaccaatatattctattatattttaagtaatttgaattaaaataaaagaattcagtaggtctcattcagtaggtcggggaaatgaccaatgacctgatactgcctatccagggtaccacactttgaaaagctctcctctatataaccaacgtttctgtacagattaaaatcacactgttgataaaattgtgcaatcacagggaaagtagtagttggtgcaatatacttgtctataacaacatagggattctcaagaatctcaggacataatctccagtaacagacaagacactactctttgttctttcctcacagaaaataaccaccttgtctctttcccattcctttcaattgttacctggtgtcttgtgataataatagaatcacaaacttccaagtcctggtttcagctgtagaagaccctttaaataggagttgggttcattcccaaataaaaaatgacactaatattttaatataggtatatatccaaatgatttcttcatgacattggtagataattttataactcactaaaggcaaatactttaatgaagaggaatgttttatgtcatgcatgcttgttaccatcaacaatataagaattatagttatttccttctgtaattcctatccctaacacactgttgacattttccatgctggaccgtataattcagtatggctcctctcacacaaattaggacattttgtcatgttcaaatacagagaaagacatagcctagcatttcctagagaagaaaaattgtcagcattttcttccactgagcaatctcaccatatagtttcattgatctaacagctgatcatattttctaaatcagttgaattttggaaccattttcagtagtgttttacagagacattttctctagcttgaatatttaaaatggtaaatattgttatctgactttattaaaaatgttaatcaggctcattggggaaagagaatcaagataatcagaacagctattctattttttaaaaaaatttaattaaaataaatttaaaaattcttctaaaatcttaaaatttttaaaattatatgacagatcccatcagttctttccatcagttttgatgtttcctatcattttgttactgttttaacaaatatgtaataaaaatcatgatgtttattattattgtttgagtctattgtttggtaggctttctctattcttgctatagatttgtactcagttatcttaaatttttgtcactagttgagtgaagatatttgatatttagtgggaattactaaacaatctgtcacgtttgataatgtgtaaatatgttggacatataatcttatattttgaaaacttgttattgcaaaagctatactttaatcttgaaagcaaatcaccaagtgagatttactcagggttcattttacatttttgtagcattcatggatgaactactttgaagattaaattataagcaataaaaattaatttactacaatagtaaatataccagtaaattagtaggaaataatcacttaaaacttatacaatacaattttaattatgtagagtccatgtttagatatattttctttatgatatacatgggccacaatcaagcatattaattttctgcctgctggcgcaaaagtcggttggtatcttcctaagaaaattttgtcagtttctatagtcttttgcaatcgtgtatattctaagacttgtttggttttgagtgttaagtctctattaatcaagtataatgaggataatctctcttacattattttaaacaagtaattttatttccctaccttccatcatttttctttgttttagctttatcaatgtataactgacaaataaaacttgtttacaagcaggatgtacaacataatgttttgatatgtatatacattgtgaaatgtctattatttttcttgattcctcaatcagacagcctatatgtgaggacagtgatgtgaatataatttgtgactgtgtgtgttttacctctttatccctgctaagaaaatagataaggaagttaagtggaaagagtatctttatatgagtaactatgaatctgatcttatttatcttttaataataatatagtcacaaatcttctgttctctaacactatctataaatgcctattgacacttttttaatatccctgtaaaattacgttgacactcaagaatatggttaagaggcatttctctactgagttacaaagattttataaacaaatttaaagggcaagcgatacattaggaaaaattatctgttacctatatgatgtacgaaaaagaaaaagtcacacttcatacagtttctagaacttagaaggaacaaaaagaatctactgaaaaaaaaaaaaaaagaatacaattcagaaattccctgaactagaaatccaaatggccaaaacacaatcccaggttcaattaacaaatccaactcttaacaataatgatacctcccagagcgctgcaggtataagcatgagccactgcaccccacctccacctttcctttttaactatcagtttcatatgcctgatttttttttacaataagcatgttatatttgtaatttttcgtttaacttaacgtcaataacgttttatactccatagtatagaaaaatatagtatacctattcttttatatttaaagaaaaaaatttaaattaaatgcagttttatcgaaatatgttgtgtcatttttttttttttgtccaaaacaacatagctgttctgcagtgagtgtatggagacaggtgttatcatatactattgataggagagtaaattggcccagtcatttcagagggcaatttgactgtatttctcaaaactctaaatgctcaaatccaataactgataaactctatttctaagaataagtcctgaaaagactttcagctggggctatacgatgtctgtgcaaagggccccctaccacattctacgacatttttatgtaacagtaaaatattggaaaatacctctgtatccaagtctggtaaaataattttgttgaatcaatataatggattacttgtagccaataaaaataagaagatgtgtgtgaaaaatgtatcttttaccgaaaaaaaagcaagttgaaaaaacaaaatctagttacaatacttttttacataaaagatatacacataagtgaatacatatgtgcatgtataaatgtatgagcccatatgatcgtaagaaaaaggtctaaaatggtatactctaaatagtctactactgggaattcggactgagtggctaagtgagacccctttctctttctctttctctctctccttcgaaaccgggtctctctctgttatccagactggaatgcagtggcacaattatagctcactgcagcctggagctcctgggcttaagtaatcctcctgcctcagtttcctgagtagctgggactacaagctcatgccatcatgcccagctagttatttttgttttgttttgttttttgtttttgtttttttttttagatagggtgtctcactatttctccaggctggtatcaaactcctggcctcaaatgagtcttctcctgggtcactgggattacagtggtgagccattgtgttccacctttctttttatttttgagacagggtctcactctgtctcccaggctccagtgcagtggcccggatctcagctcactacaacttccacctcctgggttcaagtgatcctcccacctcagcctcctgagtagctgggactacaggcacacaccaccatgcccagctaatttttgtcttttttggtagagatggggtttcaccattttggccaggctggtctcgaactcctgacctcaagtgatcctgttctgtcctgtaaaaaaataaaaaataaaaaaacactttcaataatatgcagcaagcttttgtttgggaggggagataatatgtaaatttaaactattaacttttctttaaggattactacaaaaatagattttaattcctatcattatggactattaacattttatattctactatttcaagcagttatgctaatttattttagagattcttcaactcttcttttccaacaaatattttataatgatctataaagataaaaaaaacagagccagtaaattatgactttcctgttatactaatgccacacattttatgattgtagtgacggaggtgtctgtcatgaaacaatgactaattgtaggaagtacaagccttctttaaaattaatgaagcttcagcaaaataacaaaatatgaaaaaaatcaaaattattttttacttcaaatatacatttttttcttttttttttttaattgacacaaggtgtcactctgtcacccaggctggagttcactggtgccatcgtggctccctgcagcctctacgtcccaggctcaatccatcctcccacctcagcctcctgaatagctgggactatagtcgcatgccaccatgcctggctaatttttgcattttttttttttgtagaaatggagtttcgccatgttgcccaggctggtcttgaactcctgggctcaagcgatctgcccacctgagcctcccaaagtgctgtgattacaggtgtgagccactgcgcccagccaattttgcaaattgaactttcaattataaaagattatttgtcttacttaagcattgttgtcctactaaactattatttctatgcattaattatgccttggtgactttaggtttgaaatcaaaacccattttcttttatataatattaacaacactattcagagctaagacgcattataactaatgatgcattatatacacttgattattaattttgctttttaagtgaataggaagagtggatatgaagagaatgcccacagtcctcattgctgtggagatttgctttccacgattttaaatcagggttatcagaaaaatccagtttctccctagaaaggtttaattagttacatttgttgaaaagtttgacacattctagatgctttatatttaagactgttttataattaaatgccatattatgaaagctcttcttgcttctgtattaacttattaatggatattgaattaaaatcataaaacttaatcctcactgttgaatatttcttaaatctcaactaataaacagttggcatatggacattcttattgaaatataggacatttttactggtgaatacatttttccacttaaaagtttttatgctgatataatataattggttccattaagctattataatataaattgcattcccctaaggtcattttagcctttatacatggttaaaggctttcatgagttatataaaactcagagctgtcaatgaatttactattgagtagcagactgccaagtagactgaacaactgaaaaaggggagaaaaagcaaaataatgataaaagtagataacatttatatagagctcactacaagtcaagcactttttaaattgtctcatccatattaattcatctaattctcatagtgatcttggaggttgatccccttatcatccccacattgcagaaactgaggcctggagaggttaagcaatttacctgttgtcatacaggcagtaaggaattaagctatggtttaaccccagatattctggctccagagcccatgctttgacttaaccactcttacaccgcctctccatgcaaattgctgttggatgattgaaatggtatgggtgcttagaatcaagtgacatataaggctgcagacaaagacagacctaagattttatcattttaattcactaccactaaacaattggccagaacttggactttctggccctgtacttatttctttcatagtctacaccaacatatttgacatgattccattatgctgccacaagtgatagactataaagagaagtagttatttgcttctaatattttgccagataattaatatagaaaatgatacattttttctcatcaaatgcaccaatgcatttttcactggaatatgaaccctggtttgcagaatggggctagtctggggcaaattcgcgactgccgccttgggttccaaagaccaggctgactcaggaggaatattactcaaggtaactgcagtttgtaaaacatgagcaaaaagaataaaaaaggaaaaaaaaaaagatcagagctgcaagtcacttgcatatggcaatcctgcaggcatgttaagaatgaaaacagctgggtgcagtggcatgcacctgtggccccagctacttaggaggctgacacagaaggatggctttaggctaggagttcaaatccagcttgggaaacatagcaaaaacctgtctaaataaataaataaataaaacaggatttaaataggaaaatgactagtgaaggaacccatcaggcaccattgttctagtcaaaactttagcattatcctagttggttatttccctcacttctctactgtgatatcagagcctttaggaagccttgaggttcatttccaaaacaaagtgagacatgcccgtgtttgccattgccatgactcctgcccgctattccaatctgtggtcctctcttcccaagagctcagccttggccccagctatgtgtccatttccatggcttttacacttgccctctcctaggttgtatccatgacacacagcagaggtttttaaattagaaatgagatcatatcactctcctgactaaaactcatttcagtgaaaataagaaagattgatatattcccatatatgttagaagaaagttcaaactccttgtcaaggcccaaagattctaaataattctgcctttctctaactccatctcatctcttctcccacctcctcccatcatgcttacttatttccagttatactgtttccccttcaattctgcaaatagccacactgtctcttgactttgtactttttttttccttctgtcttgaatgctcttccctagctcttcaaatgcctggctcagtctcactcagttctgggctcactgtcaccttttagagaaaccttgctgatcagttatttaaaacagggctccttatttattttctatcacatcaccatatttattttcttcacagcagttgccacagtctaaattatcttgcgtacttatttgattacctgtgtattgtctgctccagtagactgtaagctttaccagaacagcaacctattctgcctcatttgaagtgtgcaccctacgttgagcaaaatgcctggcatgtagtaagcaagtggtaaatgtctattgcatgaataaaactgatggtgaatcagtgtccacaaatgagccaaggaaaatggctcagggctgagaccatgggcaatgaacaagttctttgcactgtttgtgagaatagaaaggctggacgcagtcacattggggttgagtcctcaaactgtaataagcacaaataaaatgatgaaacatagtaaaagattgactgttccctgtccatctatctatcaatcatttatctgtttacctgttgcgtgtgtgtaatgtctacagctttatccttccataaaatgcatctgtatttggtaattttcaaatttaatcattatacgagcataattaaaatataggtgtttacatttcattttaaaaataaacacaaacacttatgagtttttagaatgcacaagtaagtggaatatcttgattctcaatctcagattaactaaagatatactttgtgatgcggcagtcaatttatatggttaaatagtgtatcattgaaatgtttgcacataatatgtgtaacaacgtttgaaataatgaaaccacaaaagcaaaggaaataattttgattaaaagtgaacatgtctttttggaagttaaaataatcaaatggtaaaatttacttctaataattgccatatttatttttttgccttccttttatttagagactagtaaacctatcccacaaacttctaaaagcatacagatgtgagaaaaactgaaactgaaatggtcattatttctaagtgcaggtttccttttcaactacagctgggttttgagcatatcttaattaacaaaaaaacttaaagaaagcttagcaaactttgaaggaggaggtcattgcattaatgttctttccaccattctcagcaatatcatttacacctgcttccctgaggtgttattccatatgccccttctggatataactatgtagggagtgtaagaatctttgcaaattgcttcaagagggtgatcatgattttaactgccactaccaatcaaatctgaaggtccatttatttaatgaacatgaattcatttaaaaaaggaaattaccaaactcatcatttaataacaaaaagggaaacaatacaaataaatagcataattaaatagcaaaaggcaatgagaatccaagcattttgagtatctgcaaaaggctaacaatgaattttacaaattaattgttgtaggacaggtttttttgtttgttcttttctcaggatggagtctcactctgtcgcctaggctggagtgcagtggcgcaatcttggctcactgcaacctccacctcccaggttcaatcgattctcctgcctcagcctcccaagtagctggggattacaggcacacaccaccatgactggctaatttttttttattattatttttagtaaagatgtggtttcactatgttggccaggcttgtctcgaactcctgacctcaagtgatcctcccacctcggcctcccaaagtgctgggattacaggcgtgaaccactgcacccggcctaggataggttttctcattgccattccattagagttttgaaaagaaatctattgaaaatctcattgaactatacacttatatcagtgatttttaaggcatataaattacacatcagtaaagtggctagaaaagttatataccaaaacttttttccaaccatatctctactctgcatcttcaactttgttcagtctatgccatagcactttctcctgtatccaccatgtattgcgttacccaaccttctgctgaacctaaatttcatcacatttttaaataagtaactctcctcttggaccttaggcttgagataaattttccacttttgagggatttttttctaaactataacttcatataatttcaccccttgatttttctatcctctcttcttgtctcctctcatgtcatctcctttcttctctttccttccttgcttcttttatcacttttatttctggctatatagtcaattcatttactcagaatgtcacccatcctaatgcatataaactgtgaaggactggcacttctctgaggctctgaggttactcttactttcgaatggaaattggagttcttaagcactttcttaaagctaaaattagtaggaatggctattcatttcgctcacgtgaaaagtgtcagaaatatcttggatcttattgaggttttatttctcactactagtacaagactatactccttgagtgtggagactgtcttttttttttttattttgagatggagtctcgctctgtcgcccaggctggagggcagtggctcgatctcggctcactgcaagctccgcctcccgggttcacaccattctcctgcctcagtctcccgagtagctgggactacaggcacctgccaccacgcccggctaattttttgtatttttagtagagacgggggtttctccttgttagccaggatggtctcgatctcctgacctcgtgatccgcccgcctcggcctcccaaagtgctgggattacaggcgtgagccaccgcgcccggccgccggagactgagtcttgttcatcttcatgtgcatctcccataattgaatgtctggcgcagtactcaaaaagtagtattcaccaaattttatgtacccaagagttccggagaagtttgttgcttttattattgcccttgttcactgaagcaatcgttccaaatgccaacatagggtcctacctacttcttattcagtaccgaaggtccacacctatgtggtatcaaatgatcattttgtaaataatatgatctctgtcactttactaaaaggataaataagctgaccacatatgtgagaaggaggagatggcaaaaagccaagactcttccttctgcttccttgctcccagactcttcaggaccttaccccataaattatcattttttttctcatctactgctaattgatccatcttctaagcaaacaatcatactccaaacactgcttttaaaaacaatctctccttaggtcctttccccaggatatagtcatttttctctttttgtagccctttttctcatctatcgttcgtcaacaatttatcatcaatatgatctatgctttatatccatcagcttcaatctagctttttcttctaccgctattatgacacttcttgtgaaacgagcacatatgacctcttaatcgttaaattatagagtttatacattgtttcttgtattttgtttacactgaataaatctatagaatttgtaataattgctaaacgggtgaaatcactgtagcaatttcagccttgcttattttcaatggcaagtaaacctcattctgcattgatggtgaattcgaatgcaaagatatttatttaccatctgcaattaaaaaaaaaaggtatgggggaaatacaatgaaaacaccaaacagtatttttatctaaaattactatagagtggtacaaacaaccatatatcataaactacattatgttgtgaaacagactgtgatgatggaaatcaagtgtatattagacagaagggttattctaactggaaggactgaggggtgaggtcagggctgctttaaatgttgttttccttatttttttccctgcctttatttttcttctttgagctattgttgtttgagtggttaataacacttctcagttcataggacattgtcatcaggggtctatgcaaggttctcttatattttatgaatttatttacttcccgtaacttcattctccactggagaaaattttatacagaagatcacataagacctggacctgcgtggatgaatagtaggatgtccacagaggaagtgaacggtgctccaaaaagagggaaaaggggaacagaggtaccaagaagtgatcgttgcttaagtctggggttagtggcagcatatatgtctggaaagattgttgcagcaagttgtaaaggtcttgatatcctgtgttaatacaattgcaacacaatgacgaattttgagcaaatgggttactggatctggctcatgtgagatcattctaacagaggtatagagaatctattttagaaactgggtcagaacaaagataactgagaaagaacatagaagaaactggactggggagattactttgaaggtggttcgttatctaaatcataatcacaattaagatttaaggtaacatttcccattgatacagaagtttaaaataagacagacgtctatatgcaattgatcttttcttccatactggtcctacagacctgatgttaaatgctttttaaagtgctcttgttatccctataaacattggagcttggtttccttgggaaatgtaagagcagagtttattagtctattcattcctagtactaaaatataatggatccagtggtagaatgaaagattcagtttccttaacttgccatatatcttttattacattagtgatgtgttttcctgatatttgtttccttgtaaactgtacttttctctctttctttgaattagttgctgtcaaggtgaatagctgaataatcttgcattaattattaatacttcttatgccaaagctaattaatggttttgcacgatttaaataaactacagtcttatataaagaaacagctactttctttagaaagctaacacatgtataaacatgtggtcataatttgaacatattaataatgtaagtttccaacacaatcatataaagagattagaaacaaggagatcctaagtcttctatgatggcattctattaaaatccaaattgaaatgtgtgaaaaaagtcacttaaatatatgtgcctataatctatctatctatctattatctatctaatctatctatctatctcttttcagccatctatctatttattttactgccttcattacctacaatttgtttgtgattctccagattcctttttttccatgttatatttatcaagagttttgattttggtcttggattttctgcgatttctttattattctacatttaattatttttataccccaacagttaatgtgataacctttttctattaatatccctttctccattcaagtatttatttttctctttcctctctggcatttctctgtgaaggaaccttgacagctttctatcgtggtgtctttatggtgatagcacagacaccctttgaagttaacatcttgttttctcctgaagatagtttctactccttctttattttctttgaccccagcccagacttcaataatgcattgaacttgctgtcgctgatagtccttctgctggtatttcattgctgtctctcttgctcagggtcagggacaaactctcagctattctcacaagattttaataggcttttactggcacttaacatttataaatagcaaacaacaaatgacacttctgttgcatgtgctacaaaataaggtttttgtacattgaagaacatatttcttaaataaaaaaattaaataatgtctctataactacataacagaaaataagaccaaaccataattatataaattaatattatttggaaactttttagaacatgttttatatttttatgagtacatgtaggcttggttatgctggagtaaaatatcaacaggaaaacaccagtgtcttaaagcaacagttacagccctagccaactgtccagggcagctgtcatctcagtttttggctcactagttcagactccgtgatcatcaagagaaaggtagagtgttcaggaggatccacaccagtagtgtaaggcattggcctaaaaaggaacaaagttactttctctgaaaagcccttaaccagaattgttcacaggtttttacctaagtgaaaagaaaaaatgaaaaagacacaaaagggtaattctcttaaatagctacagaagtaaataatcagatatggataaagactagaaatttctcccacaacatgatacaatagatttctattttactgccaacaacatattaattctactttactccgtggctacaaactttggaagatgttattagcaagcattagaagaagaaagagagataatttgttatggatgaggcattcaaatcttgataaatataaacaaagtatttgggactagaataaataatgcaaatacaaggtaaaataaaaaggatacatcagttagaggacagaaccattttgagagctttttggagatgagtgtggaaagaaaacagaaaaagtggcagagagggattgtatggaggttgtgaatggtgactattaaaaacactaaatgctgatatccacatatgctcatgtccaggcaagtccacagatggaaagatacttagctgtagcagaaataaggaatgggctgtgaggtttacaagaacagaccacccaacacctatgtgaaatgaaaacctggccaaggaccacagtcatgaattcaacttcattgtccagaaaactaactcatgcctcatagaaatattatggaagcatccattcctttttacataaagcccaattttaccgtatgcaaaaaatttacagagcatgcatatgcttgcaaataattcattttctgtgccctttattttactcataggttgaagaagtaaagaagtgtcacaaaggaaagatcttctgggtcctaacaggactaatatcagtgcccaaaatgaaaatgcattcttctgcatacctagttactgtttcggctggtgtttcttacttacagttaataaaatgttagacatccctctagttcacaggttagccaccccagctccccattcagagctccctagtgggaagctgttgagcctaaaattcatgattgtcagcctccaacagagaacttccacagattgctgctgctacagcttcaggatccaatccaagtcctgctttatgccagtctggtgtttaacacttagtctggtttattacttccaatcagtcctttttggggttatgttaactgaaattagtttctgttgtttgcaaccaaagaaccataattaagactgccctctccactccccacacagctgagatttttgcacccaagttgactaagaaactcctgaaaataaatagcaggtttaagatcctgttctagagagctgaatcacaagacatttaaaggagaataaacagggttcagttactaaattcctttactggagaaaatagtcaaaaagagaaaaagcaaacataactaaagagttttaaaatcgatgacatcagaagaatgtggtataatcaatagttacaggaagttagcctgtgaatgacttgtagacagtcaatggtattcacatatgcatacgcttccataaacctgttgttctttctcaactattccacatatggaaggggcatgtgactcctttccctctcctttattgattttcctcatggtcactattccaactgcactcagctagcggtagttgtcttaatatgtcataccctttaatgtgtatgtttttgtgcccaagttatttctccttccttggagtgacttttctcccttgtttgtctgtcacttcttagaatcagctgtcactctttgaaatctcagagtcaataacaagaacaactacaaaaatgatcactcactcactgctttctccctacagttcccagaacctactcctagtattccatttgtcaaaatgcagtttagtatttagttgcgtctgttatctttaatccactgtgacttcctaaaagtggggctgtgacttacttgtcattgcatatctgggaggtacttggtacttggcacagggtgaataatacttttttttttttccacacagatgaatgaataaattagtcatctagggttaagatttttccacctcaaaatctgacacatacacacctatttacaaaaccttatagaaccaagtttagataaaattaataaactgaaaactatcctgtccttttatatttaggttgtaaattcaatgtagataatggatggattcttattatgtgtgtgtgtgtgtgtatatatatatatatatatatatatatgaatttattttttaacagaagcatccaatgctttttacataaaacccaattttaccctatgcataaaatttacagagcgtgcatatgcttgcaaatacttcattttctgtgccctttattttactcataggttgtacgactatgtgcccatgtgcatgtatgtgtgtgtgtttttatacacatagatgtgtgcacacgagtctacatgtttgaatagattttgagaagcaattgtaatgcactattataattgaagtccaaattgactgcaactatgtcaatgagtgctgaatcaccagcctcactatttcctccttgaatagcctttccgtcatctccattttctcgagtaatgctccctaatcctacactgtaccttcactcccttcttgccttctttccattatgtttattcttcacggaactgacatcaactttattttcaaacagtgacttcgttttcaataaaccaagctagaaaacccaattctgtatgtattctgggcttggtttttttctgatgttaattcaccatattaagtttttgtcttggctctgcacaatctggtgattagcatatatgtataaaatagaaaagagcttttatatttaatgtacttttcatgcgcattgaaactctgggcagaagatgtggggtaaatgcaattactatgtagagtagcatggtaaatctcaaattacatgagaaatttacctagaattagatcagatacatagatgataggtaggtagatagataaattttatttaaaatgatcgtcatcaggagtgaatctccaaaacattgtgaagctgtagaacttatattgggtatttctttgattgcctgtgctcatccattcttccctttatgcaagcatccccctctggacctctcactcttcctcctcccacctaccctaatgggaattacccaccatgactgcaggccctccaggatgtggttcccaatttcctgtccctcagagtctcaactgccattctctagaccttgtccctgacacctatacttgacatactgtcatgtgctgtcctagagttctacttactcattatattcttttcaggtattttcttttcgcagggtcacactatgtgaaatgctcttatctcccctgggagcctgaaaaatgcagctttatcttgaaatctcagttcttctgagattacctgctccagaaagactcttccaactacacagtggttatttagatgaaattacctctattttctgccttatcaattctaatattgcacttgccatactgcatttatttctgcatagaatttttgtgtgagacaaaaggaaaaaatgcacccaattctcaagcactccctgtattctacaatgttccttcacggtgtctggccgttttgacgctgagcttgaccatgtgactcactttagccagtgggatgttagcaaacgtgaagtaagcaggggcttgaaatgagcttgtatattgaggcttctttgctcttgccttttgccattgccaggagaacctgcccagaggagcctgctggaggatgaaggacacgtggagcacagccatgtagcccttgtcatctcagccgtggccatcctggaccaaatgctcacctgcaatgtgttcattatacttgttgtggcaatgcataaccaatatggttgctttgcctgtattttgtgacctctttgtgagtgagacatctatgtcttgattaagtctctttcccccattcctagaacagtagttgatctattacattttggttgaattgaacctgttgaatgccgttattgttcctttctcagaaaaaaaaatgagtgctgtatcttatttctaacaggcttctaaacagtttagaacccctgcttaaaggaattctacaaaaaatattgagaactgcataacctctttagagtaatcaacatatgcaaataaccagtttatctacctctttagtgagccttaaactttgcaagagtataaaaaattatatattttttctcaatagtcttcatgtaattttctgcacttttctaaaattggttgtggaaattgtgcccggttttagagtggggggaaccagcaagtttggaaacatcatcagtgttcttgttttactcgtcttttagtaaacacattaggtctggacaaagtctaatgtatgtgcaagttcaacataaactgcatcgatcaattaagtaatctctccttttcatgtacttgataaagtactatttctcatatacatttttagaataaaaattacccataaatttgcaagatcggcaggtataaccagataaagacagttttcacttttgtataaataatgaaagtcatgcactcaagatagggactgtggaaagactaggaattctaggattcagcatatttgagaagattgctctggcccccctcatgaaggacttttcattcaagctttgaaagattcaatctatgcaaggatgtttctctaagctgctagtccaaaagtaataaacatcaagcttacggatgggtgtggaaactgaatggctttgcttttcttctgagggatttaatttatttttaatatcacaggtggcttgaggcgaggtgtaatcatctgtcactcttcagttaaatcatatcacctcacttctgaaatattctttgatctctctacctgtaaatcacgttctactttctctactatagactgtagcatatagatataataatgacatgacaaattaccaagagcatggagagtatgtctatttaaaagatgattgaaaaacacacacatgcaaatactaacccagacatttactttttaatgtttttcttcttttttgacttgttactagaatataaaattatatgaaacacatactgaagacaagttttaattttttttaatttaaaacacatcaggcatttcttttttactggctttatagtttaggcaatattaacaccttacatctgtaattttagcattttgaatacacagtttttaatgtacattatccattgggcagatccatagaacaagctaaaactttccagattcacattactttaaaaatattttgatttgctgggtgtggtggctcacgcctgtaatcccagcactttgggaggccgaggtgggcagatcacgaagtcaggagattgagaccatcctggctaacacagtgaaactccgtctctataaaaatacaaaaaattagctgggcgtggtggcgcacagctgtactcccagctactcgggagtctgaggcaggagaattgcttgaacccgggaggcggaggttgcaatgagccgagatcgtgccactgcgttctagcctggcgacagagcaagactccatctcaaaaaaaaaaaaaaaaaaaagatttgttgtcatatgtcttagttaacaaattttctgagggggtcattgggtaaagtatgcctcactagattatgttaggaaaagtgatgggacattaatttgtgttattccaatataaaaagggcctcttttcttcccccaatcaatctaactattaaatcacttataagaaacttaaatgtcacaataagataccaactgtcttgaataaaagtcatagatgcacgcctgtaattccaggactttaggaggtcgaggtgggtggatcacgaggtcaaaagatagagaccatcctggtcaacatggtgaaaccccgtctctactgaaaaaaaaaaaaaaaattagctgatcatggtggcatgcacctgtagtcccagctacttgggagtctgaggcagaaggattgcttgaacccaggaggcggaggttgcagtaagccgagactgtgccactgcactccaacttgagtacagagcgagactccgtctcaaaaaaaaagaaaaaaaaaaagaaaaaaattcatacatggaatgcctttcaaggaaacattaccttaaaaaagtgtaatattataataatcaaaatagccaaattcatataattttacaaaaaaacaagatttgctgaaacggtgaatcaaagaagtcattgtgaaaacagctttagctgcataaatgataaaatctagaaatagggatgagtgttattgaaaagaaggcttctgtttatatgaagaaggaagtctgaagagataagggaaagtgatatactggctgagtgtcctttatgcaaaacccttaggaccagaagtgtttaggatttaaaattttttagatcttagaatatttgtatgtacctaatgagatatcttaggaataggaccgtcatctaaagatgaaattcacatatgtttcctatacacttaatacacatagtttgagggtaactttatgcaatattttaaataattttgtgcatgaaacaaaattttggaaagcaaaggttccactgtctccacaaaccatgtggacagtctgtagttgattggcatcaccatgatttctcactctgaatttatacactattgataagcaatcatcttcttacacttatttgcacataagtacttaacagcaaaaaaatgtgacatggtattttcagcttattttctaataaatacttattagtcatataactgctatcctaatgtttatgttgttagatcaaaaaaatgaataagtatgttaaaggacctcggacttccaaaataaattggtgggcattattgatgttttatttctctgaagcctaccaactccatttcctgattcttcataggactttttgacatattgcttcaaactcttagatcaatgacatattaatccctagatttaaaagaattattgctatattaggcagtatgcatttagttgcaagtaataattttttaaaaggagctgatcaaaagggaatatttattataaggatacagtcatagtgggcagcaatatacttaggcctctggaatgacctgagagagaggactggacagaagtcttctctctgtccttgtgtttcttatctgaattcatttgattaatcagtatcttgatcaaaaataaacagcttactctaactgagtaatttgggcagaataaagagacatcttatacagacaaggtatagcacagctccctggcataaggaagaccaaggagtcatttccacatctaggtctggaggagaaggagcagaacagaaaacgcacagaggaaaactgcatgggaaggacaccagcaggttagcgctgcccctgtatctcagaactagcagcaggaatactccttaagatgccattttttggacctttcttccattgtctcatatctctttctaaccagagctgggaaaagttctccacttttcagggttcatatgatttgactgaacacacttagatgacccaagataatctctccatctcaatatcatgtattcctttgggttctgtaaaatgcaaattgtcctggaatacccaatgcttgaagcacttttttataaggtgtggtgcagttgtagtgtaagaatttaacccccatgagagcagagactgttttccttatcctttgttttgctgtatcttcaggatttagaatagtatttggcacataaaaggagcaaagtaaatattagttgactgaatgagtgagtgaatgagtggagagagcaatgccaagagagagatctgtagttttgagaagtaacatataggcaaagagagaggtttcatcaatacagcccctgccattatctctctcccggattacttccaagagtcccactgagtttttctgaattgcattaatctcaaatccattcctcattttaagactaaaatgggatttcttttgccatgtcgaattattcacttccttggttaaattccaactgaggtttccttttgcctgttgtataaaatcaagttcttacaacacccttgaagattggccccgagtacctttctcctcacattgtgctctgcagctgcattaaaaatgttctctttccttgctcacctcctgtcctttcttatcttgaggcctttgtcggtgctaattcctctactttgtatgccctgccatcttgagacacccttgtctgtcatctttgtttgttcttaatactaaacacaggtgctccaccctccacaaagcttcccttgacacttaaactccaagtttgctcctagaacctcctctgtatagttttctaccaccccagaagatgctgcatcttgttttttggctgtgtctcctatcaacttgatgtggggaaaagcaaagcaaaataaaacaaaactttattagtgccagaaaaaaagaatcatcaaaaggatcaccctttagaactatatattatacttcctgctaattcattccacttttccctgaggaaatgctatgtacacatgcatgtgtataaacccattgttatgttaattcaaccaattagtttttttttaatttatcagtctcctttttcctcatgaccatccctaaactcagaatcaaatttccagctcaattatatttaatctggtatatttcatggtctctacatttatggggttttttttctccatcttttctacacaagaaccaatctagtattgggccctcattttaattagatttttatcttgtttttaataattcctatatatgtgcttttttgtaaattttaaaatctaattcattaaactttaagttagtgctttttgaacacctaggattgccataaaaagaaacaaacacgcataaaaaattggggggacatagtttctagaaaggaaaattcttaccactgatattttttcttttccgggagtcaataactccagcaaataaatacttccaaaagaactgtgttctgtaatgtggaaatgaaaaacaaatctagttaattcattcagaagatttttctgtacctgtatttaggaataaatttgcatcttttacattggttccttttgtcattattgtaaatagccttggatggtaataacccactccattgctcataaaacccatttgatctgtgtttatcacttgctctataagtagctcttcatttctgtttgttgctatcatggttataaaatatactactataatagttcttaaacatacaatagcgctataaaacagtatctttggtgggtatttaagcaattttaatgctgagacaaaataatttaatttcctacccatatgttgaacgttccttaaggcactaaaaaaatctctaaaatccatatgcttgaaaatatctaaatttctgccaaacttagttcaggcttattagtaattcctaacgagtgaaatcattgtgattatacaagaaaaaattgattaaggtatggcagctttctctactatccactatttcagagctgaaaacaatacgtatatcagatcttggttctgtgacatctaaaagtatctacaacatttgtgagcaagaaaatgtagaacctatcaaataaactttgagaaccattaacttgttttactctacctgtaacactctctatagagctaaattaacattctttgtattgtcatttcaataaaaatgttatgactctttcatagttaaaatcaactttttaaattttcagtgctaaccattatcacttaataaacagcagttagattttgacaccttgatttattttaaagaaaagttaatatccattgagatgtgaattttacataaagagaataaacaaaatcagatgattatcttaatagatgcagataagccttgataaaattcaatatctcttcatgttaagagccctcaataaactaggaattgaaggaacatacttcaaaataataaaagccatctatgacaaacccacagccaacatcattctgaatgggcaaaagctggaagcattccgcttgagaaccacgagacaacaaaaacctctctcatcactactattcaacatagcactgaaagtccccgacagagcaatcaggcaagagaaagaaataaaaggtatccaaataggaagagaggaagtcagtctacccctgtttgcagacatgattctatagctaggaaacctcatggtctctgctcccaagctctttgctctgataaacaacttcaaaaaattttttaaatgtacaaaagtcaggtgcaattccaaacactagcaacatccaagctgagagccaagtcaagaatgcaatcctattcacaatcaccaccaaaagaataaatcatctaggaatacagctaaccagggaggcgaaagacctctacaacaagaattacaaaacactgctcaaagaaatcagagatgacacagacaaatggaaaaacattctatgctcatggataagaaaaaatcaatgtaattaaaatggctatactgcccaaagcaatttatggattcaatgctattcctaccaaactaacaatgacattcctcacagaattagacaaaactattttaaaattcatatggaaccaaaaaagcccaaatagccaaggcaatcctaagcaaaaggaacagagctggaggcatcatgtcacctgacttcaaactatactacaatggtatagtaatcaaaacagcacggtactggtaaaaacaaacaaacaaaaacagacacagagaccaatgcaacaaaacagatcacctacaaccatcagatcttagaaaaagctgacaaaaataagcaatggggaagggacaccatattcaataaatagggctgagataactgattagccatacggagtggtttgaaaatgaccgcttcctcataccatatataacaatcaattcaaaataaattaaaacttaaatgtaaaacctaaaactataaaacttctgaaagataacctaggaaatactattctggacataggacctggcaaagattttatgacagagtccaaaagcaattgcagcaaaaacaaaaattgataaatggcatctaattgaactaaagagctactgctcggcaaaataaactatcaataaacaaacaacctatacaatgggagaaaatatttacaaactatgcatccaacaaaggtttaatatctagaattcctaagaaacttaaacaaatgtacaagaaaaaaataaccccactaataagtgagcaaagaacatgaacagacacttaccaaaagaagacattcatgtggccaacaggaatattaaaaaatactcaatatcactaatcattacagaaatgcaaatcaatacgacaatgagataccatctcatgctagtcataatgatgactattaaaaagtcaaaaattaacagatgctggtgatattacagaggaaagggaatgcttatatactgctgatgggagtgtaaattagttcagccattgtggaaagcagtgtggtgattcctcaaagaacttaaaatgaaattatcatttgacccagcattctcattactgggtatatactcaaaggactacatattgttttatcataaaggaacatacatctgtatgttcattgcagcactattcacaatagcaaagacatgagctcaacctagattcccatcaacagtagactagataaagaaaatgtggtacacatacatatactatgtagctataaaaaaaaaaaaaaaacaatgaaatcatgtcctttgcagtgacatgggtgaaactggaggtcattatcccaggcaaacaaacaaaggaacaaaaaaccaaatactgcatgttctcacttatgggaactaataaatgagaacacatggacacaaagaggggaacaaaagagtctggggcctacttgcgggtgaaggctaggaggagggagaggaagagaaaaaataccttattgggtactatgctcattacatggatgatgaaataatatatacacgaaacccccatgacatgcagtttacctatagaacaaatttgcagatgcacccctaaatctaaaataaaagtccaaaaacgaccaaaaaaaaacaaacagaaaagaagtaaattttgtgaagtctttagtttataagttaaatatgctcaaaacataaagaaatcaagagttctagagtaattgtcatttatacaacatgaacaatgcaaacataaatttgaaagcttacataattctcaaaagaaccacaaattattgaaaaaataaacattttctatccatgtagatattgaccaaaatttttatagaaagagattaatgaataagcttaaattgtaaaagcaatctattgacatttccaaacctattgacttgatttattccagtactataacagtatataaaattatatattctatttataatagtacatgtaaatattacatacatagtattagtttactacataatgcatacagtattagtttattatgtaagcatatgtaactatacatatgtagttattagtttattcaccaattcaagtattcatcaaacttaacaaacatgtatttgcttacaacttactcaacatctgaaactgcacttcgtatcgaaggtataaaacttagcaaggtcagttttgcctgccagagctctcattcatatatgggagctaaatgagtggatctcatgaagattggtgatcaccagaggctggaaagggtagcatgaagggaaggtggttaatggtccaaacatacagtttgataaaagaaataagacgtggtgtttgatatattagcagggtgactatagtttacagtgatctataatacatttcaaaatagctagaagaaaataatttaaatgttattagcatatagaaaagacaaatatctagggggaggagccaagatggccgaataggaacagctccggtctacagctcccagcctgagcgacgcagaagacaggtgatttctgcatttccatctgaggtaccgggttcatctcactagggagtgccagacagtgggcacaggtcagtgggtgcgtgcaccgtgcgcgagccaaagcagggcgaggcattgcctcactcgggaagcgcaaggggtcagggagttccctttcctaatcaaagaaaggggtgatggacggcacctggaaaatcgggtcactcccaccctaatactgcacttttccgttgggcttaaaaaacggcgcaccatgagattatatcccgcacctggctcggagggtcctaccccatggagtctcactgattgctagcacagcagtctgagatcaaactgcaaggcggcagcgaggctgggggaggggcgcccaccattgcccaggcttgcttaggtaaacaaagcagccgggaagcttgaactgggtggagcccaccacagctcaaggaggcctgcctgcctgtgtaggctccacctctgggggcagggcacagacaaacaaaaagacagcagtaacctctgcagacttaaatgtccctgtctgacagctttgaagagagcagtggttctcccagtaggcagctggagatctgacaatgggcagactgcctcctcaagtgggtccctgacccctgacccccgagaagcctaactgggaggcaccctccagcaggggcacactgacacctcacactgcagggtactccaacagacctgcatctgagggtcctctctcttagaaggaaaactaacaaacagaaaggacatccacaccaaaaacccttctgtacatcaccatcatcaaaggccaaaatagataaaaccacaaagatggggaaaaaaccgaacagaaaaactggaaactctaaaaatcagagcgcctctcctcctccaaaggaacgcagctcctcaccagcaatggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagtaatggaagatgaaatgaatgaaatgaagcgagaaggaaagtttagagaaaaaagaataaaaagaaatgagcaaagcctccaagaaatatgggactatgtgaaaagaccaaatctgcgtctgattggtgtacctgaaagtgatggggagaatggaaccaagttggaaaacactctgcaggatattatccaggagaatttccccaatctagcaaggcaggccaacattcagattcaggaaatacagagaacgccacaaagataatcctcaagaagagcaactccaagacacataattgtcagattcaccaaagttgaaatgaaggaaaaaatgttaagggcagccagagagaaaggtcgggttaccctcaaagggaagcccatcagactaacagtggatctcttggcagaaaccctacaagccagaagagagtgggggccaatattcaacattcttaaagaaaagaattttcaatccagaatttcatatccaggcaaactaagtttcataagtgaaggagaaataaaatcctttacagacaagcaaatgctgagagattttgtcaccaccaggcctgccctaaaagagctcctgaaggaagcattaaacatggaaaggaacaaccggtaccagacactgcaaaatcatgtcaaaatgtaaagaccatcgagactaggaagaaactgcatcaactaacgagcaaaataaccagctagcatcataacaacaggatcaaattcacacataacactattaactttaaatgtaaatggactaaatgctccaattaaaagacacagactggcaaattagataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctaaaaagagacttagactcccacacattaataattggagactttaacaccccactgtcaacattagacagatcaatgagacagaaagtcaacaaggatacccaggaattgaactcagctctgcaccaagcggacctaatagacatctacagaactctccaccccaaatcaacagaatatacatttttttcagcactacaccacacctattccaaaactgaccacatacttggaagtaaagctctcctcagcaaatgtaaaagaacagaaattataacaaactatctctcagaccacagtgcaatccaactagaactcaggattaagaatctcactcaaaacttctcaactacatggaaactgaacaacctactcctgaatgactactgggtacataacgaaatgaaggcatccttgatgaacattgatgcaaaaatcctcaataaaatactggcaaaccgaatccagcagcacatcaaaaagcttatccaccatgatcaagtgggcttcatccctgggatgcaagcctggttcaatatacgcaaatcaataaatctaatccagcatataaacagagccaaagacaaaaaccacatgattatctcaatagatgcagaaaaggcctttgacaaaattcaacaacctttcatgctaaaaactctcaataaattaagtattgatgggacatatatttcaaaataataagagctatccatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccgaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccagcttacaagggaggtgaaggacctcttcaaggagaactagaaaccgctgctcaaggaaataaaagaggatacaaacaaatggaagaacattccatgctgatggataggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaagtaaagagcttctgcacagcaaaagaaactaccatcagagtgaacaggcaacctacagaatgggagaaaattttcgcaacctactcatctgacaaagggctaatatccagaatctacaatgaactcaaacacatttacaagaaaaaaacaaacaaccccatcaaaaagtgggcgaaggacgtgaacagacacttctcaaaagaagacatttatgcagccaaaacacacaggaaaaaatgctcaccatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaacgatgagttcatgtcctttgtagggacatggatgaaattggaaaccatcattctcagtaaactatcccaagaacaaaaaaccaaacaccacatattctcactcatgggtgggaattgaacaatgagatcacatggacacaggaaggggaatatcacactgggttctgttgtggggtgggggttggtggggagggatagcattgggagatatacctaatgctagatgacgagttagtgggtgcagcacaccagcatggcccatgtatacgtatgttactaacctgcacaatgtgcacatgtaccctaaaacttaaagtataataataaaagaaaaaaaaaaaaagaaaagacaaatatttaaagtaatggatatcccttgggctaggggagggatagcattaggagaaatacctaatgtagatgacgggttgatgggtgcagcaaaccaccaaggtgtgtgtatacctatgtaacacacctgcacgttctgcacatgtatcctacaagttaaagtataattttaaaaaagtgatggatatcccaagttacactaatatgacctttatacattatatgactgtattcaattaccatgatgtacattcactactcattaatacaaatttttttaaagaaaataaaatagatatttaaaatgtggtatgataagtactgtaacagtggatggtagatcttccaaaacttactagttccttttcagtttggcatctacttcttcattttgttaaaataaaacataattgaatatttttgtgtttatcttaatgatattgtaatttacgatttttacaagtatgcaactttatgattttaataaaccttacttaaatattattgtagccaattaagtaaagctaatccagacatctatgcatcaagtttgttataggtggtgacacactgtaaaaatgtgtacacatttatgtaacaatggaattaagtttttaatttattcctgctggtggataataacaggaagtcagggagatggaggcacagttgctatctatccagtcacatattgtttgcgactaagcaccattcaagagaccttctttctgcctcattaaataagttaatcatgtaaatcacagataaaatttgagaatatatggatatagtttacacataaatgatgtatttttattgctgagaataaaaacagatgtgacaatgcccaggtgtcagtcacaaaatattatcattctttagtatctaatatgaatgaatggaaaattaaaaggtcaaattgagatatatatatgtatgtgtatatatatataatctgtagaacataatcaccaatacaaatcattctccataattaaaataagtctaagtagctcaactgctgtgataagaatttaaaatgagccacatatcatatctggaaatggcattgagagactttttaaacagaagctccaaaaatccatcattttatgaacaaaatgtctattaatataggtttagtgagttcatgactcatgtcatggctaaatcctttttatttttcacagtccctcagtactccacaaaccttctactgttgccagcagtattagtagtgtggccagacagaggatgcaacacctgaaagattgatgcagaacaactaaataaatggaaaggcaaacgtaaacatgatcatttcaaagcaaataattacagtcatgtctctggaggcaaatattggcgcaaatttgtcttttcaatcagtttaacatgctttaaaaaacttctctttcgattttgtttgatccatggttatttaggcatatcttatttagtttcaaatacttggggattttccacatatatggttactcatttggaagttaatcgtattgtggtcaaagaacatacactgcataattttaaatgttttagatttgttgagacttactttgtggcttagaatatggtctatcttggtaaacgctttgggtgcccttaaaaatagtgtgtaatctgctgttgtacagtggggtgttccagaaatgtcaattaggacaagtggattatgttgtcgtttacctcttttatatccttactgattttctctctgtcctgtcagtcattgagacatgaatcttgaaatctctaactgtaattgtggaattgtctgtttctcattgcaattctatcatttttgacccatgtatttttcttaatttttaggcacataagcatttatccttctgataaattgacccttttaacccatggtaatattgtttgctctgaaatctactttgtctaatattaagatagcccacacagctttttgttgttgttgttgtttaatgctggcatagtttgtatttttttttatttctttaattttaacatatttggggatagcagattaagatggcagataggagacaggactagccttgtagctcacgcttggaggaacagagcaggatgtggaggctcacatcctcaacttttgctccaagaactactgcaagaatgtaccaggaaagctaagagaatccacacaccctttgaaagaattggatcattgctgcaggctccctgagacactgaaaacctgtgagtctgcttgctttttcaatggggaggttcctggtctggggccaattctcagccctgctcactggttgcctggaaatagactcggtgctgctgtggggtcacggtgggagtgagaccagcctttaggactgcaggctgctgggagcagggtgaggcctgtgactgctggctttcccctacttccctggcaacctggatgagtaagcagaggcagccataatcaccctcggaatataactccattggactgagaaccacaccccgtcctccacatgagctgaatgaagcaagccccgcccaaggagagactgaattcagatatgcctatccctgcccctaccctgtggtctttatctaccagccctggtagctgaagacaaaggtcataatcccttgggagctgtatggccctgtctaccacctgaggaacctgaatactgaaccaggtgtccctagggcaagtttgcatcctgcgcacaggaccacagataatgggctcttgagagcaccacctcctggctggaggccgaccaacacaaaaccagcacattaaacaaaaacacaaccaaggaccctcacagattccacttcactcccctgctgcctccaccaaagcaggcgttggtatccacagctgcaagacctgaaggtggatcacatcacagggctctttgcagacatgccccagtaccagcctggagcccagtagctccgctgggtggctagaccaagaaaagcaaaaagtatcactatagtttggctcacaggaagctccattcctaggggaagagggagaacactacatcaagggagcaccctgtgggacagaagactgaacggcagcacttgaatcttagatcttctctctgacatagagaaggaaccagaaaatcaattctggtaacatgacaaaacaaagttcttcaaaacctccaaaagatcatgccagctcaccagcaatagatccaaagcaagacaaaatttctgaattgccagaaaaagaattcaggtcaattattaaggtaatcaaagaggcaccagagaaaggcaaaatcaaacttaaatcaaaaacatgatataggatatgaaaggaaagtaattcatccaacttgccagtctttgtcttttaattgggtcatttagcctgtttacatttaaggttaatactgttaagtgtgaatttgatcctgtcgttatgatgctgcctggttattttgcccattagttgacgcagtttcttcatagtgtcgatggtctttacagttggtatgtttttacagtggctgatagtggtttttcctttccatatttagtgcttccttcaggagctcttgtaaggcaggcctggtggtgacaaaatctctcaccgtttgtttttctgtaaaggattttatttttcctttgcttatgaagcttagtttggctagatatgaaattctgggctgaaaattcttttctttaagaatgttgaatattggcccccactcttttctggcttgtagggtttctgcagagatatccactgtagtctgatgggcttccatttgtgggtaacccagcctttctctctggttgcccgtaacattttttccttcatttcaaccttggtgaatctgatggttatgtgtcttggggttactcttctcaaagagcatctttgtggcattctctgtatttcctgaatttgaatgttggcctgtcttgctaagagtcaaacacatcggtgggctgtatttaggagactcatctcatgtgcaaaacacacataggctcaaaataaagggatggaggaatatttaccaagcaaatggaaagcaaaaaaaaaaaaaaaaaaaagtacaggggttgcaattctagtctctgataaaacagactttaaaccaacaaagatcaaacaaaggctaagaagggtattacataatggatcgatgcaagcaacaagaaaagctaactatcctaaatatatatacaccccatactggagcacccaaattcatcaagaaagttcttagagacctacaaagagacttagacccccatgtaataatagtgggagactttaacagcccactatcaattttagacagatcaatgagacagaaaattaacaagcatattcaggacttgaactcagctctggaccaagcagacctagtagacatctacagaactctctaccccaaatcaacagaatatacattcttctgagcaccacatcacacctattctaaaattgaccacataattggaagtaaaacattcctcagcaaatgcagaagaatggaaatcataacaaacagtctctcacaccgcagtgcaatcaaattagaactcgagattaagaaactcactcaaaaccgcacaactacatggaaactgaacaacatgctcctgaatgactactgggtaattaacgaaattaaggcagaaataagtaagttctttgaaaccaatgagaacaaagacacaatatagcagaatctctgggacaaagctaaaacatagtttagagggaaatttacagctctaaatacccacaggagaaagcgggaaagatctaaaactgacaccctaacatgataattaaaagaactagagagacaagagcaaacaaattcaaaactagcagaagacaagaaatcactaagatcagagcagaactgaaggagattagagacacgaaaaacccttcaaaaaaccaatgaatccaggagctggtttttataaaagatcaacaaaatagaccagtagccagactaataaagaataaaagagagaagaatgaaatagacacaataaaaaatgataaagggcatatcaccactgatcccaaagaaatacaaactaccatcagataatattataaacacctctatgcaaataaactagaaaatctagaagaaatggataaattcctggacatatacaccctcccaagatgaaaacaggaagaagtcgaatccctgaatagaccaataacaagttctgaaattgaggcaataattaatagcctaccaaccaaaaaaaaaaaaaaaaagcatgggatgagacagattcacagccaaattctaccagaggtacaaagaggagctggtaccattctttctgaaactcttccaatcaatagaaaaagagggaatcggccctaactcattttatgaggccagcatcatcctgataccaaaaactagcagagaaacaacaaaaaaagaaaatttcaggccaatattcctgatgaacatcgatgcgaaaatccttaataaaatactggcaaaccaaatccagcagcacatcaaaaatcttatccaccacgatcaagttggctgcatccctgggatgcaaggctgattcaacatatgcaaatcagtaaacgtaacccattacataaacagaaccaatgacaaaaaccacatgattatttcaatagatgcagaaaaggccttcgataaaattcaacagctcttcatgctaaaaattctcaataaactaggtattgatggaacatactcaaaataataagagctctttatgacaaacccacagcctatatcatactgaatgggcaaaggctggaagcattccctttgaaaaccaacacaagacaaggatgacctctctcactactcctattcaacatagtactggaagttctggccagggcaatcaggccagaaaaagaaataaagtgtattcaaataggaagagaggaggtcaaattttctctatttgcagataacttgattgtatatttagaaaaccccatcatctcagcccaaaatctccttaggctgataagcaacttcagcagtctcaaaatacaaaatcaacatgcaaaattcacaaacaatcctatacaccaataatagacatacagagagccatatcacgagtgaactccaattcacaattgctacaaagagaataaaatacctaggaatccaacttataagggatgtgaaggacctcttcaaagaaaactacaaaccattgctcaaggaaataagagaggacaaaaacaaatggaacaacattccatgctcatggataggaagggccaatattgtgaacatggccatactgcccaaagtaatttatagattcaatgttattcccatcaagctaccattgacttatttcatagaattagaaaaaactactcaaaatttcatatggaaccaaaaaagagcccatatagccaagacaatcctaagcaaaaagaacaaggctggaagcatcacgcttcctgacttcaaactatactacaaggctaaagtaaccaaaacagcatgggattggtaccaaaacagatatatagaccaatggaacagaacagaacagaggcctcagaaataatgccacatatctacaaccatctgatctttgaccagcctgacgaaaacaagcaatggggaaaggattccctatttaataaatggtttttggaaaactggctagccatatgcagaagactgaaactggaacccttccttacacctcatacataaattaactcaagatggaataaagactaaacataagacctaaaaccatgaaaaccctagaagaaaacctaggcaataccattcaggatataggcatgggcgaagacttcatgacaaaaacaccaaaagcaatgacaacaaaagccaaaattgacaaatgggagctaactaaactaaagagcttctgtacagcaaaagaaactatcatcagagtgaacaggcaacctacagaatgggggaaaatttttgcaatatactcatctgacaaagggctaatatccagaatcttcaaggaactcaaacaaatttacaagaaaaaaaaaacaacccatcaacaagtgggcaaaggatatgaacagacatttctcaaaagaagacatttatgcagccaacagacacacgaaaaaatgcatgtatgtttattgcggcactattcacgatggcaaagacttggaaccaacccaaatgtccaacaatgatagactggattaagaaaatgtggcacatatacaccatggaatactatgcagccatagaaaatgatgagttcatgtcctttgtagggacatggatgaaattggaaattatcattctcagtaaactatcgcaaggacagaaaaccaaacaccgcatgttctcactcataggtaggaattgaacaatgagaacacatgaacacaggaaggggaacatcacactctggggactgttgtggagtggggggaggggggagggacagcattaggagatatacctaatgctaaatgatgagttaatgggtgcagcacaccagcatggcacatgtatacatacgtaactaacctgcacattgtgcacatgtaccctaaaacttcaagtataataataataaaatttaaaaaaattaaaaaaaaagaaagaaaaaaaaatgctcatcatcactggccatcagagaaatgcaaatcaaaaccaaaatgagataccatctcatcccagttagaatagcaatcattaaaaacgtgggaaacaacaggtcctggagaggatgtggagaaataggaacacttttacactgttggtgggactgtaaattggttcaaccactgtggaagaaagtgtggcaattcctcagggatctagaactagaaataccatttgacccagccattccattactggttatatacccaaaggattataaatcatgctgctataaagacacatgcatgcatatgtttattgcggcactattcacaatagcaaagacctggaaccaacgcaaacgtccaacagtgatagactagattgagaaaatgtggcatatatacaccatggaatactatgcagccataaaaaaatgatgagttcatgtccttcatagggacatggatgaagctggaaaccatcattctcagcaaactatcgcaaggacaaaaagccaaacatcgcatgttctcactcatagctggaaattgaacaatgagaacacttggacacaggtagggggacatcacacacagggcctgttgtggggtggggggagtggggagggatagcattaggagatatacctaatgtaaatgacgagttaataggtgcagcacaccaacatggcacatgtatacatatataacaaacctgcacgttgcgcacatgtacgctagaacttaaagtataataataaaaaaaaaaagagaaaaacaaccccatctaaaagtgggcaaaggatatgaacaggcacttctcaaaagaagacatttatgcggccaacaaacatgaaaaaaagctcatcatcactgttcattagagaaatgcaaatgaaaaccacaatgagataccatctcacaccagttagaatggcgatcattaaaaagttagggaacaacagatgctggagaggatgtggagaaatagtaatgcttttacactgctggtaggagtgtaaattagttcaaccaatgtggaagacagtgtggtgattcctccaggatctagaacaagaaataccatttgacccagcaatcccattactgggtatatacccaaaggattataaatcattctactataaagacatatgcacacatatgtttattgtggcattattcacaatagcagacttggaaccaacccaaatgtccatcaatgatagaatggataaagaaaatgtgacacatatacatcatggaatactatgcagctataaaaagaatgagtgaaaaaatatgtcctttgcagggacatggatgaaactggaaaccgtcattctcagcaaactaacacaggaacagaaagccaaacaccacatgttctcactcataagtaggagctgaacaacaagaacacacggacacagggagaggaacatcacacactagagcctgttgggggtgtaaggggctaggggagggatagcattaggagaaatacctaatgtagatgatggactgatgggtgcagcaaaccaccatggcaagtgtatacctatgcaacaaacctgcgcattctgcacgtgtatcccagaacttaaagtatgataaaaataattaaataagtagagtttgatcagtagtgggagtggagagtggacctcagagagccctgagcagccccacttctgccgctggtctagttaccatcactcccggggaggagccacagctgctgcagcaggacccagtcaccatcaccgcacccatcagcagggcagagacccagcacccacctgccacccctcccccaccattctcgcacccccgcccctgccactcagcttcaccgacaccaagcccagcaatatggggagcggtgcaaggactggtgagatttttaagaatttcatttttaatttgtactaaaagcttacaaattggtgatttttttcaaaaaagtcagcaaactgcaagcacctgttaataaaggtcttaataaattatcaaataaataaataaaatggaaaaaagaaaggaacattcttcagtgaagtagacagcataaacaaaaagaaatcacaacttctggaaatcaaagacacagagaaatgcaaactgcacttgaaagtctcagcaagagaatcaaataagtagaagaaagaacttcagagctcaaagacaagccttttgaattaacccaatccaacaaaaacaaggaaaaatgaattaaaaaaaatgaacaaggccttcaagaagtttgggactacgttaaacatccaaacctaagaataattggtttattcagaagagaaatataaaagtttggaaaacatctttgagggtataattgaggaaaactttcccagccttgatagagatctagacatccaaatacaagaagctcaaagaacacctgggaaattcattgcaaaaagatcatcacctaggcacatagtcatcaggttatctaaagtcaagacaaaggaagaatcttaagagctatgaggcaaaagcatcaggtaacctataaaggaaaacctatcagattaacagcagatttctcagcagaaactctatgagctagaagggacctgggtcctatctttagcctccttgagcaaaacaataattagccaaaaattttgtatccagtgaaactaaacttcataaatgaaggaaagatacagtcttttcccagtaaacaaatgctgagagaatttcccactacctagccctcactacaagaactgccaaaaggagcatgaaatcttaaaacaaatcctcaaaatagaacctctttaaagtgtaaatctcacaagagttatataacaataacacagtagaaaaaaaacccaagttattcagacaacaaacagcacaatgaatagaatagtaccacacatctcaatactagcattgaatgtaaatgccctaaatgttccacttaagatacagaatggcagaatggataagaattcagcaaacaagtttctgctgtcttaaggagactcacctaacacataaggactcacataaactttaggtaaagtggtggaaaaaagatattccacacaaatgaacaccaaaagtgagcaggagtagctattcttatatcagacaaaacaaactttaaagcaaaagcagtttaaaaagacaaagagggacattatataatgatataagaaatagtccaacaggaaaatatcacaattctaaatatatatgcacctaacactggagctcccaaatttataaagcaattactactagacctaggaaatgagatatatggcaacacaataatagtggaggactttaatactccaccgtcagcactagacaggtcatcaagacagaaactcaacaaatgaacaatggacttaaactatagcctacaacaaatggacttaacagaaatttacagaacattctacccaacaattgcagaatatacatgctattcaccagcacatggaacattctacattctccaagataaaccatatgatagaccacaaagcaagtcacagtaaatttaagaaaactaaaattatattaagtattctctgagaccacagtcgaatacaattggaaatcaactccagaagaaaccctcagaatcatgcaaatacatggaaattaaataacctgctcctgaatgattcttgggtccacaataaaatccagatgaaaatttaaaaaaatttgaactgaatgataatactgacacaacctatcaaaacctctagaatacagcaaaggtgatgctaaaaggaaagttcatagcattaaatgcctacatcaaaaagtctgaaagagcacaaatagacaatctaaggtcacacatcacagaactagagaaacaagaacaatacaaacccaaacccaacagtagaaaagaaataacaaagattggagcagagctacgaaattgaaacaaacaacaacaacaaaaaagataaatgaaacaaaatctcgttctttgaaaggataaataaaattgatagattattagtgagattaaccaagaaaagaatagagaagattcaaataaactgaattaaaaatgaaatgggagatattacaactgatacacagaaatacaaaagattattcagggctactgtgagtgcctttaaacacataaactggaaaacctagagaagatgaataaattcctggaaatatacaaccctcctagattaaaccaggaagatatacaatctctgaatataccaataaaaagcagtgagattgaaatgataatttaaaaattgacaaaaactgtatgtgaccagatggattcacagctgaattgtatcagacttcacagaaggattggtaccaatgctatgacactattccaaaagatagagaaagagggaatcctacctaaatcgttttatgaagccagtatcaccctaatacctaaaccagtgaaggatgtaacaaaaaaagaaaacttcagaccaatatcactgatcaatgcaaaatcaatgcaaaaatcctcaaaaaattatgacaaatccaacagcatatcaaaaagataatccactgtgatcaagtgggtttcataccagggatgcaggaatggattaacatctgcaagtcaacaaatgtgatacactacataaatagaattaaaaacaaaaatcacatgatcatctcaatagtcacagaaaagcgtttgacaaaatccagcatccacttatgattaaaaccctcagcaaaattggccatagcaaaataggacatataataaggtaataaaagccatctatgacaaacccacagccaacattatactgaacggggaaaagttgaaagcattcccctaagaactgaaacataataaggatgcccattttaaccacttctattcaacatagtactggcagtcctagccagagcaatcagacaagagaaagaaataaagggcatccaaattggtaaagaggaagtgaaactttgctgtttgctgatgatatgattgtatacctagaaaatcctaaagacttgtacaaaaagctcctacaaagggtaaataaattcagcaaatttcaggatacaaaattaatgtacgcgaatcagtagctcttctacacaccaacagcaaccaagctaggaatcaaatcaagaactcaacccctttcacaatagctgcaaaaaagtaaaaatacataggaatatatctaaacaaggacgtgaaagaacaacaacaaaacactgctgaaagaaaacatagatgacacacacaaattgaaacacatcccatgctcatgatgaggagagtcaatattgtgaaaatgaccatactgccaaaagcaatctatagattgaatgtaatttccatcaaaataccaccatcgttctccacagaactagaaaaaacaaccctaaaattcatatggaaccaaaaaagagcccacataaccaaagcaggactaagcaaaaagaacaaatctggagggatcacattacctgacttcaaactatactataaggccatagtcatcaaaacagcatggtacttgtatgaaaaagggacagagactaatggaacaaaatagataacccagaaataaagccaaatacttacagccaattgctcttcaacaaagcaaacaaaagcatgtagtggggaaaggacactccattcaacaaatcgtgctgagataattggcaagccacatgcagaagaatgaaactggatcctcacctttcaccttatacaaaaatcaactcaagatagatcaaagacttaaatccaagatctgaaaccagaaagattctagaagataacatcggaaaaacccttgtagacattgacttagacaaagacttcatgaccgggaactcaaaagcaaatacaacaaaaacaaagataaacagatgggacttaattgactaaaaaccttctgcacagcaaaagaaataatcagcaaagtaaaccgacaacccacagagtgggagaaaatcttcacaatctatatatccaacaaagactaatatccagaatctacaaaaaactcaaatcatcaagaaaagaaacaatcccatctaagagtgggctaaggacatgaacagacaattctctaaaaaagatatacaaatggccgacaagcatatggaaaaatgctcaatatcactaatcatcagagaaatgcaaatcaaaaccacaactcaataccacctgcctcctgcaagagtggtcataatgaaaaaaatcaaaaaaataatagatgttgttgtggatgtagtgaaaggggaacacttttatactgtcggtgggaatgcaaactagtacaaccactagggcaaacagtgtggagattccttaaagaactagaagtagatctgctgttcgatccagtaattccacttctaggtatctacacagaggaaaaaagttattatatgaaaaagatacttgcacatgtttatagcagcactatttgcatatttgcaattgcaaaaaaatattagatcagcccaaatgcccatcaatcaacgagtagataaagaaaatgtggtactgtggtatacatatatcccaggggataacactcagccataaaaaggagcaaaataatgacattcacagcaacctggatggaattggagactattttttaagtaaagtaactcagcaataaaaaaccaagcatcatatgttctcactcatatgtgggagctaagctatgaggctgcaaagggataagactaatacatcagattttgaggactcaggggaaagggtggtgggtggtgagggataaaagactacacactgggtacagtgtacactgcttgggtgatgggtgcaccaaaatctcagaaatcactgctaaggaacttattcaggtaaccaaacaccacctgttccccaaaaacctattaaaaaaattttttttagaacaaagaaaaaccaacaacatatttggatatttatatttcaggtgggtttcttatagacagcatatagttgagtcttggtttttaatcttaacagtctcctattttcagttgaaatttttaggccatttctatgtaatgtgaatattgatacggttgctgtttgctttctatttgtcccattcttttctttgttcctggtttcctctttttgactgctcttgaattaattttgtttaatgattccaatttatctcaattttagcttataaacgataaccttttcagtattatttagtgattgcttaggatttatagtacacgtacatatttttcttatttttatttatacataacagatgcacatgttttcagggtacatgtgataatttgatacattcatataatgtataaagatcaaattagggtgtttgggatatacataaccttaaatgtatatatgtacatatacatacacacatataaccttaaatttaaatgtatatagagagacagaaccttaaatatatatatatttgttaaatatatttgtataaataaataatttgttatatatatttatatataaatatgtatttgttatatatatatttaaggttgtgtgtgtatacatatatatgtttaaggctgtatggccatatatgtgtgtgtgtgtatctatatatatatatatttgaggttatgtatattccaattaccctaatttcatctttataatctttaaatatattttataatctttaaaatgtatattaatttgtaaatctaattataaatctttataatttgatctttaacatatacatatattttaatgctaggaacacttgaatcattcttttctagataatttgaatgtacaatagattaatgttaactatagtcaccttagtgaactatcgaacattaggtcttagatcttttatctaactgtatatttgtctttttaatcaaccctcctccacctccccttctcagcctctggtaaccaccaatcttctctctctcttcatgaggagatctatcactttagctcacacatatatgtaagaacaggcaatatttgtctttctgtgcttgacttatttcacctagcgtaacaactcccagtttcatccatgttacttcaaatgacaggattttattctcttttatagttgaataatattccattgtgtaaatattgcagatttgctttatccattcatccattgatggacacttaagttgattccctttttttggctgttgtgaatggtgcttcaaaatacgtgactacaggtatctctttgatagattgatttcctttcttttaaatatatacctactagtggaattgctagatcatacggtaattctatttttaagtttctgaagaaactccctgctgttttccataatggctgtactaataatttacattcccaccaacagtgtaccaggtttccccttcctcaacatctttgtcagcatctgttacttccagtctttttcataaaagcattctaactggggtgagataatacatcactgtggttttgatttgcattttttatgatcagtgatgttgagcttttttttatatatacctcttggtcatttgtatgtcttctttgagaaatgttttagattttttgcccatttttaataagatattttgtggggtctttttgggtgtttgtttgtttgctattgagttttctgagctccttgtgtgttctggttattcatcccttgtcaggtggttactctgtaaatatcttctcctattctgtgggttggttcttcactttgttgattttttcctttggtgtatagaagctttttagcttgatgtgatcccatttgtttatttttgcttttgttgcctgtgcttttgagattttacacaaaatatctttgtccagaaaaatatactagaacatttccctaacgttttcttttagtagtttcatagtttcaggtttagatttaaaacttagatatgatttttaatacattttgattttttatgtggtgagagatagggatctaattccatttttctgcttatggttattcagcttttgaagcaccattttttgaagagactgtcttttccttattgtatgttctaggtaccattgagttgggtataaatgtatggatttatatccagtttccttattctgttccattggtctatgtatctgtttttatgccagtaccatacagattaactatagctgtcttgtatattttaaagttaggtagtatgatgcctgcagctttgttctttttgttcaggattgctttgactattctgggtcttttgcggttccatataattgttttttctattccttttctttgttttctttttgagacagactctcactctgtcactcaggctggagtgcagtggtgccatctcggctcattgcaacctctgcctcctgtgttcaagcaatgctcatgcctcagcctcccagtgtagctgggattacaagcatgcaccaccatgcctggctaatttttgtaattttagtagagtcagggttttatcatgttggccaggctgctctcaaactcctggccccatgcaatcttcccacctctgcctcccaaatgctgggattacaggtgtgagccactgtgctcagcctgttttttctatttctgtgaagaatatccttggtattttgatagagattacattaaatctgtaaattgctttgagtagtattgtaattttagcaatattcagtcttccaatccatgagcttggaatattttttaaatgttttatatcctcttcaatttcttttatcaatgttttaaacgtttccttgtattgatcttttactatttctttggttaaactgtttcctaggtattttatattctttgtagatattgtaaacgggattgctttcttgatttgtttttcagattgctttttgttggcgtatagaaatgctacatttgtatgctggtttttatatgttggtttttgtatcctgcgactttactgaatttgtttattgattccaatgactattttgcagagtctttatgttttccaaatataagattaagtcatctgcgcataaagccaatttgacttcttttgtcctaatttggatgccctttatctctttctcttgcctaattggtcttgccaggactttcagtattgtgttgaaaaaaagtgaaagttttgataatatgatgtatgtcatttattgacttgcatatattagacaattttgcattcttgggatgaatctcacttgacttatttcacctggcatgaatatcatggtgaattatctttttaacatgctgttgaattcagtttgctattatttcattgaggattttgcatttattttcaccagtaatattgacctgtagctttctttttttgtggtgtgtttttctggttttggtatctcagtaatcctggccttataaaataagtttagaagtattccgtcatcttcaatttgtttaaagactttgactagaattggttctgtgtttaatgttcggtagaacatcaggtcctaggctcttctttgatgagagactttttattatgacttcaatcttgttactcattattggtttattgaggtttcctattccttcatggttcaatcttggtaggttatatgtgtcaagaaatgtattcatatcttccaggttttccagtttattggtgtatagttgttcatatgtctctaacgattctttgtatttctgtagttagttgttatgtctcctttttcatttctaattttacttaattgggtctactcttttaatcttagtatagttataggtttgttgattttgtttatcttttccaaaaaccaacttttcgttttatcgacctgttttactttttgtctcaatttcactatttttctgctccaatttttattacttctttccatgtactaatttaggttttggtttattattgctttgtcagttccttaagagccatcattagcttgtttatctgaagtcttcacacctctttgataaagtcatttatggccataaacttctatcatttgttgtatcccatagatttttgtatgttgcatctccatttccatgtggttcaagaatttttataatatcctttttaatttctttatgacccattgatcatttaggaacatactgttgactttttatgtgtttctgcagtttctgaagttcctcttgttattgatttctagtttgagtccactgtggtcagaaaagacacttgttcagatttatgctcttaaatgttttgagtcttgttttgaggcctgatacatggtctatcctggagaatgttccatgtacttatgaaaagaatgtatattctgatacagttgggtgaaatgttatgggtctagtgtgtagtttaactcagatgattatttgttgacttttttgtccactactgaaagtagggtgttgatgtcccctactcttactatactgaagcctgtctttgcttaacattagacttactaatgtttactttgtacacacggatgctcctgtgtggggtgcatagatgtctatacgagtatatcctctatctgaattgatccctttatctttatattctgactttctttgtctctttttacagcattttacttgtagtctattttatcagttgtaagtatagatatttctgctatttttggtttccactttcacagaatggcttcttctatctcttcactttcagtctgtgtgtgtgtttatagtaaggtaggtttcttctagatagtatttagttgtctttgttttctatccagttaatcactctgtgtatttttattagagaattatctccacttatattcagtgttattattgatgaataaaggcttattattgctattttgttgcttattttctggctgttttataactcatttttttcttttcttcctttttttacggtcttcctttgtggttaagtgtttttctctggtagcgtgttttaatttgttgctttttattttaaatctgttttaaatttgttgctttttgttttctcagtttacatattttatattgcctatctcttaatggttgctgtaattattactgttttcgatagattagttttttcatcttcatagtagagttacaagtggattgctcatcacaattacaatattagagtattctaggtttgtctgtgtacttaattttaccagtggatttctacctgtattttttatttctttttgcacattagcgtttttttttttctttcagtctgaagaactccctttggcttttaagacaggtctaatagtggtatattttctcagcttttgttatctaggaaaaactttatttctcactcatatttgaaaaatagctttgctggatacagtattcctagatggcatttttttctttcagtgttggttcttataggatatgtttgcttagagattatttgtaatttttgaattttttcatttttatcatcttgggattctggatattttagtattaatatgaatattatttcagttctgagatacaattaaaattatttgcaaaccagtttgatctctttgcatcttgcttttaagttttgtttagcagatcacagaagtgcttagtttcagtctaatttttccccaatatggacacaaaatgttatgaggactccactcaatgacctgtgaattatgaggcatggttctttccttaactcaggtagttttgtcgggtaaagactcaaagggatcctcttcagatctctggagtgctctgcctatgcagtctttccatttccagtactctgccctataaactcatgctgctttcactttccaggactttcaacaatgaatttcttcaactcagagatacctcaggatcctacctaatatgttgtctcttcaccatgtcctagggaatctctagccagtaagatcaggcaaacttgagcctcaactaattttttttttttttatttctcagagcagtatccttcattggctgatattcaatgtcttaagaattgatgtttgatacattttatttggtttcttactttggttttcattttgctttttattttagttgttttaggcataatggtaagcccagtctctattaatcttgtcctgaagtggatgcttgaaaaatcactggaattgtgtatcaatcttaaactacattttgtctcctagagcagagtttacttatggttattcatttttcaattatgagactcgatttgtcatgtaaggagtgattttcttttttcccaacttttattttaagttcggggtatgtgtacagaatgtgtacgtttgttagttaaatgtgtgccatggtggtttgctgcatagatcatccgatcacctaggtattaagcccaggattcattagctatttttcctgattctttctctcctcccactcctcaccttcaaacaggccccaatgtgtgttgttccccaccatgtgtccatgtgttctcatcattcagttcccacttataagtgagaacatgcagtatttggttttctgttcctgcatcagtttgcatgctggtgaggttgtggagaaaaaggaatgctttgacactgttggtgggagtgtaaattagttcaaaaattggggaaaacagtgtggcagttcctcaaagtgaagacctagaggcagaaatactatttgacccattactgggtatatacccatagaatgtaaggaattattttctaatggttaatctgattactattttaggatgtagccacacaattctgggaatttcatttttattgaaaaccttttgacatgtagtccctaaactggaagttccttttgcacaaagaatttgacacccttctcagacatttttttcttgagagctgtctaagcaccatgcaagaggcttattatatactcaaaagtcacaatatgcctcataattttttttcctcaggaaaaatatttttcaaggtatcagtcttagaagagtcattcagggagaatgatttcctctgtcaattcaatgtatattgaaaagaaaaaaaagagtgtgatataacttgagaagacacaaagtgtaggcaacatttatgtggcaacatggcactgactattcaatctttattgatagctaatgagttttaccggatgtctacttggcttatcatagattattagagttggcttggtttattgtgtccaatcaggatggatttgcaatctaattaatttgttcctcacccctgttgaccttcaagggaataaacagaaggaaattcctagatcattgaatcactgctttcaccactacagagtcattcttctgcatgcagattgaatattaaaaaataaacagcttcacaggtgtttatttagggtgctgtgaaagaaaccaagagaagagctaaggaatttttctgtttatccttttctccaataatttcatggacaggtaaatctttaaaacacctctcaaaaacaccttaatttttttttaaaataatgtgacgaagcagcttttagttatttagcatttctaatcttgcaatctgacttagtggaaaatcactttgttttcttcatctcaggtttcaaaccaaaaatatagccataatgtgttctgcttttgtatagactgcataagataatatttataaaaatcactgtgaaacacagaccactcatcctatatataatatactacgacaataataggtgttgttgctgaattattctattttcaatgtttactatgatggttgaacacaaagcttgagcctattacgtataatttttttataaaatactctaaaagaagaatcaatacatgagaaaaaaattaaactttgacttcaacatagtctgtatggcagtgaggataaaatggctaaaagaaaaaacaagcaatatttgctaacaatagaagaaaatatcctggaatccattttttttcctagcaatagagggtaactctagaagttttttttttcttaccaaaatgccaagaatatacagcagagcaaaaagcatgcaaagcacagaagctgctttcagagtatgtcacagcagctgcattttgaaaagagttgaagaagtaaaaaacctgaaattttagtattacccatctctatatagttatgagttaatcataattctcttaagactgtaacttgaactattatacagagagatttaaaagtctttgaaaataaatatttgcgaacagtgtgattcagaatacaaagaaagatatttattttcctttagcaataatcaactgagtgttaatagtccttggagaggcagaacatttacaaattccttcatagaatattttaaaaataataaaagcaagttccatctacacttagaatataggttcattggccgggtgtggtggctcactcctgtaatcccagcactttgggaggccgaggtgggtggatcacctgaggtcaggagtttgagaccagcctggccaacatggcgaaacccggtatctactgaaaaaaaaaacaaaaattagctgagtgcagtggcaggcgcctgtaatcccagctactcgggaggctgaggcaggaggatcacttaaacacgggaggcagaggttgcaatgagctgagatcgcgccattgtactccagcctgggagacagagcaagactccgtcaaaaaaaaaaaaaaaagaagaagaagaagaagaagaatataggttcattgttaggtagactttataaacgttttttatccctttgctctctgttttaatcataagaattagtgatcctactcctttccacagtgactccttgcacttctctcttgaatataacagtcagtccttgcagggcacttacccagcagtcaggtgatctgttcttcacgagttttatttcacttgaacctctcaataacactgaggtattgatagtactattatctccccatttggcagacttgacactgaggccaacagaggctaagtaatgacttggttcatgcagttgaatagtgggagagtgaggattaaaccacaaaccctgtggttataaacacgatgagataacgctttgttatataaaccgagcctctcactctgtgacctttctcagaccctactccatccataattgttctctccactctcctgaccttctgtcactctctgtccctttgctttctccatctttagtggctccttttgctcagccatatattaaagcttttatgtttttcaaaactgcagtaataccatcgttcttaccctccagctccaactccttcctctgtgccaaggtcctcacagcaatggtcacttggcctccatttccactcttctcatttattttatctcacccaccatgaaactgaaagtgtactcttaaaatagagtaataaatttctgatttctagttttatttcagttcacattctactctaattgtatacaaaatttggcaatttttaccgcaatatcttccctccttttttttttttttatttttagagatacggtgttgttctattgcccagactgtagtgcaatggctcaatcatagctctctgcagcctcaaactcctgggctgaagggatcctcccacctcaactttccaaagtgctgagactacatgcgtgagccactgtgcctgtccaatatctttctttttctttttctttttctttttttttttttttttttttttgagacggagtcttgctctgtcaccaggctgtagtgcagtggtgcaatcttggcttactgaaacctctgtctcccaggttcaaggaattcttctgcctcagcctccagaatagctgggactacaggcatgtaccaccaagcccagctaatttttgtattttaatagagacggggtttcaccatgttggccaggatggtcttgatcttttgacctcgtgatctgcctgcctcagcctcccagagtgctgggattacaggtgtgagccactgctcccggcctggccaatatctttctctaaagtctcttcttcctttcctttttactcctgattttctttctatgtcagttcatttatttttattttttgtcctctctctccccttaagtgtttatgttttaagatttctgaccttttttctctcttctctccttgatctatcaagaatcattaatccacaaacaagaagagtcctaaatttctatctctagccctgactctcacctcagcatgggattcgtattacaaacagtacagtggacatcagcacctaaatgctatgtgggcttctcaaatatttccaaaaccaaacacatgatctcccactgccctcagaaatgtccctttcttcttcattttctatgtatatgagaatgaccattcagttatctaagcataaaactcaagacccttctcagttagttaaaatatttaaagtgtttagaaaagaccctgcacattataaacactcaataattcttagttaacactaaaattgcctttactagttaacagtactatttgccattgacttctcactcttcctcacttactatatccaactgaactcccgtcatgacaattcaatccctactaagtctctggacttttgatttctccttcctttttcactgccactgctttagttctttcaggctgtccattttcaaacaccagagctggtctccctgacttcagattctaaccattcccattacattttctcactgcctacagagttatcttgctaaaactcaagtggggtcaggcactctctgtgataagttcatgtaattgtaccacgtaaggcctttcccaatctaaacacaagctaccctgccagtcatgccacttggcatttagccgatgacaccttccatgctgtgctccagttagaactgcttctcaaccctaagactgaccatgccccgacatattatactctttttatacctatgctctatgccttctctttctgcctggaaaactcctacttcaatcttaaatcctattaaaacttttaactgttaatcttgattttaaacattactctttccctacctagctccctgtacacttccatccctaccccagtcaggcagaacagggtactgtctcctcagggtttctattttgtaaatttgtagaagcccatttttataacacaaaatcttaaataattgtttccacaatatcatatttttacaatattatgtttattgtccagtaattatgtaatagctaatcataactccaacgtatcttgaaggaggagcttcaggtttgtttatatttttattttcagaacgattcttatatttgacacacaacaaattcctaaaaactgcttgtaaagtgaatgaagtaaaacaattcttacatttcactttctcagccaacctactctttgattataattatggtagatactgcttttataacccacttcattcctcacatcctttacatttataccccaaatataaattggtaggaattctctaaaccattcagtgtctcattttccttacctgtaaaatgctgaaactactttataaggttgtcatgggatttataccatttatatacaaaaaacaattagaatataacaggtatctgattagcatctaatacaattaactattactatgattactcttgtattcgaatgttcctttttcctctgatacatttgtgtgcaatgctccctatgtttggatgataatgttttcttagttttcccacataaaagggagagatcagtgaatccctttataagataaaagacatatgtaattatattagtctattctcacagtgctataaagaaatacctgagactgggtaatttataaaggagagaggtttaattgacccacagttctgcatggctgggaggcctcaggagacttacaatcatggcagaaggcaaaggagaagcaggcaccttcctcacagggtggcaggacagagtaagtgcaaagagaggaaatgccagacccttgtaaaatcatcagatctcatgagactcactcactatcacgaggacagcatgggcaaaactgccccatgatccaattacctccgccttgtcctgtccttgacgtgtggggattatggggattacaattcaaggtgagattttgggtggggtcacagccaaaccgtatcaataattaagccctaaaatgctctttggttagaaatgatgagatttgttcttagggtagtaagaattattcttatgttattattttgttattataagagcaagaatttttagtccaattattacagtctccttttaaacaaacactttataagtggcttttgattatcgcaccattgtaaagggataccaaaggaaacctgaggataaggagtgagatgcttgctcttattttcacactggcagctaaacagacaaactactttctgctttttaagtgctcgccagttaaagctgcatgtgagcactattggtttttatttgtttgtttgttttacttcactgtttttttcaaagtactttatgctcattaacctattttctatgtggatattccaattaaatattagaacaaaaagttgtttacttttaagtttcttttaggagaatgaaagaaactcccaaatttctgcattagaatcgaattaaaatatagaaaagaaatttatctgtgagttcccccagctctgcaagatacgaatcatctctcatcactcactttttcaggcctcaggatcaaactagtgccagaggaggaccaggtgactttttttctgagggagagaagtaatgggagccattgtcattcctctcactttttaaatggattgagctgccatgggagctatttgtcaacaaaaacagaccagaactcattagttaaatacagatcatgtgagattcagggagcagcatatggaggggtataatgacaaacttaaaaacagccatttggttacaaattgtcttaatattaatagttacattctaccatttagttactacttcctaaatactgctatttacccataatacgtaataaaaaactaaaagatcgtgaaaggaggagagaaacaacgaatatactaaagttgttatggaaaatcttcgtagacttacagatattacacacatatgcatgtggcaaaaatactttttttcctttctgtccacattgtttcaaaactttcaggtgaatttttaattcattcattcatatttttttcttctatttacaaaacaaacatacattttgcagccattaagttccagggcctccggcaggcaaaagaaactaaaggccaataaaattgtcctcgagaagcttgtatttcttatgcagtgattttcaaagcatgttccttagagcaactacatgagacgtaccatgggaatttgttaataatgcaggcacctggattgactccaaattataatttccgtgcatgagcttccaaagtctttatgtttaacaagcaacctagttaattcttttgcttttaaaaaatttgcacactgatctaactgctttgctccactaagtgtggtctgagaaaggacaacggtatctacatttctcattccaattatatccaaattagagtcttttaacttgtcatccagtggttcacatgtacttcaaagtctaaagagtaataatctagtctatatgatttctggagccaaccatataatgatattatgtggaatggttggtgtgtgctgtgggagacacacctaaaaagttctccagaacttgaatcctaccatcacatattattctatttttaacatttctcaggtgaatctgtttcaactactatattttacttgggtttcttatttttgtttgtttatttctattggcactgaaaatttaagggatagtgatatgtagtttaagatgggttatcgtctggatatttgcctggtggaggggcatatgaacaatgaatatgaattgatacaaatacaccacaagtcagagttagcacaacatatcttcattcatccacttctttattttactcagcaaatatttatttatttattattttatttatttatttatttatttattttttgagatggagtctcgctctgttgcccaggctggagtgcagtggcgccatcttggctcattgcaagctccgcctcccgggttcacgccattctcctgcctcagcctccagagtagctgggactacaggcgcccgccaccacgcccggctaatgttttttttaacagatttttggtagagaaggggtttcaacgtgttagccagtatggtctctatctcctgacctcgtgatccgcccacctctacctcccaaagtgctggaattacaagcatgagccactgcacccagcctcagcacatatttattaggcttcttctttgagccagggatttagatagtatttaaaataataataaaagcaaatatttactaaccacttttactacgtattgatgagtctccttaattgtcacataagttactgcatttaactgtcacaaccctgtaatggagggacagtgattactctcgctttacaagtaaggaagctgaagcccagagaggtagaataacttgctcagagtcaccgagctagaatggattttattgggaacttaaatacgtatctctttcatcagagcccttccttttaacctctatgctatcctaatgctcagatttctgggactcagatcaccgaagcccttaatcaaacaaacctgtgaaaaatttatggtgaaaatattacatatgaggcaaacaggagggtcaatggaagtatggaaggaagcaagaattcacgaggagacagagaaggccagaagatgcttccagggcacatggacagagaaggacagtggtatcctagccttatggagcagaatgcacaacggcagaaagcatgagagaacacactgggtgtagggaacttaacatttcttggttttgctggagggtgagttttgagacaggggagaaattggaaatgatggacagaaagtaaaggatcagatattgaagagaatgatatgtcctgctaagtatctgacatttctcttataggtgatacaagtctattgaataattttgaactgataaattattatattttgcttcagataaattaattgtcaaacatagtgaaatcttttaaataacaataactccaaatggtttgttactgcaaattgtagtcttctgagggaacatataaaagaaacagctgtgtttctgagagagtttgtaggcattctgaccccaaggaaagggtaagcatgacatgttttcttataccagaggtcaagaccttcccagtggtttgtttttgacctggaaaattttgtgtgcacatttttttccctcagtcagtgacattattcttgcagagcaggtgcattcgaaaaattattttgtgttaatcttttataagcatgaatgatttttaagccatcatttaaaaaattattcctaggttttttggtagttttgggttctaaagactgcatattgttaggcacaataattaattgtgacgcactctacccacaaagaaatgtatacacccatcagcaagtctccattgggccatcaagtcgtctgcctgcctcagcctcccaaagtgctgggattacaggggtgaaacaccacacccagcagcctcaggaaactttcagtcacggcagaaggcgacaggagagcaagctcaccttacatggcccatacaggaggaagactaagggaaaaaaatgtgcacacaaaattttccaggtcaaaaacaaaccactgggaaggtcttgaccgctagtataagaagtaattttactagaagtaatgctttaataacaacaccaactccaagtactcaacaacatgatacttataaacctttacctgattaagccatccaattagccgttcaaagactgtgtaaatacagacatagatgatgtctgggggattacaatttgacatgagatttgggcagggacacaggtccaaaccatatcaccaggtgatcacagaaaaccaaaaaagagtaggaatatttaatgtagacatggtcatctgtgggtaaagtccttcttcatatcctatttatttaaccctcctcagagttagcagggttagtcacacactcatatgtacctttttctagaaaaaaataaatatttctaaaagtttgaattaagtgaactaaattatagttgactaatttttaaaaatagagtaaacagtcacaatttggagcacaaaccaagaggaaagaagaaggactttacccacagctgaccatgtctgcattaaacattcctactcttttttggttttctgtgatcacctggtgatatggtttgggcctgtatccctgcccaaatctcatgtcaaattgtaatccccagcattggaggtggggcctggtgggaggtgactggatcttgggggtggatttccccctcagtgttgctcttgtaacagtgagtgtgtgccgtgagatttggttgtttaaaagtgtgtaacacctctcccctcactctcttcctcctgtatgggccatgtaagatgagcttgctctcctgtcgccttctgccatgattgaaagtttcctgaggctgccgggtgtggtgtttcacccctgtaatcccagcactttgggaggctgaggcaggcagatgacttgaggtcacaagtttgagaccagcctggccaacatgatgaagctccgtctctactaaaaatacaaaaattagccgggcattgtggtgggtgcctgtcatcccagctactcaggaggctgaggcaggagaatcacttgaacccgggaagcagaggttgcagtgagccgagatcaggccactgcactccagcctgggcgacagagcctagctcaaaacaaaaaaaaaaaaaaaaaaaaagttttcctgagttctccccagccatgcttcctgtacatcctgcagaaccatgagccaatcaaatctcttttctttataaattacccagtctcgggtatgtctttatagcaatgccagaatgaactaatacacctggcgaatggaattaagttacacgatgatgcaatttaactaaatttcaagggatacgaaccctgctcacattgatacgatttctggtatctactacttgtagcatatgaaacaaataatcattggcttcttactctgtggttagcctggcattaacccaggagaggagggttctttgtcattctccctaactatgagatattgcttatgaggtagcataaagcagagatctccagcttagtgattttttttatgacccaaatcaggataccaacttaagcatttcagctcttatgcattaacaatctgtattctatgtacatttttcatagtaacagcaattttgtggtgtttccttattcttcccttttgtatcacagtggagcccattcactctgtttttccacacagtatatctttctaggtcacacccttgctgcctcaagaattttaacaagagttataaatctgcagtgtccagatacctggaaatctcttgctgaccttatccttcatcattttagcatgagaatttggtatgactttgagtaatgttgtgatttaagaaagcatattacagaaataggtggtgccctttgtaacacaacaaaaatgccatgagcccacaggtcctctgtcaataggccattctgttggttgttggttttccagctgtagagatgtcattaagatgcttctacttccttttctcaaattaaactgtttttctatcttatcttttttttttttttttttttttgcaataagtaacctgtgttttattggaaagaacataggaaatcaataaaatttaggtttgaattcaagctttggcacctacctgctaagtgattctcggattcccaatctgtaaaatggataaaacaaagccagtttcaaaagattgctatacattttaaattatgcaatacaagtaaaatgctaacattttatctgccatagagttggtcctcataaatatctagtgtcattgctattgtaattattttttttttgacagggcctcactgtgttgcccaggctagggtgcagtggtgtgatcttggctcactgcaacttctgcctcacgggttcaagtgagtttcgtgccacagcctcccaagtagttggggtttcaggcacccaccaccactgctggctattttttgtattttgagtaaagacaggttttgccatgttggcgaggctgatctcaaacttctggcctcaagtgctccacccgcctcagcctcccaaattgctgggattacaggcgtgagccaccacacttggcctaatattttgaacacattttactcttggctattgatgcacggagtgttagagctgaaatagttcttaattttggtctctcctactgtagatcaggaaggcaagagatagagaggacaaatgagctattcaaagagcagagggtcacaaatagaactagcgttctcctcaagccatcttgatccatcagtttcaattcatgctataatctattgtatagtatctgctctatgttgatatttccttactggtagcagtattcctcttcccacctcatagtgtatacttgtatatcattttgaagttgcagctaataatcaaggactctgtctaatgtttcatgtgaaacccttggacttcatgatattttgaatgttaaataatttcatcattttaatagtttatctcagcaatggcgtatgcaaaattagctggatgaagagtgttatctgaccaaggccaaaatctgtagcccagagacatagtacattttccctggcccagtggtgctggaatatatttaagcctttacagcaaactaaaacaattcatttaaggaattatgagagccaaactatttttttagagcctctgactgatacttcatgtgctaatagagaaaaatattatgatgtcaatgtttttctctttaaaatataatgtaatgtggcatgactgatatagccaatcttgaatattagaaatgatgcatcatcacctaattcatcaaaatcaatctcgaaaaggtcagtcttacttgaaaaataagttgattggccttaaatgaacatactacgatctcaaaattagagagagacctcatggttttgctaagttgttttttcaaagtaccctcatcacaaaatttaggcatgcaaatgtcaacaatttgtgtagttacgcatttaaaaagtcttcttcaatggaaacacacaaagtttcataactttcagtggctgatgcctaccgtaaataactaccacagattacatagtaaactcttcattactcagggattgaccagtcagttggtaaattaactgcgttctagattttttaattctctctcctcattgcatgtctgctggttacatcagtactcactagcaagtcaaacatcatgaaggaaaaaagctaaagaatatcccattgattttaaaaattatggagaaaacgtttaaaaattggctttcatttgaaactttgagtctctgtacacataatatatcaaagctccttctctttactatttatacaaggcactgtcttgcggtcagttatatattttaacaggtgaagagcagaggcagtaattttttaaaaaatttttctaatttttaatttgtataggtatatagtaggtatatatatttatggggtacatgagatattttgatacaggcatgcaatgtgtaatcatcacatcagggtaaatgagataatcattgcctcaagtatttatcctttctttgtgttacagacattcaattatactcttttagttatttttaaatgtatactacatttttgttgactgtaatcactctgtgtattaggccgtcctcacactgctataaacaaatacctgagactgagtaatttataaataaaagagctgtaattgactcacgcttctgcaggctgtacaggaagcatagcatcttctggggaggtctcaggaaacttacaatcattgtagaaggtgaaggggaagtaagatgcctcacatggccagagaaggagaaacagagagagaagggagaggtgccacacacttttaaaagaccagatctttttttttaattttattattattatactttaagttttagggtacatgtgcacaatgtgcgggtttgttacatatgtatacatgtgccatgttggtgtgctgcacccactaactcgtcatttaacattaggtatatcacctaatgctaaccagatcttacaagagctctatcatgagaaaagcactggaaggatggtgctaaacaattagaaactgcccccatgattcaatcacctcccacctggtgccccacctccagcattggggattacatttcaacatgagattttggggagaacacagatccaaaccatatcaacctgttatactatcaaatattagatcttattcattctatctaattatatttaggtactcgttaaccattctcagtttcccctgcatctctcactaccactacccttcccaatgtctgataactatcattctattctctatctccataggttcaattgttttaatttttagatcccacaaataagtgacagcatgcagtttgcctttctattcccagcttatttcactcaacacaatgtcctccagttccatctatgttgttgcaaatgacaggatctcattctttttatagatgaatagtactccattgtgtactgtaccagattttctttatccattcatctgttgatggatactttggtagatcccaaatcttggctattgtgaatagtgctgcaataaatacagagtgcagatatctcttcagtatactgatgtcctttcttttgggtacataccgagcaatgggattgctggattatatagtagttctatttttagtttcctgaggaatattctaggataaaaagatttttgttttctttcagcactttaaatatgacatgccattctctcctggactgatatattgatatattgtatatagtctgctgccagatatattggaatgcctttgtgtgttattttttctcttgctacttttaaggttctttctttatttctgacctttgtgagtttgcttattaaatatcttgaggtaatcttatttgggttaaatatcagcgttctataaatttcctgtacttgaatgttgatatctttctctaactttggaaagttctatcttattatttctttgaataaactttctacttctacccagctgaattctgccctgtgttgctttccactgtgaccaggaagcactgagttctaatgcaaagtcccgcaatcactgcactcaccctctctcaagtgcactgattttctttctgtgccatgtggtccagaccaggggacggcggagggatggtatcagtaattcaagactgtctttcctaccctcttccatgcttcttttcttgatattatgttaaaaccaggtattgtaatcactcatccaagttttggttcttctgaaggtgctttcttgtgtgaatagttgttcactttggtgttgctgttgtggagtcgatcactggagggttctatttggccatgttgctctgcagaggcagtaattttgatttatcaattctattagtttataggggttttgtttgattccttttactaatcttatgagtaattttctcaaacttgtgtttgcataagagagccattttgtgtgtgctgaaaggctgtgtgtgtgtgtctgtgtgtgtgtgtgtgtgtgtgtgtgttgcttaatgtcaaatagattcaaactattggtaattttgaattgaccagctgttttcatgtaaaagcaatgataatcaacattttggtgagatagggaggtaacttaagattctagtaattaaccaaggtgtaagcaacttaaaattatttccatctgtaaaattatcatttcaacaaattatattgttttagagcaatgaccatgtcagcaatgacaatgacaatgtagcaatgacaaggacaaagttaattctggttacaaaagaaataattcttgtttagtgaatcaaagatctccactcaaaatcacaccatttgaattcttgcagactttgaagcttaaatagattcttagccttcacaacccctgggcatttttaataagaagcatagtgtgattctctgcttgggtaaggaaataaaacagaaatttttctcgaaagggccataaggtatattacatccaattagtcctatcttgactctgtgaagttgtcccaaataagagtgggtgataactgtttgtaatttccaaccacagaattcaccttagtttgtactttgaatagttaatgcttggcagtagcagcttactttaatataggggacatctggaaaataccttgtaaacgatgaaaccaaaacattcaattgtccaaaaatattatggagtgaagaacacaaccacatataattaacttaaatgtacagaggcattatatttgttaaataatttattaataatattatttttcagttcttttcattctttgcaggaagttattatacatcaattttaattattttagttttatattttctgttgtctcctgtgattatttaaatcagaattaccatttcctaaacataattgcagattgaaacatgtgactatatttcttattttaattttttgttttataagcttcatctggtacatattaaccatgaaccttactctcattcaattcagctcatggtcagataccacaattgaagtagtatcactcctataatatttttaccatttattattgaaagcagttgagaattaatgattttaacagaagtgacgtttgtatacagttccattaaacaattaagataatacttgatccacagaatacattggaaactttataaattagaaatacgctgaataaatagacaactcatgctgagaataaatgttgaataaatcaaacaaatgtttcatcatacttggatccttccaatcagttatctaatttctacaaatgtattttacatttatccttttaagtccatttataatgtcatcgctctttgccaacaatactaaatgttaattaaattttgaatattttaatcactattacattgtgattgaaaaaaacagtgtattcaatctaattttaatgtgtctcaacctcagaaaatatttttctctggtcatattttcatgagtaaaaattatttccaattatattttaaccgtgtctttttcattattttaaacagtaaaattttaatatgtttactcccttcttgttttatgagtctaaatgctgtaaaataacaatagccaatgtgaattacgcaagcattttaaaatgtaaaaaaaagcaccttgatatgaaaagaaatgctcagttgtactctcaagacaagaatttaataataaatactatgcttaatgaagacagtttctaaaattaaaaaaccccaaagtgatacataacacagatattagtaacaaaaagagaggctagattacttcttgctgattctcacctacaccagcctccaataaatttctttcttttgaaactgcttttcacctgcttatctaaatgtgacttctatctctctatccctcagtcctccatttgtcatgaattgttctctcacctactgttcccacagttcactctctgccctgaaaattgtaatagtttctgtgttcataacttagtcttactctccaatgatttctcatattttatgattactgttacattaaatgttttatttccttgaccacattgtaaagtcatggaggactggaagcatgttttatgcttttggattgtccattatattggatacagtgccacggtcaacagcgtattgtatatgtacatttatatgctcccaacatatgtaaccctcttcccatcatcagcttcttttcccttgtttcaatgtttctcaactgagtagctccagcatgcctaccagcggccaaatcaaattatcagtattttccccaatctaataaatcagtaagtcttatctagtattccttctcaatatatcttgaatttatcactatctcccattgacactatcgtaggtcaagccattgttaatctataacttagcttgcactggccttctaactggtgtaactcttcaaaattgcttctttcaaaacacttgcttattcagtagccagagtgatgtttctaaaatgtagacataagctaatttcctgcttaaaatcaccagttgttttttatttggctcatgataaagtccaagctaagcagggtagcataaaagaactattatgatctggggtctgtccactttgccacctcatgccaaatagctcccttcatcactctcaatgtcttgttataccaaattatatcaaatacctttccattttacataacagtgcactttctacatgtatctcctcttcttcatatatgtattctcctacactttaccagcatgtattgatcttagatctttttacaaaaggtttagatgatttctcctccactcttgaaagaaatattttatgttctccaaatttgcttgcataatttctttaaatttgcatgtataattcattatgtttctccctattttaacagttgtcatttactgatgttataagtattcttctgtttgcccagtcatctgtaagtaaattacatgcagagggctatgttttcccatagtttaatcccaaatacttagtaaaaatatgtttttaaaatatttttaaatgagtgatgggtggtttggtagatggatggttaaaagaacaattttttaatacataataaatatgagttgaaccatgagaaatgaaatttatagagcactggtacaataatgtgtaattttcctttaaaatgtctttaaaattcatttaataactcattaattttattatgatacaaataataataatgatgaagttgggcagcaaaggtaataaggagttacattattgagcacttaatgtatgctagatagtgtgctatgcccatttatattactattatacacgccactcttaattgcttattttcttaccaagcttgagaaaagagagtcaatcagactgtagtgagccagctccagtttctgttttactaccaaaacgatctactttatagcctttcatttcttgtctttatctatgcaatggagacaatatttgctgactttataacaatatagttatgggaactgaggcaagatgttgaaaattattttaaactcagactacagaaatttgatataagccattccttttctaaattgtaatttatgttccttcaatatcagaaaataatattgccttcattcatatcaaaagtactccgtatctgaatctttcattccagccgatctgatatactcactatattccaaatagttcatgatggcatgtgtgaagaaaatagtacattgtgcatttctgcactcttcttcctagttttaaccgacaatttagttctcatggttcccttttctgacacctttatctttatagagttttttaaagtgacatttgaacatatgtaagttacctcaaatcttttttggaataggctagggagaaaatgagacagaaattgtgaaaataaaatgccagtcataagataactgaaaataaatgaagattggctcacctatcaggttataataatttttttaaccacaacattacgattccgtaagtccgtaggaagaattatttcaaaagaaatttccaaaagggcaaaaagggcagagtaggaaacttgaaaattcatctcctcataaaaacaacacaaaagctaggcaaacaacaacaaaaatcttgtctaatttgacttttctagaattctgaaaactaactaagatgctggagaaattgggagaccatttgttgaagaaatacctactgaatcttggtaagaacaatgagctttgaggtatttacacttaccctggttccatcccatactcctcatcttagtgatggtagtcatgaaaatgtactgtatttctagtacaggtaatcagtgctggagggagcaaaacagacctcgctcacaaataattgttttagcccacctggtagctccctgaaagacctgcttaaagtcaagctaaaagtgcttgccttaatgtctcataacatggaactctcccagtgctgaggttgctaccccaaggatgtttgtcaaaaatgttcacaggcaaatataatagtcactgtttcctggggaagtgaataaaagttggggcaaaaaaaaatagattaattaaaagcttaggatgaaaggctggagattgaaatgctttggggaataaaggctttgaaaatttcacatattctgggaatccagagggccacacgtaggtacagggcagtgcaaatcctcaggaaaaaccgaaaaaggcattaatctctcgccactgactaaccttcggtctctgcgctggcaagaagtgaatgctagggcagggatggtacacggcctcactagagtttaacacacagaagcccatctcaaaattctgggagatgtttttggttccaggcaagtatagaaatctctgtccaatcactagctgactactaacctcacagaaaagagatgttattgaccacacatgacaaagaatacagactttatgatattaattcagaaaagtcactaaacaaacaatcaccataacaaacagaacatgaaactctggagaagagaaaaacctgaattccatgcttgctacattataattctcaaaatgtccagttttcaacaacaaacacaacaggcattagacgtgccaacaaacaagaaggtatattccatgcacaggaaaagaagccattcatataaactgcctctgattaacctgagacattggtcttagcagacaaatcctttaaatcagctattttaagtgtgttcaatgaactaaagaaaatcttgcccaaggaactgaagaaaataatgataacaatgtatcaccaaatagagagtatcaataaagagaaagaaatttaagaaatgaatcaagtagaaattctgaagctaaaaagtacacatttaaggtactaaaaaaaaaaactatcaaccaagaaaataaggcattccataataaataaaaacagttttcactaatagacttgtcctaaaagaaatgctaaagggagtacttcagactgaaactaatggacactagacagctacttgaatccacacaaagaaattaagaacatggttaatagtaaataaataggcattataaaagtattatgtaaaagtcattataaatgcatttattgttttaactcctctattttgctatctgatttaaaagacaatagcaagaacaataattataaatctacgctagtggacacacaatataaaaagacaatttatggcagtaacataaagtttcagttaggatgaataagctctagagatgtagcatacagcacagtgactatagttaggaattatgtattgtacacctgaaaattggtaagagagtagatctcaaatgttctcataaccaaaaaaatgataagcatgtgaggtaatgaagatgttagcctgatttaaccatcttacaatatgtacatatatcagaacatcatgttatacaccgtgtatgcatacatatacaatttttgtcagttatacttgtaaaagctgagaaaataaaattaaataaagaattcgagttcagaaataaatcctagtacttatgttcaattgatttcaaccaaagtgctgagaccactcagtaaagaaagaatagtcttttcaacaaacagtgctgagacaatataatatcgaaaagaaaaacaaggagtttgggccgctatctctcactacatagaaaaactaactcataatggatcaaacgcctaaatgtaagacctaaaactacaaaactctgaaaagaaaatatacgtgcaaatttcatatatttgaattaggtagtggtttcttaagtatgactccaaaagcacaagcagcaaaagaaaaaaatggtaaactaaatttaatcaaaattaaactttttatatattgaaatatattatcaaggaagtaaaaaaagacccatgaaatgagaaataacgtttgcaaataatatatctcataagggtttaatatccagaatatgtaaagaccataaaattcaacaccgataagataaacaacacaattgaaaaatcagcaagtgatctggataagcgtttctccaaagaggatatacaaatgaacagcaagcacttgaaaagatgctcagcatcattagtcattagagaaatgcaaatcaaaaccacagtgagataccacttcatacccactagaatggctaagaaaaatggaaaacaggccgggcgtggtggctcacacctataatcctagcactttgggatgccaaggcaggcagatcacttgaggtcaggagttcgagaccagcctagccaaaatggcgaaaccccgtctctactcaaaatacaaaaattagccggacgcggtggcaggcacctgtaatcccagctactcaggaggcttaggcaggagaatcacttgaacctgggaggcggaggttgcagtgggctgagatcttgcctctgcactacagcctgggtgacagagggagactccatctcaaaaaaaaaaaaaaaaaggaaaatattaagtgttggtgggcacgtgagagaactgcacccctgatccatcattattgggagtataaaatgatgcagccactgtggaaaacaattaggcagttccaaaacctaaacgtaaagttattatgtgacacagtaataccactcccagataaagctcaggcgactgaaaatagttgttcataagaaaactcatgtttagagcagcattattcacagtagccaaaaggtggaaataatccaaatggccatcagctgatgaatgggtaaacaatatgtggtatgttcatgtaatggaatattattcagccacaaaaagcaacacagtactagcacacgctacaatatccatgaactctgaaaaattatcctaaatgaaagatgccagacacaaaggtcacatattgtacgattccattattgtgaaatgtccagaataaatagacaaattcatggagacataaagcagattagtggttgcaagtggcaggagctgagaggaattggtagtgacggattaatggattttcttccaagagtgatgaaaatgttctacaattagattgttgtgataattagacaccattgtgattttactaaagaccactgaattttacatttttaaatcgttaaaatggtaaattttatccctgtttttaaacatttacaaaaaaatttccaatacaagttttcaatatacatactaatatggaaaacaatgagaatatatttcatggcttgttgtgcattctatgtgaggtttgtttgatgaaaacacctttcttttcaactattggtctgaaactcacaatcatgttaaatcaggttttcccaatatccatttgtagagtctagtacagtacatttttactaggatataagcattttgaggatacaaatatttcttgtttagttaactgtttgcaactagcttattgacttacaaataatgagcatatcaataagtagttgtttaataaatttattaatttcctggcttgggggaaggaaggtaacatattatcattggcagtgctttgtcgaattcttgccttcagatttgaatacaaaaaatatgatttattgtcatagctacaagtaggatagagcagctaatatgttaggttcacagagatcagtcaattgataaatatgatattatactaagacttgaattaacttaatcttcagaaacccgtggaagctttactttatgtaatatgattattattatcatctttgatttcagtattaaatgctttgtggctccttagagtcctagaacaatgtaaaagaaggtagagaggaggtccactttcatataagtgagaatttttagctgtcagatagttgacattaatgaacttcacatttatctcttcctaacagcaatttttaagcatatatctgttaatctaggtctttcattatttccatacataagcccattgcaaaattcaccaaatgacacagtagactgtcccttcaataatattattagaaaaaaagtgcactgttgggttcattttttgtagtttcttgtagcaaccttagttaaactaaagctggaactaaacaactaaagtttacttgcttaatttaaccttcagtctatgatattctcatgtctgatctttattttagaaatacatattataggcccagggcgacggctcatgcctagaatcccaccacttagggaggctgaggcaggtggatcatgaggtcaggagttcaagagcagcctggccaatatgctgaaacccagtctctactaaaaatacaaaaattagccaggcgtggtggcacacagcttgtaatcccagctactagggaggctgaggcaggagaattgcttgaccctgggagatggaggttgcagtgagccaagatcacaccactgcactccagcctgggtgacagagcaagactctgtctcaaaaaacgaaagaaaaacatatcatacctgctatgtacaatttcttttcacaatataataggtttggattttaccttttattatatttctttcctcaaatattattattttatttcagcactccttttgaattgcccactctgctttaacaataatgctgttgtttatttgtatggtgcctgaaataaaccatgctattggtctaccttggctgccatttcttattcctcatccaacctgttttctttcaaagaggctagctcttattaaagaaagatgacaccaactagtaatgttttgactactttagactcctgaaaactgtgttttccatcattctcttgaacttccataaagcttgtcctggttttaatctaattttcataagttacagagctatgcaactcaacacaagaagcaatactaataaaacttactccaaagactaccactggaaatgttttgttgttttgaatcttactatgtcattcttggaaaaagtggctttcatttccaatgagggtagatttcactttgtttgaaaaagtggtagaagaaaacgacaggcgaagaaccacttaaacaggtcactttgaaggagttctttatacttgaaattctattctctcaagttcataatttttataattgaaatataaaatattttattttcatagtaaacctcaaaaataaaattaatatctcatgagcaaactatctgaaaatgttcatgtattgctagttgtccaagagtagtttgaagatgactcattgcaacactggtagaacgggcatcatttgtctgccacccagttctagaatgaagagccgactgcattttgttgcacccaagacactatgaggaaggatttgctcacaattttgtaattgaattcattaaaatttttactctcataaatatttgctatcatttagagtttcctgtcatataaaaaatgtagagttttgaagatacaccaaaaatgtgtcatattggactcactcttaaaaattaattaatcatgcagcatgtaaaacatatagaaattataaaggatgtaaaaatgaaaacaaaaaatggaaattataaagaatgcaatagtcatatctactacctagcttaataaataatatattgccaaaggtcaaaatatttgttgtttctttcttcctgaacatcagcctctgcagtaaacttgtttctgtatatgactgtcttaaatttccctgcatgtttattgcatacatacggatccttaaacaacatccgggggttggagggtgaggcagggcatatagtctataatttgcagaaaatatatatgagtcaaggatactattgtgtggagaccagcatgagcaaaagaatagacccagagtcattgaggtactattatgtgtagggtctggtaaacatgggtcactgaaggcacaccatgattataggttctgaatagcttttttttcttcttcttcttctttcaagagacaaggtcttgctctgtcactcaggctggagtgcaatggcaccatcatagcctgggttcaagtgatgctcctacctcagctccctcagtagctaggactacaggtgcatacccccacatcttgctatttttttgtttttttctagagattgggtcttctgtgttgtccaggtctgtcttgaactcctggcctcaagtgatcctctaatttaaacccccaaaagtgctgggatcagaggcataagccactggacctggtttacaggtcctaaatatctaagagcaatgccaacgtaagtccaatgctacacatcctctctctccaaatggctcaaaatggaggcaaaggagtgggactccaagacagaagatgtgagtgaattagaggaggaggagaaacaaaagaaacaaatatggggatatcggcttatagccatgtctacatttacaacaaccctgctcttttacctgcaacaaaataatctaaaacagcttattaaaaatagattagttttgttttattactatggcattaaccagtatgtgttcacaaatgaaggcagattgggaatagacttcgcttcactttcaaggttcctttcctcaattaagtctaaaagaggagaactatttccccactccctcatccccatgaaaaacaaaagaaaagaaaaaattctgtatctttaatttttttctaccaaagctgatacctgaaaatcttttacagctgcatctgctatttcctgctcagccctttcttaactctcttagatatgagctaaaagaaaatatgcccagataccaccttaccctagcagcatattctctacctgccttacccactctgtgtgccaacccacttgttctgatgcctgaggtagaaatagtagagttttggctgcaaaatgctttcttcttgcatttattatagatgacaaaaatattttggagttaaatggtgagatggagggatttttttttaggtcttatatttgactaaagatttgtgtttcttgctttgtgaaaatttaatattttaactgtattccagcagccctatgaaagtaggtaaggtagatgtactaaacccattaacatgataaggcaaccagaggctcagtggattgctaagatggtgaattgcttttttactaggtgaaattatatttttatggaaaggacagaaggagcagagtttgttttggtcttttgcttcgttttttgtaaatgtgcatgtgttagcaaaaacacaaagcagcaagaaaccaaggatgtggtaaattattcactttatgacttcaaagagcttctcttttatgactagcagcctcacagatcaatagataacgggtgtaaataagaatcatagaatttaggagttggacaaggctttgaaggttattcaggacaacccctcataaggagttatgttggtccaatattgcttggaaaagatgggctaggccagaccttccagtctagtctgagtttgagtttgtgtgagaagtttgactggaactaggtacaagcctactttttctttgatttacttacagagtaggaaataagaagggcaaagattgccaaagaactaagaatgctttgagggttaaaatttctgctgcgttcgcactggggcactcttgtacctgcgattgctctgcggggcttaggagatttcccatattgcccagtatgggcagaattgtccacaacctgccacaagaactaacccagactctgcgagaacattcccccacaatgggtagttgatatcatagaactttctttctcactgtaggaaaccctaatttgtcagcctttcttctactgctttatattgaaagcaaggctagcttttaatcataaagggacaaaaaaaaaaaaaaaaaaaaaaaaaaaggcacactcctagttaacacccagcttctactgctcttttagaagtccctttgtttcatggagaccagaaaaaaccatttacatttccaactctttgtcttttttattttattttattttatttttcactcggtctcccaaactagactgcagtggcgcgatctcggttcactgcaacctccgcctcctggattcaagcgcttctcatgcctcagcctcctgagtcgctgggattacaggcacctgccaccacgcccggctaatttttgtattttgagtacagacggggtttcgccatgttggcaaggctggtcttgaactcctgacctcaaagtgatcctcccacctcaacctcccaaagtgcagggattacagacgtgagctaccgtgcccggcctctttgtcttatttttgcagcctgaaacaaagaaaaagtcaacaatctttttttttatttttttattttttgcaagccagcccttcaaatacttaaatgaattatctctatttcacaaccattcacagccttggtcttcatctttgttttttgtttttcttgtccccaaatcccgacacatcttctcccatgatacaactccctattctgttgagtgccttcagcggaacactctccagtgtgtcactgccattataaaacgcagatctcttagtgaccccaggtgaatctcaatccttccccctgaatagcacgtttcaactaggaatccattcgtgtctatcttggtaatcctatacagtcagtcattccgctgagggttccacctaagggtgaccccaaacgaagggagggaggaaggagaaagaaaacaaaggtgaaagaaagaacaaatacagaaatataaggaagaaagaaaaagataaaaagaaagaagagggaggaacagaaggaaagatttaaaaagaagaagaagaagaatgcatctactttagcatattttcttaataaatcacgcaagttttaaagagtccccctcttttatcttctaaggtctcacaaactatttgataaacattacagtaggtatttcttttttttttttttttgcctatataatatgcactctcttttttctctaataccaatatcctaatttcctaatgaatccaggctccgtcactcctaggacaagtgctttgtgtggcagagctgtgtccaatgctagctttgtagacacatggtatgctgttctgaacaatcagatcactttatttctccaaccatgacaactggttcagagatggacatctgacctattcagagccattcagaattaacctcagtttttattgagaaaaccagaatagattctatttcaacacgatttggaagaaatcttgggaacattagtgacctcaacaggaaaaaaaaaaaaaaaaaagcaaacgtggaagaaaaataagctgatggcggggacgggaaggagccaggagataaaaacagcttcctgatagctggaaatagacaaagcaagctgcggttagttctactggagacgttttcccttactgatcttttttgtttaagcctcttgtagctgagtttcttttatttgcaacagaaagagacatgtctaatatttattttcccaaaatatgcatcaaatttcacttctttccaaattgattatttccagtttaaaacatgaggatgatgcgtgcacatctttagtactctcaatgtttccaacccttatcttcaatgtaatttactaacaattatttaaagctccctctctcactattgtaagctacacgaaggcagaaagcatcacttattttaatgacccttatagtttagtgcagtgccaggcacttagttaacacaccatataaatgtctagatagatagatatatagaggtaggtgataaagaaatttatatatatatatacactatatatatagtatatataaagaaatacatatataatatatgcatgtgatagaacgaaagaaaggataggtagatttatcgataggtataaagcccgtgggctgtgacttatgcctgtaattctagcaatttgggcggccgaggcaggtggatcactttagcccaggagtttgagaccaccatggacaacgtgacaaaaccctgtttctataaaatatacgaaaattagctgggtgtggtggcatatgcctgtagtcccagcactcgggaggatgagacggaaggatcccttgagcctggaacttcgagactgcagtgagcggagactgtgccactgcattccaacctgggcaacacagtgaaatcctgtctcaaattgatagatagaataatagaaataattaaatgaacgttatgtcaacttccctatggtctatacatcttcagcctttaatagcgtttgctttgggagctcattcacaacatcttttattattctgacaggtttcattggatcacgttctcctgaatgattttccccttctccctttatcctgggttatcagtttttctaactaaagaatgttcattttatgctaggaagctgagctcagagagatgctcctcaaatttttaatcttagaaaattttctgggaaacctatggacaaggtgctcacctcgcttgcaagaacaagcttagtatattcacaatcatacatttcattgtctctctgagggtcaatgtttcttgctgaagctcataatggatttgaaaatccttgtaatgcctaactcccctttaaacaattaaccagagtctcttggttcccttggagactattctaagacttaaaattgtttttcttctcccctgcccacactgcagctaaaagctatgaattaccacaataaacaatattgagaaatgtcaaaaatcatcatttcatcccatggaaaataatcaaagagcaaagatagagattcccttcctatttatgcacttgtttaagaagtgtctgacctctgtgggatcttctgggaaaactttgatattttgactattcgttattaaaaattcatagatagagatgaaaatgaatcatttactttttttcaatcataccaaaattggccaaatggcttttgcagctgacagtttccagttattctttgtgatggaaaagggctatcaatttatgaaggaggaggcatgatagtgacatccataataaaatttaagcaataatctgtacacaaataacatatttatcatccctcatgcaaaagctaagccatttgcaatttgtaaacttacattaagttcaaaataaagaaattttaaaaatgcatgctagttaaataaaatgcacagtgtttataattgggaaacataatatcaataatgatgatggtgatgattatagagagaaattatataggtttaaaagtatgccaggccctctaataagtgctttatgtaaattgattcatttactccttccaaagatcatttgaggcaggtaatcagctaggaaaaatattctacagagtatgcagtaggcacagcaagtgccaagggtctgaggtgagaatgagcacagcatgttgaagaagctaaaagacagagtagataatatgtcttttacataacaatattttatatcaattttcatttcctttctagtacaagattatttagaatattaaaattttcagttaaaattgttttttttcccttggctattcttttctgttgttttttttaaatattttgtttccataatgtggactcaattttcagtttcatataatttgtttttattttaattttgaaataatatattaaaatttaaaatattatttcatgagtgttggaaaaactgtattgttgttttaagattacagttctgtgtgtgtgtgtgtgtgtgtgtgtgtgtgtgtgtgtgtgtatgtgtgtgcatggctaccaaatcaaatttttagtagtttgaattttgctattcctctttgagtctaatgtcaaataaattttgtatgaagtatctttaaggctctaacatttaaggatcagtaaatttgtctttgtatttccatgagcttaattttgtatattttgatgctgcattttaaaaataagttacactcaagttttgttttttattgtattttaagttccaggatacatgtgtagaatgtgcaggtttgttacataggtaaacatgttccatggtgatttgctgtacctatcaacccatcacctaggtattaagcccagcatgcattaactatttttcctgatgctttccttccccctgcacactgctcccacccctcaactggccccagtgtgtgttgttcttctccctgtgtctacgtgttcacattgttcagctctcacttataagtgagaacacgcagtgtttgattttctgttcctgtgctagtttgctgaggataatggcttccagctccatccatgtccctgcaaaggacatgatctcattcctttttatggctgcatagtattccatggtgtatatgtaccacattttctttatccagtctattattgatgggcatttgggttgactccatgtctttgctactgtgaatagtgctgcaatgaatatatgcatgcatgtatctttataatagaacaatttatatttcattgggtatatacccagtaatgggattgctgggtcaaatggtatttctggttctaggtctttgaggaaacaccacactgtcttccacaatggttaaactaatttacattcccaccaacactgtaaaagcgttcctattggtccacaacctccccagcatctgttgtttcttgactttttaataatcactattttgactgttgtgagatggtatctcactgtggtttttatttgcatttctctaatgatcaatgatgttgagcttttcttcatatgtttgttggctgtgtaaatgtcttcttttgagaagtgtctgttcatgtccttcgtccactttttaatggggttgttttttcctcgtaaatttgtttaagtttctcatagattctggatattaggcctttgtcagatggagagattgcaaaaattttctcccattctgtaggttgtctgttcagactgatgatagtttcttttgctgtgcagaagctctttagtttaattagatcccttttgtcaattttttgcttttgtttcaattgttaccaaaaaagagcccatatagccaacataaccctaagcaaaaagaacaaagctgggggcatcatgctacctgacttcaaactatactacaaggctacagtaaccaaaacagcttagtactggtacaaaaacagacacacagaccaatgaaacagaatagaggactcagaaataagattgcatgtctataaccatctgatcttccacaaatctgacaaaaacaagcaatggggaaaggattccctgtttaataaatggtgctgggagaactggctagccatatgcagaaaattgaatctggacctcttccttacaccttatacaaaaattaactcaagatggattaaagacttaatgtaaaatcccaaactataaaaacctagaggaaaacctaggcaataccattcaggacatagacaagggcaaaaatttcatgttgatgctgtgtttttttatgtatataaggttttatgattttacttttaccattgtaaaatatgattagcttgtctcattcatcttttttttctggtattacaatgggtttcacagtgttggttcaatgcctgccttttgttaaaatttgcccaatttacttttaccatcattttattattatactttatattgtcgaatttttaactttctcactttcacacaacatatagctagatatgggattgttgttcatttgttttctcttctttctttttttttcttcttttctctccctaatgttaaagcctctgatttataaggaaatataactcatgtttattatgcctacaaacatacttagtatttcttaggttgagattcccagcaagtggagcctgtggcaaaggctggtgtgcttctgctccattagagtgtgatcccagggagaagtagtgagatcaagtacagcaaagcagggaagaagggagagccaatagaaaatgtgccatggggctgagcattacaaggtaaagcagatgtttgaccttcaggatctcttcccccagaagctatatgactgtggctcagaaccgtgtgcccaaaggagacagagaggataatttatctacacacatctgttgcccatcactcaaaagtctggctgatagggggttaattctgccccaccacccacccctacacacacatatttcggttggacataggtgggcactgacgtagattctttgcttcctgtacttatatgtgaatagcaaagtgttgagaactggaagcatgagtgagtgacatgcaaggaactgacattgaagtaagattctgtgagggtgaggttgcatttgtagaaagtggttatagtccacttagcaatggtcatcacagaggtggctgagggaccagtagatggttctgaaaaggtaagtggatgctacctaggtttgtttagtcttctttctagcagggtttctgattgggtttcatttattttattctcttgtactgaattgtcttttcctatttttcttttttgttttaagcattattcatcataggcctaatagttgcccacatatatttaatgtgtatgtttatattataatttttgaaggataatttgaattattatccatttagaaaatgaccataacatactttcacatttcttgtgctctaccttcttcacctcaactagtcaccctttatatgctctgggtttcatattgaaaatatatttgaaatattcctggatcattacacataactctgtaacatatttattttttaaattctggagaaatctatttttgagctcactagtttcctttataagtctatccatttctcaattcaacccactcatagagttttttaattacttttttcaactaaaaattgaatgtttaaatctaactcttttaaaatgaccactgcttaacataaactgggaagagataagggagtcatggcccatctgttccagtaatcatccagatggacaaccaggtggcctctgccttgcttacaatcattaactgtgaacctggaggactgctacaaccaaccttagcagaagatctgaggatacaaaagtttagggcaccagtttcttatgttcttttttttctttataattcttttaatcttctctttatgtttcagggattcctcaaaatttgcaattggttgatggcactcttcatctttctgatgttcatttagaagtggtatgtgtgcgtgtgtatgtgtgtgtagtgtgtatgtagtcattcttaccagtagtgcacacctccccccccaattctctcctctatcctactttgttcttttgatttttttcatttcaagggattttggaaagtagaagagtaaaattgtatagtcaatctacaccctttgatacaatctccagtgcactaattaattttacatttttatcattgttagtttttattgaaacacgcatgccaaaagaaaaaaaatccacccaagaataattgaattggtgtatctgagtttggtagataatcctttaaatcttaaattgtgttaatctcagcatttgcagagctattgcctgctatcctgtagtgaacccagtttctaaatcagagcaatccttaattaaaatgggacattaatcaacagcaaactatttgcatctaccattattctaaattgtgtgacttgacaagatccacgttattgcctaagataaacattaaatatataaacttcataaggcagaagctgtttatcttagtcttatctagaaaagacattacaaataaggattcattaacttattcattttatatatatgtatgtttttcacgttatagatacgtatattattctttgccaattatattgtaattatatgctttaggattaaataacagttgtaattttttgtcacacacatgcctgcatgtgtaggcactttatgcatatgaacacatttatatttcttatttatacatcaagattatgcaaaaaaatgagaaaaaataaaaatatgaaaatgcttaattcagttatttgtgcaacctaaatataaaattagagcatgcctccaggatctaatgggagtcttaagggtccattagatggcacaattggtttaaaattataatatctctcaaatttttaaaattaaaatttgccttcaatgtaaagcaatggtaacaacaaactgttagaataacatatggcactaaccaaattgattctaaatggccacctgtccctaatatctatgatttcctccacagataattactgggaacctgatgctcagtactgtattaggcattaaaaggatgaagatgactaagggaacaaaataacagcttagaataattctctcctttttagagtttttccctaactttgtcaaagtataattaaaaaataaaaatgtctatattttcagcatacaatgtgatgttttaatatacatcttcattgattaccacagttgtgcttattaacatatccatcacctcacaggtttacatattttttttgtggtgagaacatttaagaatactctctgagtaaatgttaagtatacggtacagtataattaatgataggtatggtctattggatttccaaaactaattcattctgcataactgcaactttatgtcattttaccaatgtctcctcttttccctcactctcaagacactggcaatcatcatttttctctctgtttctatgagtttaagtttttaagattgtatatgtgagagtatgctgtatttgtctttctgtccctagcttatttcctttaacataatgttttctatggtcatccatgttgttgcaaatgacagaatgtccttttttttgtttgtttgtttttgtttttgttttgagacggagtctggctctgtcgcccaggctggagtgcggtggcgccatctctgctcactgcaagctccgcctcccgggttcccgccattctcctgcctcagcctcccgagtagctgggactacaggcgcccgccaccacgcccggctaattttttgtattttttgatagagacggggtttcaccgtgttagccaggatggtttcgatctcctgacctcgtgatccccccgcctcggcctcccaaagtgctgggatcacaggcgtgagccaccgcgcccagccagaatttcctctttttaaaaaaagaaaaatggccgggcgcggtggctcacgcctttgatcccaacactttgggaagtcgaggcagggggatcacgaggtcaggagatggagaccatcctggctaacacggtgaaaccccgtctctactaaaaatacaaaaaattagccgggcgtggtggcgggcgcctgtagtcccagctactcgggaggctgaggcaggagaatggctgatcccgggaggcggagcttgcagtgagctgagatcctgcaactgcactccagcctgggcgacacagcaagactctgtctcaaaaaaaaaaaaaaaaaaagaaaaaaaagaaaaatattcctgtgtgggtgtgtgggggtgtgtgggggtgtgtgtttttgtgtctgtgtattttctttgtctattcatctgtctatgaaaacagttgattccgtatcttggccattgtgaataatgctgcagtgaacacaggaatgcagatatctcttcaacatactgattttatttcctttgaatgtatacacaatattgggattgctggattatatgataattatttttaattttttaagaacctccatactgtttttataatagctgtaacaatttacaatcccaccaagaatgtacacgggtttccattttttcacaccctcaccaacactgattatcttttgtctttttgataatagccattctagccattctaacaggtgtgaggttattgtggttttaatttgcatttccctgatgattagtaatgttcagctttttttttttcatgtacctattggccacttatatgtcttcttttgagaactgtctcttccgatcctttgcccattttttaattaggttatttgtttttgctgttgagatctttgaattccttatatgttttggatattaatctctcattgtatatatggcttgcaaacaatttctcccatgtaggttgcctcttcattatgctaattatttcctttgttatacagaagctttttagttgatgcaatcccatttgtctatttttgattttgttgcctttgctttggggatcatatccaaaaattatttgcccagaccaatgtcaaaaggggttttttcctatgttgtctttcaataattttatagtttcagatgttacattgaagtctttaatctattttgggttgatttatgtagacagtgtgagataagggtacaatttcattcttctgcatttagataagcagttttcccaacatctttattgaaaagactttccccattgcatgttcttgtcatctttgtcgaagatctgttgacaataaatgtgtggatttatttctgggctctctatacaattccattgggctgtatgtctatttttatgccagtatcatgttgtttttattactatagctttgtagtatatttcaacatctggtagtatgatgccttcatcattgttcttgtcaggattacttttgactgtttggaacttttgtggtttcatatgctttaggatttcttttgtatttctgtaaataataccattggatttttatggggcttgcattgattctgtatttgttttgaatttttaacaatatagattcttccaatatataaacatagatttttttgtttatttgtgtcttcttcaatttctttcatcaatattttaaagtttaactgtacagatcttttatctcctttgctcaatctattcctaaatctgttttaaatgatactgtgaatgggattgcttccctattttcttttttgggtgtttcattgttagtgtatagaaatgccacagatttttatatgtttgttttgtatcctgcagttatacactgaagttgcttattagttctaacactttttcaatagagcctttaaagtttttccatatatacagtcatgccatctgcaaagagacaatttaactttttcagtcaagattgtaatggatatcctccagactgttcagttgtttccttacagaaatcacagttttaccctcagtaatctcaatacaattacaaagacaaataaaaggatcagtatgtctttgattttgttggaaatacattaactcagcttttactcagtttagcatagtggtaagatgtacaggttttgacattagacagatccaaattccaattctgcttcctcgaatcgcgtgctgatgaatttaggcatgttacttaacctctctgagaatctttcctttctttttttttttaatttggtgagtgagcataataatcacaataatcgaataggctatttttcaggtctatctatatatatatgtatacgtatataatatttatatgtatgtataaaacatttagcgtaaaagcattcaattgattttaatctccttacctgtaagtgtttattttggtgtgtattaacacattgtgtgtatgtttatatagtgtctgcatttaaataaaatagatttaaacttaataacctggaatgctagatttatatcatcacaatttattaggttaaaatgtgggtgctctaaaacaaacaaacacaatgcaacccctcaggctcatgaaagtaaaatgagaaatacattatgtggtgataagagctaatacttcatgcaaatgtgacattacacatctctttgtgtttaggactatgcttgtcagctatgcaaatgctagccattatttcttaacacactctggtccttaaatagcaccaagaggaatgttctatatttcactcatttagtacattattgtattgtaatttttaaataaaactaaaaagaactagaccacataaccatctttgatcaatgttcagaacaaatatatggcagagaattattaaacagtacctcaagcatgctctttccagagggcaatggattatttagtaccatgtcaaatcacataaactaattcaaaaatgataaattacaatgaaaatgcatgctgatgttttgtccctgaattctaataatgggtgtaaaacagtgttaactgtcattgatcagacacatttattggcatgctaacctaacaattaccatagtattgactatcaaacagccatatgattatagtatatgatgtactatatagtatatgattatagaaaagatatagcatatgggttcatttactctaggaataccaattataaatataagtaagtgtagaatactaatttgttaattaaataaatatcattttaattcacaacagttgacactctggttctccttgactccctgagttttaaataagaaaatgtattaactaacttagaattttctcaaatttatttatcattgcacttagccttcacctaataaaaatgtttatttggctttaggcgtgaaatttcccagatagtcaaaaacaaatctgccaaatcaatgccaataatcttctaagtattttgaatattaatatttatgaaggacaaaaggttacttttgtaatgttgcaattaaatgtctattttctcttcataaatagaaattaatgaatcaatgtttatgcaactgactgcttgccaattaaacacttatcttaggaattcataaacgtcctttctcttcaaagagtcagcaatagaaaattctttcttttttctcttttttataacctttcttctacctacttttttcttattctccctgcctatttcttgtcattctctttgttctatactcttttttctttgctctacatcctcctccacgtcccatgcagtgtatggtgttaactcatacaaagcagtgcatgtagagactatgttattaaaaccccaggggtttggtctaggttccattgctcactgcacagaaagccaatcactgagacaatgagtgttgcctgggaagagagatgggagccaaagctcaaatctatccctctcacccaagcaacattgggggtttatatatcagggaaggaatttagctatgtacagaaagcaatcatgacaaatgagggttctggcatctgtctggattcggtgatcaggtgagtttctgttccttccttgcctgaaggttaatttccctagggaggaactcagaagtgagtttcaagttttaagaccagaaggggcaatttctatatttatttaaaaaaaaaaaagtaaacatgagctctacggagcatttgggcttgtttcagcagtaggtgagggcgtggctgaggcctggcagggaagcgatgttcacaatgcctgatcaccttagtttaaaacatttagaagctgagaggaaatttcctggtcaataatctaggcacctcaaaaaagtttccattatttttttttcaaatacacagataatttcttggccaaatttcttggcaatgacactgaggcaagaccagaaatgaatggcttgaaagaatgagaacagcaaagaagaattgtccagttgttcaaatgagagaatttcagcccacagttgaggtaatgatagcagatctggaaaagacagggacgatagaggaaactataaagaagagggacactgtagaattcagcaataggttgaagaaaagacagaaatgagtcacagattggaaatggaataaatgcacattgatgccttccttccccactgttttttttaaaaagcacatatatcacctgatggttatctgaacgagagcccgactgaagaggctgacaatcagactaagccaagcagacaagtaaaatagctatagggaacagtcctagaaacaggttttacagtttagcatagatatgtcttttttcttaaaagaaacaatcttggcttatattttattcataaaagctattctttactctgttgccttgagtgattttgcctatgtgtagatgtgagtacagcagctttaaattcacctgtgcccttgaaacagcagcctgtagtacattcaacatcgttgcactgactgctgctattctgccttctttgtgagccaattatgaatctatcttcagaaaattgtgctccagtgctattactgaattaacactttgcttaagtgtgttaattcacagacacccacatgtgtgcctacatacaacctcagagaaaatgtgtaaataagtttaagagtagcaaaaaggcatgctttttatgaaaagcatttaaagtgtctaaaattttctatttatcctgttaagagagaagggtgcagggatttattaatattgaatgaaatgatgtatattgaatagaaaatatattttctttttttttgagacagagtctcagtctgtcacccaggctggagtgcagtggtgtgatctcagctcactgcatcctccatctcctgggttcaagcaattctcctacctcagcctcccaagtagctgggtttacaggtgcccaccaccatacccagctaatttttgcatttttaggagagatggggtttcaccctgttggccaggctggtctcgaacttctaacctcaggtgatccacccacttcagcctcccaaagtgctgggattacaggcttgagccactgcgcccagccagattatattttctttaagatagaaatagtaggcataatcttcctgatcttcctgattttgtcttccatgttaaagaacatttattgtctgtctaaaatttaatgttcatgtgtacatggaatttaaagacaaaagaatacattccgaagaaaaacttaacttgtatttccaagtcctatctttacatcagaacaccctgtagagctttaaaagttctaaaacctgaattccaccttgagaagttatgtttttaaaatccccactggtcaattgcatgcatagccaaagtggaggatccctgtattagggcctgcctgtcgctaggcgcagggggtggcagcagggcacagtggaggtgggtgtgtggtggaaatcacttccaaacttacctagctctaagatgggctgttagagggcagttccttctaaactttaaatctgaaatcaactgttcagtttatgattctgttactgtataaccctgaccttgaatttatctgggtcacctttgctttgagaaaacagcctgtctagaagagcagggattttgtaatcagagatttgaactgaagtcttggctctggccatttactactgagatacttaggtaaattactgaatctcttgtaacatctgtttcctcactctataaagtagagtgattaaaaatatactcaacagttccaaggctgttcaagttcaatgaaagataatctgtgtaggattgaacacacaggaagtgctcagtgtgcgttaatttctttctcctttactgaatggtagcttttttatactcatttgtgctccttataaaataggcaaagttaagggaaagtgattaaaatcacatgagcctgttctctatttggctgtatctctgtaaagagtgagaagaaggttggctgttttaatttttaagacagaaaaatgattttttgattttgttttgatagagtcttgctctgttttcctggctggagtgcagtggtgcaatcatagctcagtataaccttgaactcctggattcaaatgatcctcctgccttagcttccctagtcgcttggactacaggcacacaataccatacccagataacttttttaaaattttttttcagaaataaggaatctgcccaggctggtctcaaactcctgacctcaagcaatcctcctgcctcaacctcccaaagtgctgggactacaggtgtaactaccaaaaacggcagggaaatgatttttttaaacacacatagcaaaatgtttttgtcttaatatgtgatgcccaacttaaaatagttacctttaagagctgagaggttattccaaagatgctgcactgaaaaaaacattcatagccacacgtatgaaattgtcttccagaatttagggtacgtgaagcaggatggaaatgcaatcgcaaggtcctagggatacaaacctgggacaaacaagcaagtttcctgactctatagaatttacctttcagaggtagacagatgttgatcaagtgctcctacagaaaactaggacatgtaaaataactaaggatgggaggggagcaaatgtagaaaatggtaaaccatttcgaaggtaatgagggttgtccggggaaagagatgatgacaccctggactaggtttgggtgctggagtcaacttatgtaaattatttaggagggagagccaacaggatttgcatatcatggggatttctgcatgtattattttagaggtgaaatcaatgggacttgaaagagaagcttatatgtgatatatctgacttgagcaaccagatgaaccatgctgctagtcaataaaattggcaggattaaataaatctcttatatgaggtagaagaccacatcttgaatacattgagtttgagatgcctttggaccatccaagatgaaatgtcggataagcagcaggagcgatgccttggtcccacagacaagagagtgagaagcagttatacgtgggtcatggtataaatcatatgatggccagtgaagccatgagtgtgggaggtcatattcagtgaaagctcagagtgagaagagtgcctttacacaagtttttattaaggacttcctgtgatagcattgactgctgatcacattggtgtttgcataaaatagcataatctaatccacaaattctctttcttagaagttgtttagaagtaaaagcaaagctgctcttcaataaatgtctcttgcacatactcagcaatcctagaagagaagccaaaagatacaatcagtatgtaaaggtacgatcagtgtgtaaagatacagtcagtgtgtaaagataggtcagtgcttagaatgatcgaggggaagtcccagatgaaaaatgttgaaggttgtctggccatgtcagtttcaaacccaaatgaatcctgagatttttatgccctatagaaatagttactcattaagattttatcaaaatagtctccttgaaaaaataattctcatgtttgtcagctgcagtgtgtaatctaaaatttaattagagattttaaatatctcttgaatctctgatagcagttttcaagacatttgaggcttattagctcagcccattttactgcagggaagaatgagatagcaatggtgaactttttttttttttttaatgttaggcaactccttttattccataatgagaaaacacctgctttttaattaaaattctatttctgtatacctttgtttgagtagttgaatcctaaatattcaggggcagtgagtccatttaaaactcataacaagtaaaacttcttaaatttaattgtacccttcaggttcaaaagtgctttggtaatttgggttctaaacagaatgtgggaagcaattaagggaggctgctattgtgaatcatgcatcacactcagaatcgaaagacgtgggttttcattcaccctgtgctacacacaggatatgtttatgagctgagctctgtggaagcagagacatttcttaacctcccaatctccacatctaccttataaagatttggtaggttttgttgtttctgttgttgttgaagttttaaagtttatggtgaaatatatgtcagacattcaggtaagaataaaatattataaaaagtattataataaacattaggtttctttaagctaacattaggaagtaattacttcagtttattttttaaggaattaaatgctataaacacaattgagatcctttttctacctttctcccatatcatttccttccctcctcctccactatacatacaattaggaattcagtgcacataaaaatatttttttttagactgaaggactcctagatccttatctatgactatagagaaacagatcagagagtgtgctaaatctataggtgctggccctgtatatgtcaaaaggataataatttctataaatgtattctgtacttttgttacataattatgtattgataagtatatgtaattttttgcactatgtgttaacgtttatcgaaatagcactacgtgtacattacactacatgtaacattgaacctcttgcttttttactcaatatttttttgagttttctctatgttggtaaaggttactaattcattccaagttctacatcatattattccatttacaaatgtagcataatatagtcttccatattcctgctgatggatgttagattgtttataatgttaaattgttcattataaataatgaagtaatgagcattactgctcttgaacatgccttgtgttcatatgtgagagttttatacacaggatatttctttcttgctgtagactaaaattgttcacttttactatcacactgctatattgttttccaaagtggttgtacaaatttacacttccaatagcagtgtatgagagtcttatttttccatatttctgcaaatatctagtttttccttttttgtatgtgtgcctgaatttatctcagactttcatagctaaatttttggggccacctctactgtcactactaacatctccatgaatgccaccatctccctgattctttccatgcgagcattgtatataggtgcaatggaatgggccaagtgctatttgtaatcatggcagctgtcgtctaatatataactctatataatcaaaataacatgagtaaaatctttaatctgtcttattcattcattatatgttagttaaatgttggcactaagaataattataattctgatttaataattaaaaagataaaagaattatataattttttatgagaacacaccagattcaccatgaacttcaaagagggatacataaaattctgcccttgtgtggatcaaatacatgacatctaacctcaccggaaaactggaaaattagtcaaaatagcaaataattatgtagcttcttccatcccctctttgacattccctaatttcacataattctagaattaaaaggaatacagtaacaaccttgcctaagtttcttatttaaaattcaggaagaatattctcaaattatgaatcctaaagaggtgaaatgccttgataaagtcacataacaacagattttcacctttaacttctttttcctgatttttggcagcctgagaccctgcagtgcagtgttctgccaaaacacgtgggcctgttgccctcaagaacagcccaagccatcaagatttccctgactcacttgtttactctaacatctcacctcctttttctgtaatatttcaggactttcctccttgctaaccaatctaataagctaatgagccagcactggcagaggtttaatgttctatccattctcaataatattgcccaagagggaaatttttcagccagtttctgttgaagcctctcaaaatattactctacaactatcaacctaatcttctcaaatgtaggcagaaaaacaaaaatcacttcagtcttttctattttaatttactgaggtacactaaagaaaacttctctatcattatccacctcataaaggcctgagacaatcacactcatcacttaaattcagacataagcatggcacgctaatgaaactaaggcaaatatgaaggtaacagtttatttttaatgcctattaaatattgttaaattaaaatgaaacatttaagaaaatatatgtgacattcaaatgaacaccaaatgattcatttcacactagtcaatattaaattaactccatattacatgaaaatgttaaatactactgaaataagcagcaaaagaaaattatactgtaacctcacaaacacatcatggttggaaatttgttattcaaaaaagattaagactaattttgtaaaactgttttaaagtcaattatttttaaaaagaattacgagaaaatatcatcacatcagtggttccattatatgttttaaattaatgaactaatgaaacccactaaaatgtaggcaggtgtaaacaaattgctgtttgtataacgcaatacttagtaaagattatttaagtagtatgctaaaatctaaacaatacgtagagtctataaaggataacttttagaattacgtttcaaaattaaagttgaaataataaactgaagaaattgctaacctaatcaattctgagtttgcaatatacaacacgggattggtcacctgatatcaatatgtaagttgtttcaaagtgcaaacttgattttaaaaagtttctttggtcttcatattaaagacatatttaagtatcacagataaattactcaagttatcagttaaattgctcaaagagtaacaccataattactatacaataatattttgattattttgacctctataatcatgctgaagagatatttataggttcttgattaatgggcaattttttgatttagattaattctatgataaacttaaggttatcaagtcttattttttcttcaataatttaacattcacacacagacacacacacttgagtccacgcttgagtgcccactctacaccgtgctgggactcagaaataagaaatcctcggccgggcgcggtggctcacgcctgtaatcccagcactttggggcgctgaggcgggtggatcgtgaggtcaggagatcgagaccatcctggctaacgcggtgaaaccccgtctctactaaaaacacaaaacattagccggacgtggtggcgggcacctgtaatccaagctactcaggaggctgaggcaggaggatggcgtgaacccgggaggcggagcttgcagtgagctgcactccagcctgggcgacagagccagactccgtctcaaaaaacaaaaaaaaagaaaaaaagaaaatccttaaaaaaatcagagattaacggggatgacagacaaactaggacacagtgttgcctgctatgcatgggaacgttagcagaacactctgggaggcccagaggaacagtgtatattggatttggggtggcatcactttctcaggggagtgttgtgtggattgagtcttcagggactagtacttgccagctagacaaattggtgcatactggggctggagaagcagcccatgggaccacaggaaaagcagcagcagctggtgcactgcactctggaaactatactacccaaggtcagtcatgagatgagcttgatgaagtgagagagaagtgtctagaggaagggtcagtactaaatcgcaaaggcctcacatcatgatgagtgactgcagcttgatgaacagatagagaagtctgcaaaaaaaggtcaacagagaaatggcgttatcagattgattttccagaaagctcctactagttgcctcattgttgttgaatatttcctacaattggaaacattaagggcacataaggagaggctttgtgatgatggcccaaggctttacctgggattgaccatagaaggaagggtcagaggctatgctatatttatggctaacagccttgtatatctttttttttagatggagtcttgctcttatagccaaggctggaatgcagtggtgccatcttggctcactgcaacctctgcctccggggttcaagcgattctcctgcctcagccttccaagtagctgggattacaggcacccatcaccaagcctggctaatttctgtgttcttagtagagacagggtttcactatattggccaggctgatcgtgaactcctgaccttaagtgatcagcccaccttgaactcccaaagtcctgggattacaggcatgatccaccgtgcctggccaccctgtatatcttaaactagaacaataaagtgaaggatgtaacttttttttgtttggttatttcttccttgtaagcttggacacaaactaaaatggctcatgagtacagctggaagttaactcaagttagaggtctgcaaattatggcccctggactacacctagtccactatcttattctgtaaatagagttttgtcggaaacaacccagtcacattaaaaccaaagcttattcttctatgaattgtctgtggctgattttgtacaacagcagaaaatcacaaaagagaccataaggcatgcaaagaagaaaatacagtctagccccatatagataaagcttgccaacccttcatttaagagatcactcagtgcagatcgtgtattttttcccacatatttccatcttttttgctctttattgtttcttacaccttagatgcacctggaatcattttctctctgtctacagttcatctcttagaatgactttagtgaaagttgtcacaaagacccctctcaacattgttgctctgaaaaagtccgtttttatcagcattcctgaaatgttctctagattataatcattctcttttagtgcattaaagagattattccactattgactgtctgactttgttgctgttgagaagttagccatcagtcaaattcttgctcctttgagggtgatattttgttgctgttcttcacctgtggcctttcttaagatttttttctcagtctttttttcccccagcagtttcaatgtaacatatttagttgcagatttctttttaattatcttgcatgggatttgtgagcttcttgaatctgcagattactgtctttcagatctagaaaattgtcaatcacaatcttttcagatatatcagctgtcctccagtctctcctctccatctgggactcggattacatttcctaaatcttgtgttggtgtcattcatggttagtaatctctctcatgtatagtccatcatgggtcttttaaaattaaactcaagataattgtttgcaagctatcttctcagatacaaagtctgtctttagctgtcttcagtttgttgttaagtctgctcacagagatcttaatttctatgatatatttttccagaagattttttaaaccttctatgtctgtttctatggttccctgtcctctgcagatatcttttagttggtccttcatttatttacacctttcagtgtagttgttttataatcagtatctaattacttattaataaatatctgatgtctttaccttttgctgtggttccgttttccatttctgtccttttctacttgttctcatagtctagcaccttgttgtcatttttgacatgatgaatattctttttgaaaaaaaaaatttagaactaattgacaaacatttttcaaagagaatgttcattgctgcatcaagttcaagacgtggtacagaaaatacatgactaattctaccgaggttctaccacttccattcaccctttgcctgagggcaaactctttagggtctcagtttatcaagaaggagtcttattagacttccaattttaggtgaattctgcattagattttgattccattcccagaaggcctctgctaggaaatcaaataccttcagggaaaaatccgcttttgtaccaagataaatttccaagttttcattattccttcttttcaggcctcaaaatgtcttattgtcttgttgtctgtgtgatgcttttaagaaattattttgtaatatttttatcagcttttttagttgttttcaacaggccagaatgtccctgtaagcagaccctcccattactataaacagtaagccttctgaacaggcattttaacagtaagagtattaggttaagtaaggtcttaaataaaaaccttcctgctaaggtctttgcttcctctgctgcctttgtgagccaaggggaggtttctcactctttaaaactcctgtgggcttaaaggaaggtagccaggcttcgtgctcttttagctccaaactggtacaaagtctgtgttaaaatagccagtcgaggccatttttgtctacatggaactatggttatggcatgtaaccagaatgctaaaaactctttgctggtaacattgtagactgcaaaaatggcaacttggcagctttttgaaaaatgatgtggagtcgatttcttcaccctttcattctggactgctttgcatattacttggttaatacaatgctacagaaaggatgttggatataatctgagtagtctcaagaattttgaggtatatccactcttacttttggaactctgtgaacttcacatctaataaattactggacgatttgagtccatatggaaaggtgccctactcattccagccagtgaacctaccagctaactacagatgcatgagcaatctctctttagatcaactgagaggaaccagtgtggcccagactagaaccactcagtgaaattcacaccagattgccaacctaggaattcgtgagctaaataactggttattgttttaagctactaaatgtagaagaggttaggtttgcagaaaaactcaacacctagagctatattactttatttaaattgttcttcttaaaattaaatctctctcagttatcaaatcaatgagcatttttcagtccttatctaatgagactattttacagtatctgacagtattgattattcgtaaacaatctatactcttttagtgtctatgacactggatctttgtgcttctgctggaatttctgtactattcattcttcatttcccttgtagattttatttcttcttgttttccttataagtatcagcatttgttaggtttccgtctttttcttatgtttccatccacaaactctccctgttggatctcctccacttttttttctatttcaatgaccactttgtataaagatataaattatgtctttatgcaaagcctcttcctgcattaaagtcctgaatatataatctgacagttaggtaatagtcagatatatgtcccgaggccctatgcttcaacatatcccaaagtatgtaactgcgttcttctctgccatctgctggctggctattcctctatttcacatagtatcacaactagtcacccagcaacctactagagaaacctggcataacacatgcctccctcctcattatatttgtgtccactctgtttctctcgcactgctctagtttaggccttccttctctctcttttgaaacattatgatcgtttcttgactagtatccttagctgtagtttgtttctcttatatctattctaaacttagctgtcaaaaaagttattaaacaacaactttcagagcatttgctacagtgaatttggcaaataataaacatatttgctaccacaatttttgtctctgcctctgaaagttatcactaagtgatttctgcaagattttcatggtagcatccaactacacagccagccattgctattggataggagatagctttaaacctgaaatctgtttgccttaggattgtcaaagattaacaaagcgggacagtagttaacatggcagggatatattttaatcagtaatatactactgcaataaggaagaggatctagttctatcacaaacacctcttctaacatccaggttagttttctttcaggtgtctttgtatgaaacatctagagtgggttaggggctatacctttgtgatcctgtcaaacctatatgacatcctatcaatatgaatacgaaacctatatgaatccctattaatatacctgctcacaattttgaggttttctgatgatatttctatttatttcacttggactctgtgaagtcaagtactgtatcttaaatatttttatatccccatcatttagcacagtacgtgacaattaaaatcagtcagtgattttaaaatttaacaacaacaaaaacacataataatgcgctgacctcctacaactctaatagtgcttgtgggctcaacattatctgaaaattgttcatttagccagaattatgatttcaaaataactaaggactataggcaactcattctattgcctcagggaaacgtccaaggtgtcctacttttgtggacatgtgtcatctgacaaaaggttgtcaagttcactgttctttccagttctgcctggtactatgattgcagtgcctaagcagcttgaatttcctgggcaagtgtgcaccatgctgtaataattcagaagctgtttttgtgttcttgaaacatatggtgctagctcagatttatcttgggaaaagctggtcaggaagagaaactgctgaagagctgaaatctctcccagcagctaagaaaacaacggagggacactggcgtccttcctccgagagctcaggctctccgccagtttgtggtccatatgctgaatccagagagctgcttcacttctaataacgattgtgttaagttgtgtgaggctgatattcctccagagggctcacagtttcaagcatacctaaaagcacctgttaggaagcagagcctcagaaaaatgcattagcatttctaggaaaagggcttatttttattcttcttggttacagagttgcaagttggcttgttcagaaagagctgtttttgcaccacactgatgttcagtttggtgcaacatttaagtctgggaagagcacagagccaaatgtggcaagagatggcaatagagaaaatgccaagtgccccctggcttatctcttgtagaagaatttgtagcaaggcttagaccacctgaaatgaatagcattctgcagttctgtctgaatttcactctgtgatttattatttcattatactagactgaatttgaaccaacaaatagttcacccagggaataaaatatacctttactttacagatcctttcccttcccttcccatatctttttcttctttctgtcccacctccaccaatgtgtgtatgtgtatgtgtgagcacgtgtgtgtgtgtgtactcacatccattctaattactggaaacctacctttgctggagcaggttaaatattgcctcttaaatattagtatgtttagaaagcccattcctataataaaagtggtcatttctacccagttgttcccaaatttcaataaattaatctgaataaatgagtttatagatattacacttagaaaatgcatagttaaaaggaaacattttaataaaataacacttttgaaaaagccaaatttcaaactggaaaatcagaagcaggtagtggccagtgccactagaacatgttaggaaatctcaaagtttcccctccccctttaaaaaacagtgttcctcagaaaaagtatacatatctcatttaactcagcctttttagcccagtcctattatagtgctgtttgttccaaactgttttataaaatatgtttatgctaaaatatgtaatattaccttccactaaataaataaatatattgtacacacatcacatacatatgtgccatcaccaactcctatatgaggactaaagctctgattttttatcttggccaaattcctacctaaggggtgtcgggagtcatgccctgcaaaccacaaattctcatcaggtgggtaccctatatatcgtgacttactttccaatctgactctggcataacattatgagacaaggaagaaaatcaaaatatttcaccccaaaacatgtttttctgccatgtcttggaatggccctacaaagccatcctttgttgggaaagatctgcatctgtaaagaatctctgttaacatagctagatctttttctttcaggccctcccaattctgaagagattaactaaaagtctagcaccttttaaagatctgaataggaaacatttgtcatctattgtctctaactgcagccactataagatttcaaaagaactttggtctctacgatcttttatcttaacccgaatatttcttttctatccatctcaggtctttagacaaactcaacccattgtcaaccagaaaatgtttaaatttacccatagcctggaagccaccccccaacccctccctgcttagagagttgtcctgcctttctgaaccaaatcaatgtatttcttttttttttttttttttttgtgacggagtctcccaggctgtcacccaggctggagtgtagtggcgccatctcggctcactgcaagctccgccttccgggttcacaccattctcctgcctcagcctccccagtagctgggactacaggcgcccaccactatgcctggctaattttttgtatttttagtagagacagggtttcaccgtgttatccaggaaggtctcgatctcctgacctcatgacctgctcgcctcggcctcccaaagtgctgggattagggcgtgagccaccgtgcccagccaaatcaatgtatttcttaaatgtatttaattgatgtctcctgcctccctaaaatatataaaaccaagttgtaccccaataaccttgggcacatgtcaggacctcctgagagctgtgtcatgggccgtggtcactcatatttgtctcagaataaatctcttcaaatattttacagggcttgactattttcgtcaacatatactataatatcttccaaaatgtggtcttaactcacgagagcaaacagtgcagagtgtgtgatattttctaattccatgagtattagctggttgcaaaacaagcattctcagcccatggcactgtgtattccaagtcgagcgtattctttaatgtgtttttattttgcttcactctctcatgttaccatttatctcatcttatggtaaagcagttttgatccataatggtatttttaaaagctaaattttccaaactgaaacacctagctgagtaggccgcgagttaaaagagtagtgtggcaatggctgtagattccttcaaggaagtggttgaaggaagggatggattttagggattggttgaagtcctttaatattttcttcagcataaaaaactgactaaatcaattagtacaaatactttccagagcagtggtccttaaactctagcatgcatcagaatcacatggcaggtgactgaaaccacagattgctggccccacctttagggtttctatttaggaagtcaaggtcgtgacctgagactatgtctttctttttctttctttcttttcttttcttttcttttttttttttttttttgacagagtttcactcttgttgcccaggctagagttgcacaggctggagtgcaattggcccaatctcggctcaccgcaacctctgcctcccgggttcaagcgattctcctgcctcagcctctcgagtagctgggattacaggcatgcatcaccacgcccagctaattttgtatttttagtagagatgggggtttctccatgttggtcagtctggtctcaaactcatgacctcaggtcatctgcccacctcggcctcccaaagtgctgggattacaggcatgagtcaccgcacccagccaactctgcctttctaacaagttctcaagttatgcagatgctgtcaggtggtgtcttggttgatttgagccgctgtaacaaaataccatagacttggtggcttataaacacagacctttatttttcacagttctagaggctgggaagcctgggaagtttaagatgaaggctccagaaaattcagtgtctggggagagccctcttcttggtttatagatggtgctttttagctgtgtcctcacacggtggaaggagagacctagctttctccagcctcttttataagggcactaatcccattcatgagggctccactctcatgacctaatcacctcctaaaggccttgcctcctaacaccatcaccttgggtgttagaatttccatatataaattgttaagggacacaaacattcagaccatagcagcaggagggaacacactttgatagctgttcttctagagaaatgtctatagtgcttttcagtctggatttcataagggttactatggtattatctgagaaaaacaaaaatggtgctacctagctaacttccacagaaaaaaatcaaaaacaacttttctttttttcttttattttctcctttttctttgagagacggggtcttgctgggtcacccaggctagaatgcagtggcctgatcatggctcacagcagccttgacctcctgggatcaagggatcctcccacctcagcctcagctgggaatacacatgggcatcaccatgcctgattgatttttttaaaattatctgtagagacaggatctcactgtgttgcccaggctggtctcaaattcctggcctcaagcaaccctcctaccttggcctcccaaagtgccgggattaggattacagctgtgagccactgtgcctgacaaaaaaaaaaaaaaaaaaaccaaaaaacaaaaaaaaccttaaaactaaacaattttttaaaaaatataatgaatttatattaattttatgtttcttttccactgagaaattaggaaaatgtttagtgaacttttagccacatttaactaggaaaaaaacttcttaattttggcctgaattcctggctacagctgactgaccatcccttgacttccacaacctttattgccatcccaggttggcccctcatcctcagagtaacatcctggagagctgtcatcatccaagcttgcctcatatcttctgtcctaaatttttatgcgccaccttctgcccgcaaacttcttgacatcttcagcctgatttcctcttttccttttttttcctcttttatccatttctcagttcattctcttctgctttcattgtttttctgaacatacctagacctcatggtcaatcatcgcattgatcatttctttctaatattagaaatgtcctgactttcttgccattattcttacacacagtcagaataatccaatctaatcattcttttctctttgacttccacataacaatcattgctaggaaaattaatggttagactgccattggaatttccaactgcaaaatgtcctgtctccaagactagatgagcagtaattggacatatccctaatgagcactctgccgttttccacaatgtttatttcggattgtcatcactgaagtccctttctcactaccctctctatcacactttggaaaaagatctttcctcccatactgtacaaataaaataataataatagccaccaatcattttttcccttcaactttcttcacccttccctatcctgctacttgcggattcactcatctgtgcctcattgtttcctgcttcagaagaacacaagagcagaatcaagagccagcacaaacatagttttggaaaagtgcccgattttactttccatattttatcaccagtgtagtgtatgaaaaagtagggaacatttaaaagttcagaaacaagggctgatccattgcagtctgcactttcatgttccatgaaaaccaaaaaatcaaaaaactcactctattgaaatcatctctttcctggtttatctcttaaactaggaaatagttggttcctaggaaatagttggttaaactaggaatagtttggttccctgtgactcttgcctttcatatctatgtctacagcaactcagtatctagtacatcacagggactgcccagtaaatgattcagtgggtcattccttttttttttttcatgtctaatttttgttgatcctcactttgtgatccacaattattcccttttatttttctcttcttgagtgtcacatttgtgttatgttttatttgcttatctattttgacaaatgttcacatctttttaaaatatacatatgtatgagacataaaagtgcaaagaagaattctactcaaccagaagtaacccttgctagtgtgcatttatcatacgacattctggacaaggctctgtgcatatttaaaatgtgtagtccctgggtattcttctggtttctttctgttattacctctcttaatggggtgggaaggagtagataaaattctacctagagtagctatttgaagatgatgcttcaaatattatccccaagtggtgagggttttgtcagggatttggggaggggggtgaggggacttgcacttgcctcgggacagtctaaaattccaatttaggtttgtcatctcaaatacactctcacaagtctgctacgttctccaacttaggggcattgctctgtttagagtttggtttttgtaaaagttaaagaaagaggaaagaaacacaaaaagtggcttaacagtcaaagacaggtttattttggagaacaaacctgagaggggtttctggacgatttttttggtgaggagcactctctcttacggtctaagagtatttattggtgagagaggttggaaagtttctgtgttggggagaagtttatggtggggttggaatgtctctggttagagggcaggttatctggggtctgacatctctctggccggaggggagggttatctcagggctggcatgtctctggtcaggaaggggtttggaatgtttctggtcggagatgtcatttgtggtttatggtcatgctgaccttagccattaggctgataccgtttagatttaggtggtttttgatcaaggtgaactttaaaatggcagtgctcatccaagatggcaatgctcctgctctgtcagttttcagggtgggattgtgactcacaacaatgttctgtgatataaagagatggccattgctttcccaccctcctcattctcttatatccaaccatctccctgtgctaagaagccagatcaaggcaacaccaatggccctccagcaaggttccactgtacgacttcctctcctgttctaccttgtggatttgcatctaaaccttgtctggctcccttcatccctcagaccactttcacacttctaaacttcatccacattttccacagagtcatcacattgtcttttcagattcattcactcacttttagataagtctgtacttgtctgaagtctgaggacataaatatcagctttaatcatcctccatgattttgatccaaatttgagtatgtgatggagatcatttgagttttaggtttgaagttagtttttttgtttttttgttttccaccacataggaaaagttacactctcctcgccttctcccccctcaaccccaacatgtgtctatatgtttagtgacacttaagggaaaaaagtagaagaaaaatggcctagtgctgctatttttcattggccgtccgtcctaccaatttactttgaaatttgtttgaagaatgatgtactgaagaggaaagatgaacaacagcaaaaagtcccttgttagttatgctttgctcacggaagaccctcattttggtgtcctatgacctgcagttcagttccgtttctctcctctgagtgtccatgtttagcccacctgcctctgcattgggctttatagcctatttgttgttgagtagtgaggattacatcttgttagaaatgtaagctgaaaatagtcacagtggagctctagaatcaactttcttggcaaaagtgctaaatagtcatcttgactctggtaagccagggatactattactactaataaccattgcggcctactgagtgcacacaccgtgccaggtagtctgctaagggcttcagtgcattttaatcttttcaccagcccaggactctgttgttttttgtttttttcttaagtaaagaatttttaaaataaagaaactgaacctcagaaagcttagataatttgtgctagttcatcacactaataagtggtagactctctctgtttgactccaatgactatattcttgaacactatccaaatgaataccaaataactcactttgcaaacatttcatgtccattatcacctcattaatttgttcattttattgctcatttccagaatgctcttgccactccttttatcataaaacatcccatccattcttaaagagccagcttatatctaatcttgtatcttatccttcccctaattatccagcataaaatagtgtttctgcctctgttccccataagcgtgtctgttttaacacttatttttaatatatcagttaatgttagacatctatcacctttcggtctcagagttgtaccagttcccatctcctactgtatctggtaaaggacagctttttgttttgattttcagaacttgatttcaatatatatatatgaaaagaggggacaagataaaataaaaaaagtaacatttgatataataatgtctaagtcaaattctaggatttactaggtgtgttatattagaaaatgcaacagggatcactaaacctcaatattgtcttctgaagaaattatcttcataataaaactacttgttttacctttgattgagtttttaagagaaaagcaaatacaataataagtgatgaagtattataactcataatgtgctatgttactgtattttgtcgttgctgataaaaatagttgattgatgactttttaagtgacttttaggcagtctagagtgagcagtaaaagaaattaaagctgaaacagtgaacctaaaattctgttgtagaagttgttaataactgtcttttcttcagcagaagttacctagttctacattgcctctggctttttgccacccattaagataaaaagctagaagataggaactaggaaatagtagagataaggtgaaagtctagcttgaactcagtgaagcaaaccaaaataagcaaagatccctcacttggagatgtggtagaagacttgtgtgaattattacagtgactaactacacagaggaataaagttatacatataaagttaaaagatatgtaatatgagtgctcctgttgaatcagccaacatgaattcagtcatatagtcacaacagtgtgcatcataaaacagtatcataaatagcaatgagttataaatggaattgaccaatatacttagtgagaccaatatacttggtgagaaactacactgtgttattactttgtacaattataaaagataattgcccaatataaataataactaaaatttaagaagaaattttctatttttaatctagattataaaatgaatgatagttatgtaaagtttatctatttttctttggaaggaaaccaaatctggagacataataataatttggtatcatgtaatgcctaggaaatagtacatatctaataaatatttgttgagtgaataaatgaatgacagccactgtaataagttaaaaagtttttgtaggtaaaagacaaggctgaaacaatgattctgactcataagtggtgggccattaattatatacatatatgcagagacacacacataaactttaagaaaataaaattttaggaaaatagataaaatgtcaactagtattttattgttctgctaaatgaatttgttgtcattcatgacagtgtaatgattccatcttgtgtctttgtgtaggcacatgtgtgaaccactttaatccccctctttttaattttctaacattaaaaaaactatttttttgtgtccatgagacatacagtttcaaaattattttatgaaattgaatggatagtataggaattaatgtcatgtatatcacagtgtgattccttttaaaactgaatgagaggaagttaaggcatgcctactggttttcaggggcatctagtaactttgagttattaagtaatgaaatgtgagtgacggagttcaagttcctattaaacataaggagaaaaacattcatatagtaggtttaatcactgttactttacactttgatgtgcaaattaaaatcgagaacgtgtcatttaagtaggcttaagagttattcagaggtagaaatatgacagcagctgacctttattgttatattttactgcaacaaaagctctgtggatgttacgcagtttctagtgtgaattgtctgaaggtgataaaagaattcaaatatctggactgaggtatatattttaggagatagaaaaatcactttcttaccttcggcaaactttctcattgatcacaagagtcaaagggcaatcttcaatcctctaacttacatcacatggtaaactacttcctttgcaatccataaaatgaaaggtacaggtgatattctgcaaatacaataagaagattctgttgggttacgagcgtcttgtctgattaatttttacattccctggacctaaaataatacctgttttgaaacagtagctccatgagtatttaccgaggtcagcagaatttcattaactgaatttaaatgtagtaattgaattacccacacaagtaatttagtttgagtagttttacttagctaatagtggcaagcataacattaaaatgggcaaagaaataagcataccagagttctgcaagcattttctataaacagccagataataagtattttaacttacgagggtttaaaaataaaattaaggatattatgtaggtgcatacataacaatttaaaatgtaacaatttaaaaacaaaacaaaactatttgtaactcacaagccatacaaaaacagacaactggcactttggctagtgggctacagtttgcccttccctgaaacagatttttgtgcaataaattcaaagattttgttcccgtagttgacctaaataattctgtagatttggtcctccatgatgcaaatttacatagacaaggtgattagacagatgatggattgaaatcaatttcttgtgagttaaattaaacaattgaaatgaattgttttattatgcctttgtctctgcatataagttagcaaattctgggagccaagtggaaaatgtggataaaaggatttaagcatgtctggagcccctagggagaatggcatctttggaagaaaaaagttagtggagttcaaagtgtgccttagaaaaggatagatttagatagaagatctcatccctggtaacaggaggaaggtcatatgcagatgggctttgggaggagtgtgagggtgagttagttggagcaggtgagggcagtggagctcactctactaacctggcagaacactgtggtcctcaaggcctgatgtaagtgcatttagctctgggagacattagacacaagtaagatctattcaggaaaatgttattacttgttcccaaaaggaattctgcaattctgtttggttttttttttgttttttttttttgatacggagtctcactctgtctcccaggctggaatgcagtggcactatcttggctcactgcaacctctaccacttgggttcaaacagaaattctgcacttctaactgaacaaaatatgcaattaaatacacatgagcaatggaaataaattaactttagtcaattcatttctgtagttaaataacagtagtttatggaaaattagtattgccttatcaaaggagccaaaagccattttcaagactgtaaaacattttatatgtagtagtattaagtggtgtaatagtaaaatttaaaagaaaaacaaacaaacaaaaagaagatgagcaagcctcttgatctttctgaattttagcttcttcatgggtagggtgaagatgtgttacttaatgtttgccaatgtcttatctatctttacaatgccaagaagtcataaaatttttatgttaaatatctaaagtataaaattactctccaaactacccaaggtacacatgtatgtactcatgcaacacttagacccatagttcccaaactatgtgtcaaagtgccttagggagctttaggcttgtgggtcatacaatttcttacaaaataactcaactctgtagccctaaagcagacgtaaataatatgcaaacacatgagcatagctgtgttttgacaaagctttattttcaaaaagaagtggccaacacccaagctgtacttcactgaactctggtatacagtatatacatatatatttatatatgcacattaaatatatgcgttgatatgcgttcaagcaatgtacaaatatatgaagtttcctaattgatgaataaaatgataaacacataaatacttaagtgaagaatggagagaaggaagacagtaggtagattagagatagcctgagtcaaaaggaataaaagccactagtcagggaaaagagcttaatacattcatatacatatacacatacatatacacacagatgctcctcaattttacaatagggttttatcccaataaacccctcataatttgaacatatgatgggcttatcaggagagaaccccatcataaatcaagaagtatactaaatgcatacacttttgtaccattttaaagttggcaaatatatgttgaaccttcctaagttggaaaatggtctatctatacatgtatgtacttgtatatttgttctctgttcctctatgaaatattgatgacaaatttgttatttatttgtcgtaacagttcgtctcagatgtgatagatacacagtgtgtatgattatgaaacttgtaaaaagttttaagaataaataaatcaataaacatccatttcaatcctgatagtaatgaagtttaaactcatttccttggtactgtctcttaaaaatagtaataaaaggttttgcttgagcagaatgactgcctaatgtagacattacactcttgtgaaaataaccactttgataatacaaagatagccagtctggtagagattaaactgagacagctaagcacctgtgttgcagacattcagttggccatgttatcaagacccaagatattgtaacaaataaataaagtcatagtagtaataataataaagctaatcaggccaacagaatgccccccaaatttatttccacttaataaatgctcttctaacctcatattaaaaattgtgtctctgattccagttaaagaccaaattttaaaaatacagagactccaaatctgattctgtattgaattctaatgtgaagatctttgctggaatgcttcaaaggagattagaaatattgattatcatttaagtactcttagatcaccaaaatctcactaatgaagaatttctttatatcatgactgtgattggctagttaacaaactataaaatgaacatgtaatacattaatccctcaataacatgacctggaatccctacattctaaaaatatctctttgttttctgcctgtatttgacagaaatacggcattaatgaaatgttcagttcttgcttaaagtacataccggcataatttttcaaggaatgtagggcttcaacacttcttaaaagtcaagtttgactcttcctaggatagaatatagaggtatgattaggtaaccttaagtgagagagagattgcacgtagaaaataaagcttattctgccacctagaacagttttttgaatagtccttgttatgtctgaatcttgtcactcaggtctcagttgaaatactagctttctacagagatcactttttgatcactgttttaggaaggggtctttagaaattagattttgggacagaaatgggtatgtaggaagcttactggaaattgccttggaattaacacctgtagtggggtgaaggaacctggactggcagagaaatgtagtcaaaattaaggccacagcagattcatctttttcaccaggagctctggtgctggaatgcatctgtagaattattccaactttccccagaggagtaggcattcatgtccccatatcagtcagccattggatgagggatgggtgcacacgcatggttgtcttacctctccttggctgaggacaattcccagagcaaggctctgactgagagctttcagccaaaaacactcccagaagttgggggagtaacagcttcagtcctaatgagagaaatagatggtttaaaatggcatctgcaacattctactccctgcactattcagatacttgtgattcatatacagtcatgcatcccttaccaacagggatacattctgagaaatgggtccttatatgatttcatcattgtacgaacatcatagagcatacttacggaaacctagactgtatagcctactacacacctagggtatatggtatagtctactgctcctgggctacaaacctgtacgacatgttattgtattgaatattgtagtcaattgtcacacaatggtatttgtgaatctaaacattaaaaaaaaggtacagtaaaaattcagtactataatcttacggcaccaccattgtataggcggcccatcatttatcaaaacgtcattatgcggtgcatgagtgtattaagttctggaatcagctcctctagaatccctggaaaaacacaaaaaggacagtaaatgagacaaactacagcccatgcactatagctagtcagaagtcataaatgatattcattgtttctctcttccattatgatttctagattcacctttaactagtgcttctgaagatctgggtagctactaaatgcagaatgtcatatctgcagggtctgggttcttagtcatcataaacttctcaggccttacctgtttctcttgtccagttaccacaaaaatttagcaacagagaacaaagagatgcctcaagaatcaccaggtttaggccaggcacagtggctcatgcctgtaatcctagcactttgggaggccaaggcgggcggatcacttgaggtcaggagttcaaaaccagcctggccaagatggcaaaaccccatctctgctaaaaatacaaaaaaaaaaaaaaaagaaaaaaagaaaagaaaaatagctggacgtggtggtgggtgcctgtaatcccagctactcaggaggctgaggcaggagaatcacttgaacccaggaggcggaggttgctgcgagccaaggttgtgccactgcactccagcatgggcgacagaacaagactccatctaaacaacaacaaagaatcaccaggtttattatatgggggccatgcaaattcttccttgtccccattgtgaaacagcagccatactttctcccggtgatcaaggtagcatctccaggatgactatcactttatttgtctcctggagaactggtatgagaaggtccaagtgacaaggtagcagctatagcttaaatgttaatggggcttttgtggcccctcaaggtcaaggacctttaaacctctagaaccaagaactgtaaggacagaaagcatagattcctaggagttcaaggcagtgagctatgagtcactggaagtaatgatacacagagccattacttagctcacatattcatgtattatactgttgaggatgtactcatacacaatggtccctcatgtagagtgcatgctgtctcctggaggatgggtcccctcagtgtgttatttccaagatggtgtctctgttgtgcctttacaaggatcttcttttgctctgtaaggctggcagcttctgagtgttgtagggtgtgacagagccagtggatcccatggatatctgccacatctcctttgctgcagtgtgaattacttggttcaataagatctaacatatgacataaatgttgatgtagtaagcagtctttagtccattgtacaatggttctgacagagaccctgtgagtagaaaaggcaaatctattcttggttatatggatgatgccactcaagatgaatttctgctctttccagagtgaaaaatatttaatacaatgaacgtgccaccaagtggctggttggtcttctgaaaagatgatgtcatatgggaggtagagaacttgtctctgttggctgcatgcagtggttcacacctgtaatccaagcactttgggaggccaaggcaagaggatcacttgacatgagttcgaggccagcctgggcaacagggcaacaaagatcctgtctctataaacacccttaaagaaattggccatgcatggtggcacatgcctgtagtcctagctacttgggaggctgaggtgggaggattgcttgaacccaggagtttgaggctgcagtgagttataatcttgccacaggactttagccgctgagtgacagaatgtgaccacgtctaaattaaaaaacacacacacacacacacacatatgaaatatatataaaggaatatataagaattatatatatacacacatatatttgtatatacgtatgtgtgtatgtacatgtgtgtgtgtatgtgtgtgtgtgtgtatatatgtatcaattggtctctgttattggcagcttaggtatccaaagtggcggtaactaagatggcatatgaaatatgctgactgacatgaactggctaacttaacttggatgatcactgcctcttttaagttgctcttgggggagtattaacctgtgacacaaagatgttcacaaattatgatcattcccatagatccatccacatatctaatttccatatctcctttttctcagtcataatgtttatccttccaggcccctgaacaattagtcaattcaccacagtccatgagtctgtaaacatccttatcttgggccacttttctttccacaccaaatggaaaactgcatcacttgcagctctcaccactgggagaacttattcttacagttgttttttagggtcacttttagtttttacccacatgctgagccaactcccctgtgaaccaagctcagtcactttcctgctcggcccaccagtcatatttgtcctcatcacgcagccacaggtatgtgctgtgggagggattttgatgtaatagtgatggatgacatggagtctgggctacctgattacacatcatagttgtgccctctatttctgctcttgctcaatcccaggtgtgcaattccatcttttgatggatttcttctgcacctaccccaccttatggctggatgagactctcagaaattcatgatggaaatatctggttacaaaatcacttgatatctcgtggttggctgacacatatctcctaataactgcttttggtatatagtataattctccagtgaggtggcatgatcttggaccagaactctaggggtgtacattgtgattctcctgtcagagtttgccataaactctgcattctttcctaccactgatatatgtaataatatgttatcttttggatcatacggcccaagtagggaagccactttctcctacaccccctacgaagcatttttcctcactagttttcactgaaaacaggcagcctttgctgtcacacactaatgggtagaatgagtattctcaagtgtgaaacatgctgtctttagaatccaaagtagtgctgcactttgtcttttaatttgattggattgtttcaacatgccaaagataactggactcctaaaaacatcactgctgtggttggcccttaaatcttcatggggtttatttacactttctaggccacacatgtttttccaaggcctctaacgcacttgcaacgtcttgctactctagttcagttaatacgaggttatcaatacagtggaccaatttgcaaaatatttgggtacctgaaccaattctgcaaattagttacatggtccagatttcttctgactaattatgaataggagaaatgaggaagttaacatagagttacataaaaaagtaaacgtacagtgggaagtattagtctgctagggctgctataacaaaatattataaactgagtgacttacacaacagacatttattttctcacagttccggaggctggagagtccaagatcaagatattggttcctggtgagggcttccttcctggcttgcagacagctgccttctcactgtgtcctcacagggcagagagagtgatagagagctctggtccctctttctcttctttcactcacaggggctccaaccctcatgaccatatataaacctaattacctctcaaaggcctcacctccaaataccatcatttttagggttagagtttcaaaatatgaatttgggggaacattaacattcagttaataacatgggggaggggttttttgtttgtttgtttgtttgtttgtttgtttttgagatagggtctcactctgtcgcccagtctggagtgcagtgatgtaaacttggctcactgcaacctccacctcccaagtttaagtgattctcctgcctcagcctcccaagtagctgggactacaggtgcctgccaccacgcccggctaatttttgtatttttagtagagacgaggtttcaccatattggccaggctggtcttgaacttgggactttgtgatccacccgcctcggcctcccaaggtgccgggattagaggcgtgagccaccacgcccggccatgggggagttttggtacagatttccttcattgactgaaaaaaaaaagagtcataaagaaaaaaaaaactcctttttgcagccgcagccaccatttctccacatcctgtcctctccatctccttttctcacatatagtgacagtgtctgaagccgtggcagccactctgtggctatgtaacaacaaacccaaggacaacagggccaacacactgaaaactgtggaaagatgataatctcttgggaccttgatgatacctttaaattgtagaatcttcctatagttcttgttatgttagaaatatttcttttatttgagctgaaaccatttggattagttaattatagctgctataaaaaatgaactctaaaacagaaataacttaatacataaaaatctcatctctctcttacaacagctaaaacaggggttttcagttgggttattctccttcagacaatgattctgattctctctttttttttttttttttttttgagacggagtctcactgtgtcgcccaggctggagtgcagtggcgcaatctcggctcactgcaagctccccctcccgggttcatgccattctcctgcctcagcctccaaagtagctgggactacaggcacctgccaccacgcccggctaatttttttgtacttttagtacaggcggggtttcaccatgttagccaggatggccgcgatctcctgacctcgggatccgcctgcctcagcctcccaaagtgctgggattacaggcgtgggcaaccacgcctggcctcagacaatgattcttgaaccaagtcttctttcagattttggctccaccatctccaaaacttggtttccagagttaacttggatatcacctcaatttctaattttaggaaatgagaaaggaatatagatgattatgcatgggaagtttttaatggagaaagcctaaaactaggttgtatggttactcttaactgcaaaagagaattcaaaatcgtttttccatgaagaatcagaaaggggaatgactttattccctctacctagaatagtgcctgactgatagcaaaaattcaatgtataaccatttaatatatgaataaattagtttgctttgctctgcttcccaaccaggaatgtactggttgataattacttatccaaaatgcttaggaccagaagtgttttggatttcatattttttcagatgctttaatatttgcatatactgtacctaatgagatatctttggaatagaacccaagtctgaaatttatttctgtttcatatacaccttaacacacagcctggaggtgattttatacaatatcttatacaatatttaaaataattttgtatgtgaaacaaagtttgtattaagtatttatacatggaattttccatttgtggtgtcatgttggtgctttaaaattttcagattttggagcatgtcaaatacatatgtcttttttttttttttttttttttttgtaagagacagggtcttgctctgttgcccaggctggagtactgtggcatgaccatagctcactgcagccttgacctcctgagctcaagcaatcctcctgcctaagcctcctgagtggctggatctacagaagctgccaccacacctggctatagacctaaacatatgtcttgcaaatgtttcacatgaccatagagtgagatattacttacatccatgaaaattctgagttctagagaaacaattcaaatggtgctgtttattattgattgattcataatttcatttatatataggcagtagcaatctgtctacagcctccttagtgataatatatgtgatcttccttgttccttcacactgagtaaggtttcatccctgttttttgtaagaggtagtctgtgttttttcctttgccaataactcagtgagagaccactgccctccaatataacatcaaaagtacctgatcaactaagtcaaaaatttacttgatcttctcttatgttatgtaggaaaaaaaatctgttttggccaggcgcggtggctcatgcctataatcccagtgctctgggaggccgaggcgggtggatcacgaggtcaagagattgagaccatcctggccaacatggtgaaaccccatctgtactaaaaatacaaaaattagccgggcgtggaggcacgcacctgtagtcccagctacttgggaggctgaggcaggagaattgcttgaacccaggagccagaggttgcagtgagccaagatggtgccactggactccagcctgggcgacagaacaagactccgtctcaaaaaaaaaaaaaatctgttttataaaatcaacgtttgcttgaattgattgaatttccccatggttacaaggaaataacctagtttgccaaagatgactcacagagtttatactttaccgtttgtctttagcacatactcatatctaggtctacctctctattgattattcttccttaaaatctttttctctgagatgattatgtcatgattttacacatccacatgtatattagtctgttttgcattgctataaaggaatacctgagactggtaatttataaaggaaagaggcttatttggctcatggttctgcaagctgtccaagaagcatggtgctagcatctgcttctggtgaaggcttcaaggagcttacactcataggaaaggaaaaaggggagcagatgtgtcacatggtgagagagagagagagagagagagagagagagagaggagaagcaggactgacttttttgagcaatcagatttgatggtaactaacagaccaagaattcattcattaccatggtgacagcaccaagtcattcatgaggagtctgccccgatgacccagacatctcccacttggccctatatccaacactggggatcacatttcaacatgaaatttggaggggacaaataccaaactatatcaatatgattctgcacatgaaatgggttagcatagttagagataattaactaggctccaagtctattaagttaatataaatcctaggcaaataaattatttatattttctaacaaaatatgtattgaagctaagcaggcacatctgatgaatcattcactcttttgtttgttgtttctttttaattacacaaattttcagtgattatattgaaaatcatgcaggcaaaagacttcgaataaacaaatgaaagttcttaaaagaaatgttacatcctaatggcaacacaaaccttctaatttttattttttaatgtaacttagaggctttaagtcacaggtcagattaacttctgatgtaacccagctatgcagactgtttcctactactgaagacatgaacatacatagaatttccatcacctaaaactgttttggcatcattgtgatggcctactgtacttttgcaaattactttatcatccttgctgctttgctattcttcttgtcaatgccatgtctctgataatgtcactttgaacagtgattgtgtgaatgctcagaattactaataatttccacagacagtatcttgtagtgaggtagtaacagaatatttttccattctgtgtcagtgtcttacaggactgattttttacaagatggctttcttggcatccaatgcaaggactctcaccccaagagaaaactttatgcacgaattagaaatgagggaataaagtttcttaaactaggactgcatcagaagatgtgttctctctgtctctgtttttttgtttgtttgttttttgtttattgagacaggggtcatgcttcgtcatccaaactgaagtgcagtggtgtgaacatggctgatttgcagcctcaatttcccaggctcaagcgatcctcctacctcagctccccgagtagctgggactacagcgcatgccaccacacccagctaattttacatttttttttcttgagacaagagttttgccttgttgcccaggtctgatctagtcctgagctcaagcaatccttccaccccagcttcccaaagttctgggattacaggcctgagccactgcacccagcctgatgtgtactctcttaaaacgttcttaaaccgggccgggcgcggtggctcacgcctgtgatcccagcactttgggaggccgaggcgggtggatcatgaggtcaggagatcgagaccatcctggccaacaaggtgaaaccccatctctactaaaaatacaaaaaattagccaggcgtggtggcaggtgcctgtagtcccagctactcgggagactgaggcaggagaatgacgtgaacccgggaggcggagcttgcagtgagctgagatcgagccactgcactccagcctgggcgacagagctaggctctgtctcaaaaaaaaaaaaaaaagttcttaaaccaacaattttctataatcactaattaatgatgatcatcataacttcaaccacggtatttttaaaagagatatttaagagacttttcccctgataatttttatattacttaatttgtgtattataacatgaagggaatagggatcaccgatttgacagtctattgttcagtctaattaagtatatacaaaactgaatttccttaaaatactgaaactcaaggattaaaaataaattgtttagtaagagaaaggagaaacaagaaagccgatgggaaagacaataaagaaggaacaataaaaagtttgtgggattggttatagcttttttttttttttttttttttttttttggtgctagccataagatttatcatatgtcagataactagaaaatcaaagcctatattttaaaatccaggagccaaaatttcgacagctgttttttaaacaatgactcagattagctagctagctaggtaggtaggtagataaatagaagatagatagataggtataggtataacaaaatctttttcaatttacatcacgagtatcttatgcattaccatcttattataaatgcaaaatgtactttaaaatgctaattttgagaaagataatgactaaggcaattttatagtacttgtgatttgttccgttagtatattactattacaatttcgaaagacttatagaacatttttagtcagtctttttaagaaaacctgaatgtgcaaaatttaaaacaagacattatcttttataaaagaatatattaatataatctcatctttgtttgaagggaaaagacatcaaataacctttatttttttccaaattcatgaatttatacatatttgatcagtataagtttttgagattacttcacataaaattaatcttttcagaattattgctgttaatttgatcacccagaataccagtgatttactcacccttttcatggtactggttttcactttcaccagcttacttttctgggtgatatatggaccctccatagatatttacccctagaaaagaatctacctattcctaatatgtatgtatctcaacttacatagatgaaatatgcagggaaaggagattgtggatttgtaaatctggagtagaatttaaaaaatcactgcacagatagaccaaagtttgcaaactcagatgccagcagaggtttggtaggtaatatacaagaattgaacagccatatataaaccaatatattggggtgaatttgaaagcctacgccccacgcaaaaagagagcacattatctacaaagctcaagcaaattatttccttgctgaatgtaaaatctatctttccaacatagaagaagtcagaaatccaattctttatgtcaactcagtctcagttaaatgcaggtaagcaatttgaattactgtattaaacaatgtacaaatcatacaaaacaaatctcttggagacatttggcctaccagtaagccaatttaaaacctgtgtggggatctagtgcaggaattacagattttctataaccaaagtctgaaaaaaaaatttaaattgaattttagcttcatccaacatagccactttttctaccattacctattatttcattcctgttagctttaatcatttacctgcttgcaggtcctgaatgaccttgagattgtaactaatgttggtccaaaaatctcactgacaatgttattgcggcatgatcagtgaaagagaagttgggttcatggttgagaaacagggatgagaaatataggagactggttgaatggaggtatggtggaactatgacaatgcccctgctgtatcagatgtggcccctgctgtatcagatgtggcacctcctcatccatttgagcagccatagctatgtagaaaaatcctgaatttatgtcattaaagatgtttgatgttaacataaactgatcatttataaagtaaataatagggatttggcgtgtgtgtgtctggccttgtcagaagtaaacaaggagaatattcataatcttactcaagtcatctggggaaggattgccccttgtagtaatacttttctggaaaacaaagaggtttggggatttcttaaccctaatgctttctagaatctcagggttcagttaaaactcaacattggcggccaggcatggtggctcacgcgtgtaatcccagcagtttgggaggccgaggtgggcagatcacgacgtcaggagatcgagaccatcctggccaacatggtgaaaccccatctctactaaaatacaaaaaattagctgggcgtggtggcgggcgcctgtagtcccagctactctggaggctgaggcaggagaatcgcttgaaacaaggaggcggaggttgcagtgagctgagattgctctactgcactccagcctggcaacagagcgagactccgtctcaaaaaaaaaagaaaaaaaaattcaacgttgtcaataaatatctgatggtgacgtacaaagaaaaagctagagagaatttcagtttaaagaattgtaagttctattaaggagatattttttaacacagctcaaggaaatattatccattcctggaatacagtggctctcaattggaggtgattccttcacgctgaatccttggggacacctggcagcatatttggttgtcacaaatgaatgtggaaatgtgactggtatcaattggatagaggccggactttacactaaacatcctacaattaacagagccccccgcaagaaagaattattcaccctaaactttcaacaatgctgagcttgagagactttgctgtagggacaaaaacacaagtttgagaatttgataattctctgccatcttcaagctacatggattcccataagtaacttagcaagtatgagcctcagttttctaatatggtagttgggcaaaataaaatatatcaaagaacttgtgaggattagtgaagtaaactctgtgtaaacacctaccacagcgcctggcaaaaaagtcaggaagaaaataataattacctctcgatttcccaccctcctttacatcgacttctcacttcagtttctccagactaactttttggtgatcaaccatttcatagtgatgacgaggaaagtctaaaaattctgggtttggaagtaagaaaaaatcagagcttttgtaccaccaggatcagttttatgatcttaggcaaaccaacttagtctccgtgttttagttttcttatctgtcaaaaggacaaaaagacattttcccttgcctgtcttggagatgaaaataaatgaattactaggaaaaggagcaattttcccaggagaagtgatctataaatgacttgtgctttagcagtgtatgaaagcactttgagaagtatggacattatctaaattaaaggatttaagttattttactataagttacattatttaaatataatgtatttaaatagttttttgatgtgtgctatttattttttaagttatattttaaattagagaactatctatagcattaaaatatatatagatgagtctcagattaagactataaaatttctcacataccaatacacatttcatctctgaatagtctttcttttcatattttctcagttttgtttcttcaggtagttttctttatacagtttaaataaatattttgatttttttcccctgatttactagctttagatagtatcattttattttacttttcaaaagtttaatgacatagtgacttacccaaccatatgttctctttcctttcctggagcttgtttatattggtattttaaatttgtaaagtttacaaatttcacatttaatatgtagctaaaattgtgctctagctttactataggttgattttaaaaatataagcacaataaaaacgacatttatgatttcaaaattatgtgaatatgcaaaccaaatactgaaattgaaactgtggagaaggaaacgcaatcctatggcactaaagttctaatgctcaaaagataatgtcccaagcatacacaagtagtagcttttcctttcttatgtgcttatgttttctccacacatcttcggtgaccactaactcatgttcataatcatcctctcactttctttcttgaaggtgtttttgcttttttttttttttaaattacgttgtatagctttttaatgctcattggtttcccagtaagcagactctgaaacaaagatttgtgttcaggaaattgataggacattgattggattttgttcctaaggatcaacttggtgggggataaggggagacaaagtgagattaaacaggggagcaagattgagtaaaagaaaaagctggcctgtggaacactcataacaaaggcctcaactgatttcacagggaatctcttgggtggagatgcccctttgtcattgttccagctgccacaagggagtaggcatggggtgtaggttccacccaggaggcggtgtgatcttgggcaaggtgactctcgtcaaccaggacaatattgggatggtgggtggagaggaactcagctgcaaactttcagccaccaatactcccagcagctgggggaaggcaagcttcaggcctgaaatatgtgacagagcagggaaaaattcaggccacatgtaataggatccatccagagcaatcctcaagaggtagatttctcacgagatccttgaacatttggaaaactgggtttagttttttcattatccttcactggtaagttaatgaaaagtagaaataattttcctcaaagtgtttcttcattgtctttttagtactcagtgtctgatgggaagtcaagcggccaatcagattcctgctgtgtggtgtacatgttttactttttctctctatggaagattgaggaaagtttccctatcctgggagttctgaaacttcacaggatttggagctttttaaaattctaatcagcctttgtatgtttttaataagaagatgtgccttcccttctctgaagataatctttttctaatttatttccttgtttctttcattcactatcacagttcttttcacctggaactcttgttagataaaatccagaatattgtatattttttccattaaaataatcttttcctttattattcttccctttgtcttttcttctttttgtttcctgggacattttctcaagttttatcatccagatcatcagctagatccttaggtatattcattttcctttccgttctataaagtaacattaaaaatttttattttacattatttttcttttacttctttttatatggtttctttataaacatttattgttattttaattgacaaaatttgtatatatttatcatgtacaacaagttgctttgaaattctgtatgtatacattgttgaatggctaactcctgctaattaacatatgtgttacctctcacacttaccattttttctgataagaatatctaaaatccatcctctcagcagttttcaaaaatataatacattgttattaatacatactgcatgatctcacttatatgtgaaatcaagaaaaaagttgaattcatgaaagtaaagagtaaaatggtggttaccagaggctgaggtagcggggaggtgttggccaaaggatacaaaatttcagttaggggaaatatgttcaagagatctactgtacaatttggcgactatagttaataattctcttttattttggcagcattctcttcttttatgaatacaagtgcttgcttttctcttaagtctgtgctgtagataatttctacctctgctttagtcagccatatgcttccccattctggtattttcgttcacatttggttcatatgtttggtggtctatgagtcattatttcatgaataaaaacacaactagtttaattgatataagttgtttgcataggtttactctgcagatacataggtctggttcccaaagtgactaagttacgtgtgtgtgtgtggtatatttgtgtgtgttgtgtcagtctggactaaattttatataatcataacatgtaatattatatatcaacatatataaaatatataacacatacaatatatgctgtattttggtgtttgttttgtatgttttacttgttatatataccatatattatgtttcatatgttgtatatatgctatatatatatatacataatgtgggtatatttaaatgtgtctatatgtgctttttaaagtctaaatgttccaaatggttcttttgcccccaaatgtgtcttctgttagccttaaattctcattattttaaatattttcatgaagtatatcttagacacgttttttgctcttttttgcccataagaatcctcctccccagtcccaccccttggcccaaggaaaacacttctaatctgattagtgtgaagtcaaacaatagtgaattcgtactcactagcgtgcagattgagtatgcattaaatcatacatgtccattttctctgtctccttggtacttacataaaggtggaagaggactaggtttccagtattcgccatattatgcttcatctcctctccacttccttcatctatgtgaaaagtccaagaataataaacccttgagatacatattttggggcaacatataacgttctacataggctgctcaaaactggagtttacaagagcggtgtattaagatatcaagaacttgtgcaacccttaatattatgttttggttcttatttagctgttattctttttgtgtattgccctattgaaaactgttataattgatcatacacattgagtcattcttgtcatatccaaactgaaacagagtctagaagctgggggaaaagcactcagcttataaaacattcctccaagaatgtaattctctgcaagtctgactactaaaattgcttgttgtaacccgaaaccagttttatctacagcttctgagatgacttgctgcaatgctaggactaattctgcccaccaccattgctcaccaatacgaacttgccagctccccaaacacttactagtgtcagcgaactttctcaaagaacagtatataacatatctccttttttataaaacctctagccttctctttgttctttggacctccagaatacccccagtccatgtgtatgcctcaaactgcaattgtttcttcacaaacaaaacattaaatttggagatttatctttacatatttattctgactttgaaaagacatagaaaaagagaaagtatatgagcatgcatttgatttaataaaagtctcactcctaattcctaattcctagtcatgcccattcaagcattctactatgtctgcatgaatccatttaaaacagtaaatattaatgaagaaaaaattctcatttatcaattagcacccaccaatatttattctcaaggagttatattcacgatctagattctctacatgtgccaccaaacaccccacttttaccgctcctcattctgctcaggctcctgcattcaagttctaactccacttacctttgtctctctaggagaaagtaaacacacattctaacgcaagtgagtattttttggtactgataacattgaaaaatgtccaattcaaaatataaaatttctttcacatcattttatgtcacactagtaagaaatactagaattagtaacaaattacttttcgcctgcctctattctgattgtaacttaccaatgtgtttctacttcgagattgagaagtatagcattaacacgttggaattaattccctggtttaactagaaaactgccaacaagggaagtgggacataaatagtttgataagaataaagaaaatccaaagcgttacactgcctgcaaaatgaacaggtacctgtacctgttcacaaagtgaacaggtgagcagtcatagggcactatgctggttcattgcctaagacggcacaggtaggcttgtctatgtgtatgaccgatatgtgtgtgcacatatccgatatgtgtgtgcacatcggagacctacggggaggtttgcaggaggtgttatagaaaacggttgtttcttcatcattttgccaagagctcttgtcctccaacctaactgtgtccatacacagtggagcattatttgagtaaatgactgagctctgggaaatgggtaaatgaccccaaggcagaaaggtgtaaataggcttgcctgggcttctgtgtgtgttactctgctgctgtgacaaccattgctagcataacaataagatccagggttacctttatggttgtgttgagttgttggggaaaaattagaagagaatttggatcatctattctcaggagacccgtttgaatcatcaaagcttaatgtcacttgtctctatctctttcaaccatgcattccacacaccaatttgcttaaatagtggatgcacatgccaaatctaattatcccttatctcacaaagtcattaatcattcccatccattattcattgactaccaatagctactccaatctttagtacatgcaacttcagtgcacattacaataccctgtttataagtggcatttatctctgaaacgtaccgcatggcatttttaagttagatgaaatattcctggcataaaaactggtggtgtgttttatggtgttcttctcgtaatccataaaattagtaatataaaaagaaaatgctcaagataattgtgaagctgcagataattattcatggtgatgttaattagcacagtgttgtgaaaatggtgcacaacctacacagtattcagggatcgcaaagtactttgaaaagaggttgtatattatccaaaaaaagcagaaggaaagtggtgtgagggatagattagcctagttaaaagacaaaaacaatgtgaaatttggggtaactgaagcattctctagccatttaatattctcaactgctgcatactacacaattcatattgtcccacatatactttaaccttttgatttcctctaaaatatttgaggggtacttaaatagacacaatgattaagttcaaatctcattttttttcccaaagacacttacacagtctatgggacagcagagatttgaacacagatctcttgatggcaacccagagctatttcgttaatggatttattggatgaaaccaagtttttttcagtgccttctacataacaagttactatacacagtgccattacatagcattttcagaagtctattgaaaacgctaattatttatctatctttatatctatattttcatctataacctctatttatcatctatcatctttatttatagatgagaaaattgagagtcatcaaggttatgtatttttcccaagcttcctagttaataaataggtctgccatgatcctaatcttaatttatcagattcaaactgtgatgtgcatatttccaagactaccttttgttagtttcctgtcttgctggcaagtaggaaggacttattctttctttataataaaaatgttaagtttcaaagattccatagagaaaaccttgtccaagccacttattttaaagataagaaaactgagactcagaaaaggtacttctttacacatatataattgttgtaaactttaggtaaagcacgcatttcctaactattgatcttattggtatattttctataacattatgctttcctcttgagaggctcacaattggaatgtcatacaatcttttcctcttgtattttctctctttctagttaaaatcaatacataatgtaacattgagctcaaaaccttcatcttccataaatttttatcagatttcttgtgcacaaagaatttatcttttcttggaactaatagaacatatatatgattcaattaatcttttccatttgctgtatctttttatttattctgcctcataatcactcatagtttcttaaacatgttcatatcttatcccatgagctagatgacaaagttctgtgagaaaaactcgtacacttcctgtttctacactcttcctgttgtattgccttgccatggtaagcactcaattagtatctggtgattgcttgcttaatgtttgaccaggacaaagagtagattatttagcctattttatttacaaggtacagcaagttaaatgatatgtggttttatcattaaaaagtgaaaagggaattaaggagattgaaaattcactgcaatgttctgcctgctaccatgatggtggaaagccaaaacagcaattttaccagccagcttttcctgtggtgtgtttctacaccaatgagctcagtattttaacataaactgtataaaaataactgctagtatttatacttcaaaatgtatctatttagttgagtgtgatggtgttcacctataaccccagccactcgagaggatgagttggtaggagcacttgagtccaggatttcaaggctgcaatgagctcagacagcaccactgcactcccgcctgggtgacagtgtgagagcctgtctctaaaaagaaaaatcaaagtgtctgtatttctcatatttcatcacacttttggagtactgacttgtacatagatttctgaaaacgctttgtaagctgaacataagacaaaaagaagatgatgagaaccagccttatcttcttgaaaataattacgaagctataaaaagaaacagatacaactagacaaggaaccttaagggtcggggaggggaggaaatacttggatgccctctcttccttctggtcctcttctatgtgtattgattgcctcagacaccttcagagtaatcatattgtggagagcatggatgaacatctaagagggagaaaatatcaggatattaagtaaaactaggttttcaaatgcaataaccactcactgtagcttttcggggatgatatttgcctggcaataacttttgatttaagaaaaatctttttcaccaaaacctatcccttctctgagatgggttccaatctagataaatggcaaagctattctcctgtttactcaagacccaaacctagatgttactgttgatccctttctctcccttacctactatagccaatcaatcaccaatttctgctgagtctactcccaaatatttcttgagtctttccatttctttccaatctgttactatcactgtagtctgaaccaatattatcttttacctagaccatttatttactccaaagtaatttctatcactatcgaccaccaaataagtgtggaagttaacagtgccagctttcaagtcagactgctcactggttagctaagcaatattaggcaatttttaaagctttttgtaagatgaagataataatatttaccttgttaccagcagcaaatgggtctgcagcactcaatacttgcctaactggaggaaaaaatttggctgagggccagaagtaggttgaaggcaaagggagagataaaggcaagtttgtttttttgttttgttttttgtttcttgttttggagacggggtctcactctgtcactcaggctggagtgcagtagtgcaatctctcagctcactacaatctctgtctcctgggttcaagcaattctcctgcctcagtctcccaagtagctggggctacaagcacatgccaccacacacagctaattgtgtgtgtgtgtgtgtgtgtgtgtgtgtgtgtgtgtgtgtgtgtttagtagagatggggtttcaccatgttggccaggctggtcacaaactcctgaccttaagtgatccacccacctcggcctctcaaaatgctggagttacaggtgtgagccaccgcgtccagcctaaagcaagtttaagagcaggagtgaaagtttattaaaaagttttacagcaggaatgaaagcaagtcaagtacactaggaagagggtcaagcaggcaacttgagaaatccaagttccccatctggcccttgacttgaggtttcatacattggcattcatctagggtttgcatttcttctcccttgattcttcccttggagcaggctgtccacatgcacaggggcctggtagtacttaggaggggctgcatggtcagtgtgtttactgaagttgtgcaggtgctcatttgaagcatttttcccttaccagtagagtgttccagagaaaggtcatataccagttaaactgcatcattttgtcttttactgtgcatgcctgaacccacttgctcaagtcctgagatcttatcaggaagctgctaatcaccagcttcaggtgttttctgtctattgggagactggtgttggctgtggccaattattgttttagcaagacagattaacaaccacttgatcatcacctgatggtcacctgacattccagatggggggccctctcctgtcctgctcgagtatgcctacctaggtactctagcatttctgccctcaagagtacaagactcaattatttggtataatggatgaaagtcagtcttttgtggtagtatgttctgtgagtcttggtctcttgctagctgtcagggaaaagtggctccatgggttggtgaaagtggtatccagctaggtccaagggagaagggcaggaattccactctgttgtgtttctctgatgggcattctagggtcttctaaaaggatgcctcttgaatattgagaggacagtatccctcattgaggattatttggaatttgatggcctgaaggcaagaggagacaaattgggttattgtgcttagaagacatgtacctgtaccaaaaagactaacaagtgggcctaaaaagggaaaatcccaggagaaccatttccaggtttcttcccaatttagccagttctgagtgtcttgttctcataaactggaagttcaatttaaaagttgtctgatgtggtcttgtacttttcccaattgatttaccccaaagcaacatttttcatctgagtctaaacagatttctccctgtgctgccagtaacatatctaggtcttgacaattttggaggactatggctgctaaagagtcaatttgttgttgcatagttgttaaagttttatccatgtcatcagtgttgctgggtatttcctttgagagttggctacaggccaaggaggcttttgtgattccagcaattccagtacccataccagctataatgccaagtcctatgagaaggggggttaattggatagacctcctcatcctgggaaggatggaatgcctctggattggtgctggaagagagagactcctggggatttgaagatgtcagggatacataggctatggtacaagttccagactagttagtcagaagacattggggaactgattggacacaaatatagaaggttccttggacttaaagacaaggagccttctatatttgtggagagggtagagatgtcaaaacacaataaagtctgaccctttctagcatagctagggggcatgcctaactctgtatgttcccatgccttgcctagaatttaatggatttaaagcaggcaagcagtacagttactaagagtcacagtagcagtttatactactaaagcatttagtagacctaataacctttacaattttacatttttttaaataaattccctttcacaatttgtttatgacttacataggtcacctacaacatacttggatgatttgacttgtcctaaacatccctctttgtaaacaactagtcattttactttaggacaagaatgtaccatgcaagatcacttctcatataaaatctattttctttataacctttcttaccaaaaaatctctttacctttataacctttgaattagactaaagtaattttccttctgttaagaagttatgttgctgtgcaagtactacgaagagggagaagataaggagattatctgaatactttagaagttattctccctcaagggattgctcagttagatttcttactagggcttctctgagtaaacatggactatttctaaacccttgaggtaggactatccaggttgaagttaaagatttaggtaactttcccaggagaaatagggctactagagggaaagattaattcagagtttgggtagatattaagcaggcacccatcccaaaggggtgtggggcttttagacattacctggtacttatgtaagaatagtaattggcccctaagtaatataaaggtgtgtgaatcttttcttttcgagggaagtgataccattttcccccattacccaacaggatttggaggagagttgcttagagaaggagattagcacagactaggcagctctcgaacccaaaagagaaatttataactacttcctgcctccagagttgcccttggctttgtcctgttgatggccagcaatgtctgatctgggagctagctggagctggaaccccttcagtttaaggcctttattggattggagcctggcccaggggcatttttggctcttggaacatcctttttccagtggctgagcttgtggcagagggggcaggctatgtgggggtttctcccatttggcccatttgggcaattctttttccagtggtctggtcttctgcaccaatggtagttatctagaggagtgtccttacagcaacctggagggggctggtgggcttgcagagcagccagtagttaagactccctcctgtttgtgcatttctccttctccttagccctgtcctccttattctgctctaggttttgaaagactgaggaggctaatttgagtatttcttgtataggggcactgggtcctgaggctgacttttgtaattttctaccagatcatttttaggctgaacagtattacaaaggaaaactagatttttgctttaagatttggggggatcaaaattttcccaggtttgggtatgcatcgaagggtcatgtcctgtggtgtgcagacgcaattaactatatgtgcagaaagaacaaaggagagaagaaaatgaagacatcctttctagttttcctaacatctttttcctgcacttatggcagactggagtgaacagagtgttccccattcatcctaggggttccagaatgaaccagtgcttactgggtacccataaccttggtcccatcttgttttatgaaggtacaattaaccatttgtgaagatacaacacatgagagaagagaagaggagggcaccctcccacccctgtttttccctgaatcctttgcctgtggcagatcagagtgaacagggtttcccccattcatccaaggggctctggaatgaactagtgcttgctgggtacccctaaccttggtcccatccaatttctgggaccagccttcatctctgtcctacaggtactttggtctcttatgcctgtggccttgggccagcctatatctttgttgccaagaccttacagtgactcttgttcagagcattctagaagttacaagagctggcagagccagaggtccaattagtgtgtgtcctggcaatgagccgagacacatctatgagaaagcccatttctttgttgccacacaatgcagcaaaagctgtggacatataaataacaaactgggaatgtggtcctgaaggagcacaagaccatttcagaatacagacagacaaaacaggagaataggcagtgcaggttttcaggaaacaagcagaggaaaccttgaacattacacggccttaggctttagccctaccactctcaggagcctcctgtccaagagggccattagtgcctcaggtctactctgtgcagactccaaggtccttcccaaccccatgagtcactcatcagggggagctgtgagatcagctgagaacaaagccactgtgaccaagaggaatcattctgggcattggttagtaagcaggagagtgaaaggggagaaagaatccatgtacaggggttgtacgccctcagccaaagaaagcaaggcatagaggtgtcttaccactagggaatgtgcctgagtcacagcaccaatgtatattaccagcagcaaatccatatggatctgcagcaaatcaatccttgcctccttggaggaaagaatttagccaaggggcagaagtaggttgaaggcagagggagagaccaagacaagttgtagcgggaccaaaagtttattaaaaagttttatagcaggaatgaaaggaagtcaagtacacttggaagagggccaagtaggtgacttgagagatcctagttccctgtctgtcccttgatttgaggtttcaaatactggcatggttctgggatttgtgtttcttctccatttattcttcccttggggtggcctgttcacatgctcagtggcctgctagcacttgggaggggtcacatttgcagtgcagttactgaagtagtgcaaatgctcatttgaggcatttttcccttatcaatcaactgttcctaaaggaagatcatttactggttaaactccaccgtttttcctcttggtgcacatatttgagcccggtcatccaaatcctgagagcttatcaggaagcggctgatgacagattcagctcttttctatctgctaggagaccgtcttttcctggtgtcagctgagaccaattattattttagagagacagtttaacaatcacctgaccatcacctgatggttgcctaacattcctggggcagccctctcctgctgtgctcatgtctccctaactatctactccaacaacctcactgggttgttttaaatattaatgtgttaatagacgtttgccccaaaagaagcctgctgaacaggaagatagtcagcaaatattagccattattttattaccgcacccaacaggcccagttatatcagttatatataaaatgcctgtctgattatgccttttttttttttttagacaaagtctcactctgtcactcaggctggagtgcagtagcctaatcatggctcattgaatcctcaacctcccaggctcaatcttccaactgcagcctcctgagtagctgggactacaagcataccaccacacctggctaattttcttattcttatgtaaaagtggggctcttgccatcttgcccaggctgctcacaaactcctagactcaagcgatcctcctgcctccatctcccaaagtgctggattgcaggcataagccatcatgctcagcctgactatgcccttttcaagcttaagaccattcaatgacttcctattatttttggaataaattccaaaattattgacatagctccacgtgagcattcttgattcacctctgcacacctctccagccatatctttgctattcactgtctccctcattatctgatcttgagcagcagtggcttaatttacatttcttaggcacacaaggttcatttggcctaataaagcccctgcatggcagctctcttataccttccttggactagaatcccagttatcttcccttcactcctgatgtttcttcagaaaccaacttgaagaatactttctcagggccatttactatgtgacattattatgtgaccactcaagacaagatcaaatcccatgtttatgcaatttcctaatacctagaattatagccaattagttacttatgtaattatatgtctttgtttctatcatgtaaattttattacattaagtttgtaatgaaatgggaaatgtctgtttgttaaccaaggtatcactagtgtctaaaagagtacctgacatctagttaacgtttaacaaatagttacagttatagaataaacccattataaataaatgaactaaaaaaataactgtggagttactctgattctgttctttgactttctagggattaatgctggatctacttagcaagaggacagccagggacaccttagagataattcatcctaaccactccttttacaaataaaaccagactccatgcagctataaaaagagcctttctcaaccttcctccagtcataagttcttttgtttctctatctaccataactgtgaaaggaattccatactttaactcgggcattagtggtgattagttgtccaattcataaagttgtgcattgctgaaaggggtaatccaaaggtctagaattcaaatgtcagaagtaatgagatcagtaaaatacaaggataaaaaaggcttgagaccacaaaaaagtatttcttctatctcatcttgtaaaaatcatctctgagtataaaatataacatgatgtatatttttaaagatttctcaaatgaactctaaacaggaaaagacaaaattaaggatagaaacttggatcttggttggtgctgtaaaacttgagaaagttatttatttttgttcttttccctatgagggaaaatggtatttccaatttcaagaaatccaaacatatataagctttgaaatcagaaaaattagaagccaattataccatttttaaagtattttctttgcttcctcaaatagtgagccacctaagttcaatagatcataatggcttttttttttttttttttttgagacagagtcctcgctctgtcgcccaggctggagtgcagtggcatgatcttggcttacggcaagcgcctcctcccgggttcacgccattctcctgcctcagcctcctgagtagctgggactacaggtgccctccaccacacagggctaattttcttttttttttctgtatttctaatagagaccgggtttcaccacgttagccaggatagtcttgatctcttgacctcttgattcgccctccttggcctcccaaagtgctgggattaaaggtgcaaggcaccgcgcccagcccataatacctttttaaacatgtatttaaattagatttttaccaagccatattaccaggctaagtaaaaaggtacctgtttcataattgagatcgtgtatatatttccaaaatgaccaaatacatacttttattgaaagcaacccatattttgaatacctttatcttatataattttgttctagtctacaccatcattgctactgacaaaaattatatagtactttattgtactcaagtttgttttgtcttgttttgagacagggcctcactctgttgaccaggctggaatgcaaaggtgtgatcttggctcactgcaacctctgcctccagggcttaagctatcctcttgcctcagccttccaagtagctgggactactggctaattttttgtatttttttgtatagacaggatttcaccacatcgcccagcctggtcttgaacccctaggctcaagcaatccacccgcctcagcctcccaaagggccaatattacaagcgtgagccactgcacctggccacatttcaagatattttgtattttctattcttgaacagtcttgactgaacatgaatgctctctttctgtccacccggagtagttgaaagatatttatttaaaagtgatattaatgatataaatagataaaagaagagtatcacctggataagaatttggaaataagagaaaagtttacatttgaaatgcaggttttacatgaaatatatatataatcggagttgttttttacagtgaagttcaactgttctttttgttcttgctgttccgatgctctctctcttgtttctttttgagtgtcacagacatttatattcctcttttctcaacctaacctttccctgattacaggcatttgtactaattactgtgattccacagttcaacacagacagctttgttcccactgctacagaagcacagagctgcatcaatattgagtagggggttcttgaaaataacctaagtggcattttggaatagatattcctccaatgggtaagatacctacctaaaaccacaaaatatacattcaatagcatatttttttgaaattctatagactttccaaacaacttggtttagaataaaagattcataatatgctaacacaaatgtaaatattgtaccaggtcacacctaaaggatggaaaagtctagtaagtgaaaatgcccattactcttgggctgtaagattttctaccagagaggttgcacagtaatataccctaactgttaagaatgagaaagtttgttgctgttgtattttgttttattttgtgggcatctgtaagaactagagaaaaactgtagagtcctgtgtgtgttttgtttcacctatggaatactgattctcttcgtgttaaaatgattaattcttatttgttataaaatagagaatattatataagttctggattcctgtattctcttgaaaatcatgaagttctgccaactctgggcccaatttcatctagcagctactgctgcagtatggtgcttagactcacagagggaggtggctttccagttcagccccaaccccacctctgtctttgcctaccatacactgaaacctagagtcagatggcatttatcattttttccctaatattagagttgaaaatatattttgtaaatatctgtgtttctatcaagatgggtaagattaaaaatggacccgaatagctgtatgattcaaataaaagaggtgtagtccaaaaagaaagaatatttctttgtggaaacaagggacattccacatatttaatttgtaatgttgtctgtgtgaaagactacatctttgtcatctgtgcattctactttactatacacatttatatttatttacttgccccttagtagcttagtctacagccactgtgactgtcatattcagccatggtgtaagctgacatttttttaaatgggtgtgtgaacatgtgtacacttcggaaaaagtggcaaaggatatactccctatgtcaactcattatacctagttcatgcgtttatcagttattttaactttcttttgtttatctttttcatgttatgagttttgaccatgtgcttgtgttagatttaaaaacagaaaaacaataaaataaaatgaaaaaagtaagaaaatggtttgttcagaatgctaaacacatattccctttttgttcccctctggatgcaattaatgcatacttcaatcttcatagaacctaatccaaaatgcaagggtctttataatcagccttcccaaattgatttttactcaatcaaaaccctcctctccagacatattgatttttttcattgtcccttaaacacacctgaactcggaaccatttcctccttcacgtctgtatttattctgttaagcctcttgacttccctcccagcccagaatatcttattttgttgatgcatcaaaatactcacatcattcaagtccagttcaaactccttattaatgcttcccttagacgccggaagtgatcgctgttctccctaattgcaattgcacttaaaccaactgtagcgaacagctcaatctttgttaaatatttcctcataattcctctgaggagcactaagaccctgagatattgatagtttttgtgatataaaaatttccatggcttaaaaaataatgcaaaaatgttcagaaacatttggtttaaacaaaattaaccagatttatttactgcagtatttctcagaccattagaacatgtgtagtctcctgctaatagtgaagagtggttttaatataaggaattttacaaaattttgtcagcatcaaactgacaattgtccttatgattttgtccatattttctagtagaataatgtcctgcagaagataatttgggtgatcccagttcataatatagttttatgtgtatctctttatttcaaaccagctagcaaatttctagtcactgaacttgttcttacaaatatttttacacgtcgagatccttcaacacttatgagttcatggtatgtgtgcaaaaaccacgaatagataaggaggggagtaacaatacattgtccattggctaagataccggagcagttcaaggggacagtcatcccagattcagggaaacaggaggaaacccatcaaaggatattaggtaacctctgacagtctggcaatgtttccctcttcatgacactcggtccttgcttctcctcttctgtctggaccaaatgatttcaaactcaggcttcctgtagctctccagtgtgaaagaggcttaaagagataggatcacttcaattcagggtgcagcctcatttttccctctgctgttcacatattgataggaactttacatctgtcatgtctccttttatagatgaatgtagggagggtggatgataatgcattccaatatttattcaatttcaaaatgaaagacaagttgaaaatccttcatgaggatgcaatccacggaaatatgagagctgtctacctaccatctctaacagattttggcctttgtttatttccgaagcacttatttgtcattaagataatttttgtttatgttttctcaggcatattatgattcccttaagtttccagagagccttgttctatgctctgtaaaggagaggcatatgtgggttaaataagaatttaatatatgcttaatgaatatatcacttatttgtagaatgcattcttgttcctccttgatattcttgccatgccaaaccatcacgatttctgtcatttgccaaagtatattcttactttgcacttacactgattacacctgatagcccattttgctgagtcatcctactgttctctgtgtccttacttctcatagtgttgtcaggaaaccagcagcataggcatcccctgagagtttgatagaatgcaaaattgcagctccaactccagacatagtgattcagaatacgcatttaaacaaaagtccttggcaattcttatgctcattagagttggagaagctctgttctaagtgttccctggatttttcactgtgggctgaggcacgtggtatatagacatctctctctctcttaacttcttctgttctcctgggcattgtcttcaatatttctctttctttttcctttcagcaagtgcacctgcttaggactcactaaaccattttcacaattaattttccatctaatcaaaaccctcctatccatatatctctactatcactccaaaaataaaagtttcattgaggtctgcctcccctatagttagctagctcagatggaagttgtaggctattccacttgccaggcatttttcagcccattgtttgcatttttgttccatcattttcctgaaactttttaagtcacaattacctaaaattgttgaacatattgagcattttttgaatttcagttgtctggtctctctgtcacctttgacactgttgttacgttcttccttaaaactctctttttcctcagcttctgagaaataatcctcttccgattccacagagactcagatggttctttctcatttccccacatctgtgttcccatccaatcggtattatccttccatccatgcatccatccatgcatccatccatccatctatccatccatccatccatccatccatccatccatccatccattcatcttcagctttctttttttaatctctctatacattttttataaatgatgcttctgactttcaagacttcaactaccagatccagagctactgattcctttcatcagtgaccatgccttttctcccacatgcctctctgaatgtgagatatctctccctgtcaatacaacccacactaaacttattttctccccacctcttccattctatattccttagctgggctggtagaattgaaaagtctttctcaactcctacttccttttctgtgcacatccaattatcccctgcattctgtcaattccactgtcttaacaactcttaagtctatcttgccttcctatcacatagttaccaacttaattcagaatttcttcattatttcttaccttcactgcaataatggtctcctagtaggttttctttctccttacccacagagttcttcctaatcaatttttcttacttcttacaccatgaaaaagcttcccttctcattctgtagccatctcaatgggtttgttcttgcaggtctaccaaaagcaaggaagggctcctgaggttataccaatgtaaaaggatagaaaggtgagtaattcagatgagatgtggtttctcagacaacactcccttccaacatctatgaaaatagatgaacatgaagcaaaattaaaataatagcaaatagtctgggcacaatggctcatgcctgtaatccccgaactttgggaggccaaggcaggagcattacttgattccaggagttcaagacaagcctgggcaaaatggcgagaccctgtctctacaaaattaaaaaattagccaggcatattgatatgtgtctgtggtcccagctacttgggaggctgaggtaggaggattgcttgagtccgggaggtcaaggctgcagtgagccctgattgagccactgtgcacctgcctgggccataaagcaaaaccctgtctcaaaaagtaacaagaagaagaagggtagcaaataaatagcaaaaatatagcaaaaaaagaaaatatagcagtccataaaaataaaagttcaaattgattctgaataaaaaacatgctttcaaatccatctgaagaattcctaccttagctactgatttgttatcagaaaaaacaaacactgtgaaatatttaaagaggtttattccaagctaatatgagtgaccatggcctggggaacagtctcaagagatcctgaggcctacaggtatcctgaggtggattcaaagattttctgggctgggcatggtggcttacatttgtaataccagcactttgagaagccaaggtgggcagatcacctgaggtcaggagttcgaggtcagccgggccaacatggtgaaaccctgtctctactaaaaaaaaaaaaaatacaaaaattagccgatcatggtggcacaatcccagctactctggaggctggggcaggataattgcttaaatccaggaggtggaggttacagtgagccaagattgtgccactgcactccagtctgggcgacagagtggcgccatctcaaaataataataataataataatttctgatttggaatttgttgtaagagttaagctttatctttagactggaagtctttgtctaaagacttgaagttagtaggcagaaatgctcaagttaagattgggggtgttgtgatgaccaaggtttctgttatgtagatgaagcctcaggagttgcagtccttacagagaatagatggtaaatgtgtcttttgggaacttgaaagttttcagactcttacttaatcttttctagatctgaaaaaggtctggaaagggaaggcctggccgcattaatggagattctctactgatgcaaatttcccccacaaaagacagctttgctgtcatttcaaaatatgtcaaagaaatatattttatggtaaaatattttatttccttcgggatgtgctttctgtcatttctgtcatgtgatgttatactagaatcaggttggaatttagcattttattgccacaaggattcttttttgtcagtcttaggatctctgttttaactttaatgcctgtcacttatgcctaagctccaaaagggaggggatataatgaggtgtgtccaacctcccttccagttacggctggaaattcaggttttcaggtctttctagggtccccttggccagaagtttgtcagttcagccagttggcggaactgaaaattttacttacggtttacagactttagaaataaaccccactaattgcccatcctattttgagatggttcattcatatatgaaaaactcctgttcctttacatcttgatttatacctaaaaactctgtgcaggtatgatttctgtcattccagaattctccatgcctacaagtagtgttagaaatttcctttttgcaaaactacttcttctgaaggagagtgttggaagctatcttatagtttggattcatgggctggggtttggaaaagagaattattccagggggttatgaagaatcctaaaatcttaacagagcaaaatctcccaatctatatatatgtatatgtatgtgtgtgtgtgtgtgtgtgtgtgtgtgtgtatatatatatatatatatatatatatatatagtttttttttttttttcttgagacagagtcccattctgtcacccaggctggagtgcagtggtgaaatctcggatttgccattgcattacagcctgggtgacaagagcaaaactccgtctaaaacaaaaagcaaaaaacaacaacaacaataacaaaaacaaattggccaggaacatttctgtttaggaaatttaagaccaaggaactgaactaacattgggtacttaccagagtctaagacctgttattcatgggcatttagataagttttctcatttaatgtttataacaactctattgataaggacatgttctcaatagagaaaaatgaggaaagataaatgaaaataacaatggagtacttaatgccaaaaactttatcaggcgtcgtgaggtatctattatataaagctcattttgcagatgaggaatgctgctctgagaagatgagtgagctgctcatggaaacgcagctcttaactgctaaagggaggaagtaaagctttgcctgctttacttcaaggcccgagctgttttcattataacaatctacagtctttaagataggtgaagaccattttggacgcaaatgagctaaactgcttatctatttgtgttttaatcaggtctgtctgtgaagttatcttccagctattttgtattcaccccacgatacctagcactgtgttctaccatacatgaccatcaataaatgtttgctaaattgatggatgggccttgctgtgctattaaggaacactcatcacgctacaggaattgctttgtccccacgttaacagacaactggttatgatgaacttctaaaggaaaataaaattatgcttctctgaaaacacatctaataaaatgaggatgttattatcatttggtttgtttttgagaatatcgatcttaaatacagttaaataaatagctggaagattggaaataacattaggaaaaagatcttttatgagacatgataaagaacaataattctttcatatatacatttaagtacaaattcacagaactccttctgaagaaacaattgattcactcctaagtttaagtacctattaaatatttcctagtaggaggtttcatctatatgttacatgtcagtagcattacgtcaaataagagtaactatttggacccattctttggggttgaggaatggaggtgatagttattatgcatgaagtggctgactggatggtgcacgtcgtagactgcctaatgttgatattcaaaacaatcatatgaaatatgtgttactataatcacatttagatgggaaaactgagtgaggaggaagtcaggtatgtttcctggcttacatgtctagtacatgataaagccagaatttaaatctgtatgtctgattccaaaatctttgtccactctgcttctcccatgctacctccaatagctcaaagtatgaagaaggtacagtgacgcaaatagggccttcatctaaaaagatcagagtaatagcataatggataataaaatatttacaatatcaacagggtcaggggtaagtgcatttgtagaaaaaaaaatgactggaaggaaacaccacaatgaaaacagtggtttcgttgtattatattacgttttgctattttagtaatggaaaattttaagctcatgaaaaagcaagataagtgtattttaggacaaggctttacatcagattaaagaagatttctgggagagaatcagcaagaggccatcgtgcagcctggacagagggagggaacgttccacactgctgctctaacagaacacaagcaatggcatatggcactaatttgtgaaattacactttaatttcaaacccaggttaggaagagtagtcatggctggagaacactgaagaaggcttccacctattagctcaaacagtcaggcaggtactaaactgatccagcaggcagcatgctagatgttggagatagagagttgaacaccgtcatgtacgtaaaaacagcatattgtaggagcatactttagggttgtacttctttatagatcctctgaagtggggcccttgagatatatatatatatatatatgagcaaatagaacataatagcttttctacttccttctgcattgctttttaaccttccttccttcctaatatgtgcatcctgcctcaattccctatctaccttcttgcatactggcccaatatagagaatatattaattattactttccttataatagcacctcacccatctgttttatccagaaacccagttttacattccattttcaaggtcagcgaaaaacagagaaggcctcagcattatgagtgctgccccatgagatagtaggtagaatggcccatctgttaaaacactgttcataattttaaatggaacattttaaagctcagtgaaatcatttctactctccagtacaatgaacttctattctcttacctcctggagaggttgaactgaacatggaaaatcgggcctttttggttcttgtagtgaatataaatggtgatatcaaatcaccaacttggcccaggagataatttcttgtgagtcgctgaggctggctgttcaatcttacatgttttacacataattccagaccattttgcagaaggtttcttggcttccatcttaaggatcaaaagcaagtttcctcatggtttgtgattctcatgccaaaagggtaaatgtgcaggaaggtcataagcagtagcaaagcttctctcacatctgccttgagcttgagcagtcaggcttgctaatttgacctcctattgtcatttagaatcttctgccaggagagtttttttcttttttaaagaagtgagaggcagataatttgtttaaattatttatatttaagaagtggaaggaacagggaagaaaaaagagatgtcttgattttctgaggagtatgccatggatagacacttagggcacaaaacagcagctacctggtttatgctgaaaaaaaaaacaaacatgtaaatagcaattattgtgcagcagtagccctgaggaggattctctgcatactcaatctttctaagcacccctaagtgtcttggactctccattacagaaaatgtgtttaggtctatgaatggaagagcgcacctgtgtgtgtcctgtcccagtgtttctgtgatgatgtggatgtcctatgaaaatattagtaacagatggcaatgtttctctagccttgatgttattctcatagtatttacaggtcgcatcaactggtcagatgtggctacaaagtaaagtcataatacttcaaaaattattcttcttgaaagctcatgtatatgtattctcaaaagacacactcaggcagttagaaccagtgtatttctatgtaatgacctgttctcccaaacatggttgtctcattgcccagggattaaaaggggaaatgcttctaacaatcagcaaaggcaaaaactgcaaagggatggaataaaaaaaaaaccataaagcagacataatgatttacagaggcaagcaatctgaggttatctatttgaggagccaataattacatgtatacaaataatctttggaggaatagtacaaaaatggatgtttcagaggttgacccaagtcataatatttaaaatccctagtgtaaggaggcacagagcaatataattttagaaaatcacccatccaaaatatattttaaaggattttcacctaaagatgacattccttttaccaatgatgtagactacattagttctccttccctttaggtctgaagttcagttagctcagtctcttttgtactaggtagagtttgtggctattcccttgaatagtccagatgactttgctcttaacaaggcagtcccagagtagttaacatgaaagccacgtgtgagggtgtgtgtgggagggagagaggagttggtgggaagaggaggtcatctgtgctaatggaaaataaactcaaagggcatatccagcatcacctttgtatgggaagagcatctatttggggttttcattttctgataggcagtgatagaattacaactaatataataaataaatagaactttagagagtgcaagaaaagaatcccagccctggccagtgatttgatttgctctagcacatccatctgactgagccatctggcagtgaaccagtggtatcagaacagcaatgggtgtaaccttgaggaagggttgccccttgacaaacagactggtgggaaaagtgcaggatgtggcaagactgaggatgaacaactatccaccctgcagaggatagcgacatagggagagaaatgcgtggtgcacatcactttgtcctgagtgtttggccaggccaggtatgaaaggcacttaggctggatacctaggaatgtctaacagcaggtggagcaggcaagaaaggaggccaggctctagttaagaagagattaattatggtttggagagagctgtccattcataactggcgggctacagagggcagaaatcattccccaatgggagaaattgttaagagattgagtgaactccaactatgaaggcctatcaacggacagaaggcagggcgtagagaatgttgtgatttagaagttatacagccaagtaccttctaggtacacctgtgctgtcagactattagaacaagagccaattcaaagttctattcaactttgagacttaggctgccagtattcccaccaggtcacatttggctaagacagctttacacagagaaatgaaggtcatcagcataaagacagagatgttcagagcttaaggaggaaaagtagacaatatcatatgaggacagaaagaggcacggggatgcataacactgtattaagatgaatattacaaagctgaaacaaagagtttttaaattctaatttgcatttccaaaagttatatgcacagatacttgcactgcttcatttcctctctacatgggggtctgggtggctatctggaagaaaagaaaaaagcttatcaattttttttttagtgccctattgaacacatcactgcattttaatctgggacagatggtggaaaatggcatctggttaatcaggggttcatagattatttggtgatacaacttaactgtgctgatgaagaaatgagaaattttgtctcttccctagagcagcattataaagcatccttcctggtgtttaaaattgattgtgcattctattggttaaagagtggcattttgaaaataaaattagggctgatttgcatttgtgttgaaacagttgcacaggcatttgataagaatagttcttttttcttttagaacacatttacagtttgcatttatttatattaactcaatgttttattcaacattgttttaaaagacaagacaaacatggatataattactcataaagaaaataactcttatgagtgagaatgattactatgtatttcatttgggaaaataaaacacaattttttttattaataaggacacaggcaatacttcagtaaatgtaccaaggtaattcaattttataacggacaattttaaaaggcattttgaaacattatatattattaatttttacatctagaattgtacttgtagatgccatcagaatactcgatcaatatctgtttattcagatttaagctccatgacttagttgcattacatttaatttatgtgtatttccttgattcacagtctgtagtaaattctgattgcttacacctgggcaaaatgtctttaaaattgtcaataacttccaggcagtaaaaaaaatgaattgcatgttgatggtaaaagaaaacaaactgctacatgtgatgcatgcagatttattaactaaataagtcttcattcctcctccaagtatgattgaaatttatagtcttgctagaaaactctattttccaagaaagtgtttgcaaagacatttgtacagtaattaaaatagttacttttccagtaattataatagggaacttggaaatatgcaaaataataatcttattttatttatggtatatcatattatctttgaaaagcaactcaggtgacatgatgtttaaaagttttaatctcctaaatgaaaaatatgttgctattgtagaattggtcttgtaagatggtgtcagagacaaaaatcataggaaagttcatagatttttttaatttttaagttatttcacgtaaatcatcaatggactctaggaagacataatccctcccacccctaccacacacacatacgaaaaactttacattttaaaaggccaggcaaatactactgagacagagaaatatatagtaagcacctggttgtaaatttaaccataaccatccagaaagatcagttataaaatggacattctgggctgagtatcaatggttacataaattgaactttgtcaggaaagggagggaactgagtttctaagtgggccagaggtgaaaagcaggttttgtgaaacacctagggatgctgcagttgaatagcctgcaattggaaggtagatctaagaagtaaaaatactaaaaaaaaaaaaaaaaaaaaaaaaaaaaaattaagatactactttgttataaaataccttgacgattctgtgctgatgatacatgaatcagcctcctcccatcagtacagtgaacttggtcaatgaactgactctaatgtgtgcttctttgccccaaacagtcatagggcagaaggtctaagctttagaagttgaatcctatgggagagggcatagcattcatgtaccatgacagacacatgttcattctctgccccataaggggcaaacaccattctgggtacttagggcatgaacgtgaaaaaaatagaccaaagttttgaggtgtggggtatatattacaagaagagaagagagagcacaaacatataaacaaataaataaacatgttccagatggcaataaattttataaaaataacaaaacagggtagggaggatagaaaatacaaggatgctattttagagaaggtgatcaggaaagatcttccaggcacagtgacatttgacagagatgtagaggaagtaaaccatgagctatgtggatgttctagggaagtgtactactggcaaaggaaacagcaggaacagctcggagagtttctgtttaaggaccagcaaggcaggcagcaagtgaggctgcagggctgtgggcagaaggaggatgatggaagatgatggctcagagctggtgataacaaagaggcgagatcaatcagaaccttttggccgctctaggaaacttggcttttcttttcactgaggcaagaggccactggacatttttgagtagagtgatgtgatctggtttctcttttaaatagcttattttagctactctgaggaaactgaaaagaaggaagacaacaacaagctgttgcaacaattcagaccaagggtgctaagagtttggaccacattgctaacaacagtagtgagaaatcagtgcctattctgatgtgagtcaatgggatttgctgatagactgggggtagtgtgtgataggagagagaagtgaagagaagtaatccatgacgccaagttttctgatccacataattaaaaggatggagctaccatttactgaaatggagttgataatgggaaaaaagtaaatctgaagtccatttgggggccataattattttgagatacttcttagctattcgtggacagatcaaaagatgtgacatgcttatcttgaaaaaaaaaaaaaaactaaagaatgaatgaactagaggaatatggtaagattaccagataggcctaaaaatcaccagagtttgtgaatttcctccagtggattaaaaactccaccagaaataagaacaattgagttagagcaagaaggtagggatgtttggtgaagtggttaaggtttggaaaaatacttagaaatattttatcttctaaacattataggggtagggatgttatggccaactgtgtggcttggaaaagttccttaattaattctcattgcttctactcagtacgcagttcttataaatcagagagaacatctctttcaggttgtatcaggagcattctcaaactaacactcataaatcggcaatttaggcagggaggaaaggaatattcaccgattacctgctatattccagacaccgtgcatgccgcttcacacatattatcttaattgatcttcccgacacattttcgatgtggaaactcttattttcattttagaggtgaataaaggttaaaggttaaagattcacctacttaacatagctgggcagggatagagcatggaatttgccttacctgccatcatttccatctgaagaagttgaaaagctgtctccaaatattttggtatgagatggggtacataaatacttgttaataacttgttcgactgcattatgtctagacaagaatatattaaattcggaaaagaaataattttaggagtgtaagctttatgaggatttagtccatgctgtcttatatacaggtgtattctattcattcactcacctaatattcatttggtgcttacaataggaaaggaggttttttgtttatttgtgtttgcctgtttgagatggagtctcgctctgtcacccaggctggagtgcagtggctcaacgtcagctcactgcaacatccacctccctgtttcaagcaattcttgtgcctcagcctcccgtgtaggggggactacaggtgcgcgccactatgcctgcctaatttttgtatttttggtagagacaggctttcgccaggtaggccaggctggtctcaaactcctgtcctcaagtgatccacccacctcagcctctcaaagtcctgggatcagaggcatgagccagcacgtggggctaggctaggagttatgtgctccatagttaaataagatacagttcttgttcttgagaatttcctattttatatatatagacagccagataatagcacactgtttctactttaaaggctgcactcctcttgcctgtttaatattcaactgcctataatccagggctttgcaaaaaatcattcactgcttttttgcagtgatcagttaatcaagcagagccacaaagggactcaagcaagggtagtagaaggctggcttctggaatacaggaaaagcctctgtttgccagagcccaaggttttaaatacagacaaagtcaaaggctgggaagaaagcaatgtgcgctcatagatagcatggacccaggagatcagccccagggatggagatcagatggaagccaacattgctggtctaaatagaggcagaccaagtttagaaattgaagcacagaagttcaactgtttcaaagagatttactgcagctttgaaaaacacgaactgaaaatcaggggtgagtgtggcagggcccacaagctctcaaagaaagagagggaagcgctaactgggcagcttctttggcttcttaggctttagacccttctgaagatgctgtatatctttctctatcaggacccagggaagttgggttgttccctgggaatacttactgctgcaccaggaggaagagacagctacagtgccctaagtccccagctccagtagcccttaaggatccctggtctacttcagctcctctttcgaagctgcctcactctgagtagttttttctccctctaagagaggcctattacccttgctgctgctgctggtggtggtgggggtgtcctagatttgtctagttgtttgagtttgggggctagatcttgtattggagttgaacttcaactttttttaaggggcaaggctcttgactgaaatttctttggtaaactcttgttcctagaaaaaatccagcatttggctccctttcattgaccttttcattctgtggatactaagcctcattgatctcccagctagattcacatgccttgggatattgcctggttctaggagggacagtaggtcatatcatgatagcagtggatgagcatggtgctgtgaggctggctgaagtggccctcgataaaggtcagaaacaataggcagaagggtacaccatttatacctactggtaaagtccattggtagcccatggctggacagaaaagcaatagcccctttcagaggatggaagttaaagtactagttataaaactaaagaaaatatttaggccactggaagtaatggttcattatgattattaaaacaacaatgacaacctgcaggctaaggatgtctttaagatattgtagaatgcctgagtagataaaatatgaggcaaaataaatggcagggaataaatggatctgataagtggatgacttactatccaagatgtagcataatttccacaaggctatattctaaaatatgcagttaatgccataagcacaaaagtataaaatgcactgggatctcaatatgccaaatgcactttagagtccagtgggcttgatcttgctgaggatggccatgcctcaacagattttagtctcctagaccttaggtcatttgtattatctgatagcataaaggtatgtggcatcatggaatgagctaagtaccacattggagaaatctccccggatacccaatgatccccaggacatttcattctgttcatatcccagtaccagcagaagacagagcaatctcagatgcagcctctgccaatctcgagattccttctgccagatctttatgtcatctcagaagaatagtattttttttttgtatccttgtcctagatccacttcacactgtgttaagcaaagtggctgagaaaatgcagagttatttcaggctgagacctatatcggataatcataagggctgtgtacaccataggatggaattcacttgctttatttttcaacatttaacacagtgaaagatttaaacataaattatttgattggctcactcacttacttgcaaggaagctcctgaatcactgtatgatccccatgctcccccaaccaattcctgaaacttggaaccgaagcattattttggaaacaccaatgcaacagaaatacatgctattaccctggggccagtacaccttattctgacccatgcttccctctctctaggattgctctccacggggaaatgtatcttgttctttggccattctcatgcagagacactgttccttccccatgtacctgttaggattcagaacaagaagtcacttaactctttttacgtcgaatagttaagagtacacaattattcaggaaattgtaactttgatgtatttaaatataagaagcatctgcttggaatctgacccacgtttgtagttcatgggtcaatcagaaaattaggcagggttttaaatgatgttttcactgctctgcaaggtgcaggctaaaacctttcctcttcactcataggtgggaattgaacaatgagaacacatggacacaggaaggggaacatcacattctggggactgttgtggggtggggggcggggggagggatagcattaggagatatacctaatgctaaatgacgagttaatgggtgcagcacaccagcatggcacatgtatatatatgtaactaacctgcacattgtgcacatgtaccctaaaacttaaagtataataataaaaaaataaaataaaataaaataaaaagaaagaactcacccagtgcagctcccttcttccaagtgttgactcttctccagaatttgcttgcttttgtctctcgccagtgccttcaggtggctgttttgtagtttttccagcatttatagttattttctttgggaagggcagtctgattgaagcttattcacacattttgaaggcatccctgaggaaacaggaagaaaaatttgcactgttaaccctttgccttgcgatcaaaaagtttgtaattattatatacatatcctttcttggctttgattcttttgtgatatgtgtgtcagaaaaaaaaaagaagaaataaaagaaaggcaagaagatgaatggaagaaagagataaaataaggcttttgattaatgtataatgacatatccacaattacagtatcaggcagaatagtttcctgttcctaaaagtttcccattctctgcctattcatcacttcctccctcctttcaaattcatgacaatcattcatccttctactgtctccatagttttgtcttttccagaatgtcacatatttggaattatgaagtatgtagccttttcagactgacttcttttacttagtaatatgcacttaggatttatcaatgcattttaatagcttcacagctcattttcttttagcactaaataatatttcgttgtatggatataccacactttattcatccattcatctcctgaagggcatcttggttgcttccaagttttggcaattataaatacagtgctgtaaacatctctgtgcaggtttttatgtggacatacgtttttaatttatttggataaacaccaagaagtgcaattgctggatcatacggtaagagtatatttagttttgtaagaactgtcaaaccaaatggtacagtggctgtaccattttgtgttcccaccagcaatgaatgagagtttcagttgctccacattcgtgtcagaatttagtgttatcattattttcaattttagcattctaccagatatgtagttgtatctcattgttgttttaattctcaattccctaatgacatatactattgagaatacccacaattttacaacatggtatactaccactgctgccattacttgcaaacacctagttaaaactttctatgtactaggcactatgcagagtacttttcatatattttctcataaccctacgagtcagatacaccattattatgcattttcaggaaaaaaatcctgaagttgagaagagttaagtacactgctagtaaatgttgaatctatgacgctggggtctttctgactccaaatctcatcttttaaccactacatacatttttcctcaaagtgtgatcccgaatcccatacttcaaaccaagcaggatggtgataaaaattcagaattctgaattgtaaaatattgcattagaatcttcatgctgggtgtggatctggagtgggagaaactgaaacacactcaagattaagagccattatactaccattctaggattactcgaagtccaagtagcagttttgatactttgtttctatcttgtatcatgtatttctctttgaagtatatttacaaaatccctgttatttatataaaataaattatactaaaaacattgagattatatcttaaatgtaggtgaatatatagttttctatgttccctaattaaggatgctataaaatcttttcctcatacactctaccttagagataaatttgacaacaggggaaaaaaaaaaaacaacctcgagtctttcaaatatctactatgtatcattctggtatagtctgattgtatcctcccaaaattcatattgattcagttgattcaattgaaatcataatcaccaagttgatgatattaggaggtggggtctttgagaggtgattaggtcataaaggcaaagccctgagtggaattactgttcttataaaaacactttagacaggtagcttgctccttcccacatatgaggacacagcaggtgccacctataaactagaaagtggaccctcgccagactccaaatgtgccagagacttgatcttagacttcacagcctgtagaactgtgagaaatcattttctgttttttataagccacccagtttatgacatttttgttataacagtgcatagggactaagatatactttgtgctaggtaaattgaacaaagatcataccaaatacttctagcattatgacagatttatctaactataaaagtctatttaatgtcgttttattggatggaaaaactgaatatatttgcatattttactatactatatatactatatatatgcatatatagtgtgtgtatatatatagtattgtatatatgctataccatagtataccataatatactacatatatagtatatttcacgataatttcaggctaaggaaaaagtcattattgcaggcactctatgaaaacttattaattaaaataaacagacatgtttttgttgtggcttttgatccaagacaagacattattaaggatattaacaatagaattgcctgtgttcaaatctctgctatgcttctaagtcattgtggaactttgggcaagctttagtaacaccttttaggtcttggtgtacaagattctaaatggagataaggaaagcctctacactctagaattattgaattaaaggagttagacagtgcctgattcacattatactttcaataaatgtgagctattattattttcattattattattctcaaaaacaaaaggaaattgagtaacagagtggtagagtggaaagcgtggcagaatggtagtgtgagacccaaaaatataagaatataaatgatatgtgacaaatccatagtgtagaaattgaatactctgagaatgaaaaactgaagaaatcacttttcatgggagtgggcagggatgcatggcttctttgaggaatctaaataaacttgaaaatgtttttaggtgaaaagaatgtgtatttggagtggatgtcctcagggatgtacaaatttagagactttagctctttttggtagatagggaaaccccgtttggaccctcagacacagcccactgtgtcaagacttggcaatttgaggagagatggtgtcaaggtaggtgctgtataagaaaggaatcttagacacatgaagagaagccatcctttcttgaaccccatttgcagctacaaaattgcagactgagtactacagtcttttaaacaagcctgtcactgagttcacaaaggcaagaggcattgtcacctgaagccacaaatcctgctaagagcattaattgttctctatataacataggctgtttagttctgcaatcaataagaaagagtgggctcagatcaggacctattgcttttcttcaggtaaacttggaattcaacaaatagaccacaatctacaattttctccataaggcagaatgcaggctaagttgatacatatttacaagcatggaaatgagttaatgaccttgagatgaggatctcagtgacataaacccccattctctttacaacttcttgagtttgtcttggtgtttgctaactctgaggaggtctaaaagaataaacagtgtctgcattctgctttcaatgccataaacacattttggagaggcaggagcaattttatagctgtacatacactggagagagagcatgaccctggagagctagaggtttatcatcactttaaaaaataatggttgagaaggaattgctctaagtgtagtctctgtcttttattttatattttttaatagctacctcttattgagtgtttactaagagacaagaactctattaggcactgtttaaacttttattttaaaatgaaacacagatacagcaaaccacacaaaattattataaggcaaataccatcttaaccgctacgcatgtcaaagaatgaaatcttgctagccatccagaagtctctatacattctctgtcctctctgtctccaaaaataaccaccctcttgactttcatattaatctttttttgcatttttattgtttaccatttaagtgaacatcctaaggcattataatgtcatcaattttcaaattgatatgtcttttagcttcaatatcatcaatgtgtcatctcccttgttcccacaaactcctttcccttaaaattaatctgttgacaaatatgggccacttgtggattttaccccagggtggatttgatgagtatattgatatactcatggtgccaatttacatgttcttctcttctctgcatttccagcaagtggcagcaggaaccttgatcaaactcagcttttatattgtttgcaacactataggtagcactgaatctttcatcaggaggcaaattgatgctcaacggcagttggttattttcttggtgattataaaatggtgatactctaattctatccattatttttacacattagctcaaataatttcatatgtaaggtaattcttcctttcacctacaatttggttacccaggggcataactccaaaaaggacagaactgaagtttttatgataggttttgtgataataaattggttccctatcatcctcatcaattaggatttaaatttatctgatggatcccaatgcactgtaatttttatccttattgaagtgctattttttccttcttcatccaggtggaggcttttcaaggttaacttttgattcctcttgaactagtagtctttgatacttcccatgttagttcataacaaaatgtttcagatttatctggtgtgctccttttcttatatctgtattcagcacttttctaagaaattctgttttgtttgtctgtttgtttgtttgtttgttttaacaccacaacctggttgcaagtgatagtcattgctactagggttgccaaagttagcacataaaaatacaagccacgtagtcacctacttgggacatacttatactaaaaaattattcgttgtgtatctgaaactcaaatttaattgagcaccctgcattttatttgacaattaatttatactaggtcagtcattatttttagaccgagttaatctaggtcctctgagaagcaggtgcaagtggatgtgcaagagagttattggagaaaatgcctgtgagggaataaaagagtgaatggaaaaagcaggaataaccctttgactgtgatgtaggctttactgctgtgaaggtcaatgggaagaaaggagaatagatagaaagagtctcaaactgtagttcaggtctaagaaatatttaggagggttctcaaaccaaagctgtccaacggaggattcccacaagccctatgaaggggactgcttcagtatctctgccgcctgcactcagtcattcgcctagcacaagctgtgggaagcatagcctcactgctaatgctgttgtgcattaggaatgagataataatgatatctccaaatgaaaatgtccaattcaatttcagggctattttctaaaggaacatcttctatttgcctcttatctatagtgaaaattatagttcttaaagccttggcgattagagagttagaacatctcataattactcatttacttttccaatattatacacacaacagaaaaaaaagtaactatacaaatattaccaccacccattataattattgaaaatatgttttcttgcatatgctatctcattctctccatttggttgtactaaatctacattggtagataatatagctgttatgtactctttcctacttaacactcaatttgtcttattctactatcactaaatgtgtaatccaccataattcttaggcttatgtctctccagttctggaatgttcgcagtggctcttagtgacatgaggtattggacaattgaaacatgtctggtctaaattggtatgttcgtaagcataaaatacatactggatattggaaatttactatacgatgtaaagtctcatagacaattttcatatatattagatatcaaaatgataaaacgtttagtgtgttgggataaataaaatataccattgatttaaattcttctgtttctttttactttcttcaggtggctactaaaaaatttaaaattacacacttttttttatttaatggcgatgttcctgttaattttgttttctaaaactgatttctagaagactcctcaaaaaactcccacgaggacaatattccttgggtgattgcatgttggtaacagtctttctatgaccgttataattgaaattcagttttactgaatataaaacctccggtccatattgtcttttcttgaatgtcttaaatatgttacttcatttttttctctctaagataaagtgttactgttggaaagtttaataataataatcttagttcctttttaactcaagtattcttttgccctacatgcccaagtaattctttttttcctctttcttaattttacttcgtgttgattgtactacgttaatattatcagttacactatgagatttttcagtaagtttaattgatttttttaaatttcaggattactttcttatactttttttttttttttgagacagagtcttgcactgtcacccgggagtgcaatggtgtgatctcggctcactgcaacctctgccgcctgggttcaagtgatcctcctgcctcagcctcctgagtagctgggattacaggcacctaccaccacacctggctaattttctgtatttttagtagagctggggtttcactatgttggctaggctggttttgaacttctgacctcgtgatccacccgcctcggcttcccaaagtactgggattacaggcgtgagccaccgcgcccagtcagtattgaattttttttttttttttttaaatccttgctttattctctcactcagaaactcctataacattcatggatctttttgccatctataatacatgtcacattttcttgaaacctctttctttattttttaatttctttttagtgttaaatatttttctccttctcaacttgatttcctttaaagtgttatttttgtacttatatcctcttattttccttctagattagtcttattcctactatgctgtttcttttctttctaattttttcttgagtttgatctctttttctacttctgattaatgtttttttcatgtgttgcatgatgattttcttaatgtcctttagcttattttaaaataatatgttacacttttgaaaacattttgagcatgacattttttggcaggcttattttgtcaatagcagaagttggtaaatttcctgtaaggttcaagacagtaaatattttacactgtgtaggccatatggcctgtcacaaatacttaacattgccattgtaccatgaagatagtcataagcaatatgtaaatgaatgagagtagctatgtaccaataaaactttatttctaaaaacagaaagtagactggatttggcctctgggctacaatttgccagtctctggtccataggaatttcattctatgtttccttgtagcaactttgttttgggggctaaactttacatacatggcatttgaccttgatagttttctgttgctcatttttgtataaatttagtttttttgaacttttagataggtaaaatttaagactgacttttcaacctaaaggagatccttcttctcttgttatgtaacagtaaaaaatagatatattggcttgttttcatagatttcttatatctgtttacctggaaacaggtttgtctggattttctctttcctgcatttttattatgtctattcagttcaattttgactccacttctagtagtttatcctcagtatggggtcctgttttggaaagatgcctggaagtttggtttcaagagttcacaggatctagactgcaccagccacctaagaccttgacatagacctgctaagaacaacgaaacagctgagattttatactgctttcgagctaatgagttaacccgccaggtttatggatgtcggcaaaagacatgagactgagggtcagagacaaagactttgattactcatagtataatgagtaggatgaacatgaacgtatttgtgtgagttcttcttctcctcaagtaccatgggaggggtggttaagccagatggatgcctacccacacagtagattgcagtttatagaagaggaaccctgagcttaaggaacccaaatcttttataatggggagtaagcatgcttgttttttgttccagaggaagacattatcttttttatactgaagagtaataatgcttgtcctttgctccagaggaagatactagtccttctttccaggttaattgctgcacaaatattctttaaaagatattatgaaacagggtattttcttctgataagaaatgcagaaatatgagggaccaatttcctgttgggaaaggggctccccacagggcccattttacttactgttggaatgcacaaaacctctcctagttccactcagtgttcttatgttggtccactgtagtttctagtgaatatgcattgactatttgggggttcctttcttaaatattttggaattatcacaactgtaatttgccctactgctttcttctgcattcgctcacatagacacaagggcacccacactgtgtggcttttggtgtttacggatttgcataggtatctagttatttagaagtggtgtaaatgttgtacatttggttctgatatctaactctctatctagcctaaacccatgctgtcatcacagcagcctatcttcccaaaataaccctttcaaaaaaagtatgccaagcctgattttaccttttttgaagtcctcattttgagcataaactttatttttccctaaaatacttatatttttccctaaaatacttatttctaagatcttcctaagttgcataaaaatacttgtctctcctacccctcccccatactaagtggtactaagttgttattattttaagtggaggggccagtgttttctttctttgctttctataacattctgtatcttattttcttgctatatttgtataccccatctatcagcaattccccttaccctctttccaaatatgttgtcaaaaactagcaaagcagataaacaagcttatttaatatgtgtgcagaggatgtaaagcaaaaataactatcttctgagattgagcataatcttagaaatttctattgactttatggtccttttggcagtatatatagtctagaggaatttaagctgtatttacaacaacaaatattttattcaatttcaatatttcctcagcattttgcccattatagctcttcctcctccaaatttagtatagtgtttatatattaggtaagaaataaattaggagtgatagtgcaaacataattctctccaaattctcctgtgagctctccacactggaagcttggtacttcataacacgtagtacctgctcctaagcagtagaaaattccatgcttatgtggcttttacttaatgttttagaactaagcaatatctgatgggttcttactcatatccaacatcagtagatcagatgctgatatgatgaatcttgataagatgaatcttgatattcagaggaatatcaagactatgtaattcctacatgtcaagtagagaaaagtaaaatattctgggacaacagaaagagaaaatatattttccctggatgatcctattcagtaaaataaaaaatacaagattataggagatgctaatagagcttaatattgagagggtgaataaagatttttttttcaaagagcatttcctctgaggctccccctacttaggcaaggagactgatgtagacccctacccaccaccccctgagcacacacacacagttaactccagtccccaacagaattcctctccactaagcattgatattagtagaaaagataagatgccccatatgacaattaggatgctgaacaagctattaggttggtgtaaaaaaattgcggttttgccattactttttttttttttttttgagacagaatctcactctgtcacccaggctggagtgcagtggcgccatcttggctcactgcaacctccgcctcccgggttcaagtgattctcctgcctcagcttccctagcagctgggattacagtcacgtaccaccacaccaagctaattttatttattttttttttttggtattcttagtggagacggggtttcgccatttgaccggcttggtctcgaactcctgacctcaaatgatccacttgccttgacctcccaaagtgctagggctattatatttaattgcaaaaaccacagttacatttgcaccaacctaatattagaaactaaaggcattcaattgtgcagtgagatagacactacaaagagtgaaagaagaaagtccctgtgaacttgcgatgggaaggttgtgaaaggtgttgagtcctaatagatcagttatattcgggaagatgaaaatgtgagtggatggcttctccatgtgaaaggtcaggggacccctgaagggaagaggactgcccatttgtcctgtgaggcttttgatgtcctattaactaagattaaacactcttataagtgttgctcagtaaatcaagttgctaactgaagggtgattttctagtcattgatatgtaagaactatcatatctgtaatagattcctcctcctcctctgatgcttacggtctaattgttaagtgtaacaaatgataaaatattacaaggcaaggtaagcttgaaattaattagtaatatcaagtataacttactgacagaggaatgaggaagttacacttttgactgcattctaaaattatacaaatatatagaaaaccaatggcagaagcaatatttaggcataaccagtgggatttatggtatttcatttcatgattcttatgaaggtgttaataagccaataagacttactacaccctaacatccctaacaacttcagaatgtattctcttggcgtttcccttccctttttctcctcctactctaccttgtctcttcctcttctttctctttcttctttgatttggataaagatctgtgactttagtaaatatttagatatgcaggatagaaactgagtgacttaaacatttccttactctcccaaaaagatacagatgtgtgacagattgacagacagatgaatataacaagggatatacactagcaagcaactcatcgtgtctaatagatgaaacagaattaaacaatgttcagtattgaaagatgtgttttaatgtgtcttatttcaatgtactttgcctcccctgatatcccgaaactattatttgtataatcacctgactctgcatggtgaaaggaacccaaggacttggcctcaagtttcctttggcaatagtggaagaaaaatccccagtggtagaaagtcaattggtagagacaatgccagggactctttaatgtcagcggatgctctagggctattgcaccagaatcttcgactatctcttgttttctaggggaaaattcatgggagaatttgaatctagtactaaatctttaaaaacaaattgaacattgtggaagtgttaaaaaagatgaaaatctttccttccaaaaattagtcaagatcttacagtagaattttctctttcgatttgtaaaagattttctagaatgggaaatgtgttttgtgctattatgggaattttataaggaaagaaattgagtaaccactatgaagtctaaatctaagagaaggctcagtaatatcgtacttttcaaggaataaaggaagattattttgaatcattagggaatcttgtcttggttatggaaacgagaaataccagattcaaagaaatttattcatcacaggcagacattatctcaaaaggacaaatgcgatgccaatgtttctaaatactcctccatacatagcaacctctgtcatttgtagacaaatctgattgagaaaactttattttatttctaaagagttgtgaaaatcaggaaaaaaaataccattaatatcagctcaaagagatgatggaaggttttcttttttcttttttactgtgccgacataaccaattcattaaatgacaactcttaaaaaataaagagcaaaataaagaaacacacatcccttgttgggcatctagtgggtaaacatgacaacagcaggtaaatttctcacgttctcaagttgttttggtgttacaattcagctacatgtatacagagaaaagcatacacggtaaaataatctgcattgttttactgtcttaattcctgtatatatgacacagaagggcggtggggtgaaaggaagatgtgaggttttaaatatagcaaaaaaaaaaaaaaaaagagagatttgacaacactggacctcagtaggcatgggcaatttgttcaatatcttcaggtctccagagagcaagaatgactctcaggatattgcaactctgtctgcttccaccagagatcataattgggctatgaatttttataacaggaaagtcttcctgtcaaagacagagactgacaaaaactttagttaactgatactgaaagaaactcaaaacagaatgaatagtatacatgagtatcacttatatatatagtgcctttacttctttcttcttttttactttaaaagtaaattcctgttatagtttactggttagagcttctaaaatgtagcttgtttatgaggattgctcagcatactggttttctgtccagggacatgatgtgcattttggggaattcaaaacccgattgaggtgagtagaggtcattcataaatcgaaaccaaatgatagcagaagatatgaactaaagctatttctttatctgcaaagagctaattgggcatatttcaggccaagtctctgaagacacagctcgtgaactctgtcttcttgatgctgtgctcattatagacactcaacagaggactggctaatgctagggaaatccccatcaaggtggtctttacatgacactgcagatttacctcaggaaggggagcaaagagaaggaaaatgcagtgagggtttctagcaactagctgcttgtggagtactgtttgccttgtctaatttatctgaaactgaagagtttgtctctaaagggtatcctacttcagaaaatctcaagggacatttgtctttctgacatatcagctgttagctagaccttatttcttacttggttgtttttagagtaaattttggttctttggtcctttgtctgctatttgaggtggaggattaaatactgcatagatgacctatgtatgtatagaacaacctaattttgccacagataccaaaacactataacgataatcttcaattaatccaattattatctaaatttcataacccgtcctcaattatctaccttaatatttctaggtaaagagagatgtactgcattgacttcctgtttttaaagggtaaaacagcaagagaaagaaagacattgtagatattcacaatgttgtatgtgaggaagtttttgaatggcttcagaaacccaaatgaatatattgagaaagcagcattgtgagttctgtctacatgtgaacccaaaactaggatttgaggtaatccattttcagaaagaagtgatggagtttgaattctaggaaatcttcctgaataaaatggccatgtgttgtaaagtttagatatttataacccaaaatagaaggaattttgctaggtgatctctccagttccttttcagttatgagagtctgatttcttcccatgaaaagtgtagaaaaacttcctttactgttatatgaatgttataaaatgtatgcttgtccatgaattagctgatcaaagataatacatgaaaaagtattcaaaatactctgtgaatcttttttttaaaaaactctctttaaatagatttttgtattcagaagttatgctttgtaaatacattttaaatttcagatttaaacattatcaagacaaaattgtgactatgtgcatgtaaaactagagagcactggaaaatatggtggatggtaagggccttttgcaaggtaattaacttatctattgagttttttttttttaatttctaagtacttaattgactctcccactaaaatttaaacatatacaaataatttttcattcagaagataggcatttgatttataacatcaacatatcatcacaaaaacttagagaatgagaatatcttaatgggcacctggtctaaacattttaattttaccaggtaaaaaggtggaagtggcatggcatggtggctcatgtctgtaatcccagcactctgggaggccggggtgggcggataactaggtcaggagatcgagacaatgccggctaacacggtgaaaccccgtctccactaaaaatgcaaaaaattagcttggtgtggtggcgcgcgcctgtagtcccagctacttgggaggctgaggcaggagaatgtttctttaaaaataacatcattagaaaccatacaaaacagaactgcaaatactcccttctaaggtgtaaggtattccaacatttcttgtttggacgttagaattttttcttcagtaagaaattaagttgaaaatgaagtagaacatcttacactgtaattcaagtgcaatacattaaaaaaataaaaacagtgtttaaattgggaaaatccgtttacatgtgattaagttttaatcagtgcccttaacccagatctcaacagctaaaaatgttcttagcttgacaaaataacaacccatccccaaggacaaatacttaaatcaaagaagcattttataaataaaaaaattcacgcacacatacacacacagacccccacaatacatgaaacatataataatgtttgtctttatttgtaatgaagtggattttatactgaattcagaacacagatgcaaattcaacagttgaactcaatcaaataagtaatcttatataaaaggatatctccctccagcatgtacttatcctgtgtgacagatatctctgtaataaagtaaattccttcaactcaagcagattgtccgaaatggaaacacaatgaaaggatgaatatactcaaataatcaacagaagagcaaaatataaaaatgcgaacattttctgaataatgcagatgccctccctccaaaagaattacatgtgagggaatatctatattgtcataattactggataagctgcccaatagctattacactaatgtttcattaaaaatatatatttgctttatgcttttgcaacttgcaaagttattcctagcaaaaagttatttctcctgaaacagaataaataggtctttcacaatatgcactggaatacatatttttgaaaaacaagatctccactcacctctaattctatctttctgctggtgattactgatatatttattttaaaatacatactttataggaagtatcgttacaattaatatttaggacaacattataattcgtgttttagaaactactaaggcaagaggacagctcctaccattctacaaaagtctttcagttaagaagtgactaattaatggactgagtggctcagagcagggagccagtccttagccaataaagcccaactcactgccaccccactgccccatattctctgtcctctctgctggaactgtcttgtgctgaatacatgaacacctaaatattcaactcactcctgccatttctccggtaagcaatcttccacaacctgtgcctgagacttggaggctgtttgtggtccacaggctttaggcgccctagggaaagccacgtgcactagtgcatctggatgaactgtggactttgtctatccgcggtaattcaacttcctaagagctacattgactcattgatttgtatccaggctccgggctcccaattcccacacaacgtaagctccctgcagccaggggatttggtaggtttgccgtgttgtttagtttctctcccctgcgaccctctctctgagcctcacagtgtgtttggcacgtggtaggtgctcggtaaacctactttgaatgggagagggttgtgttgaagaaaggaaaggctgggaggacttaagatttgaaggttttcctacacgtgtccaggaagaaagaaaaagaaaaaagaaatgagtatcagagtcttatcatcattacagttcttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctggggcgctggagcgcgcgcagtggcggagctggagccacccagtgcttcgcacgggcgcgctccgcttctccgggttttagcggaagcctgcggggggcggggtaaccgcggaagccggcggccgtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccagcttattgctagcgtgggatagagggagcgcacgcggctaggctccagcagcgactcggcttttcgcgtattctaagcactgaagagcctcttaaggggagctgtccaaatcgcccaggagtggtggcgagacacaggaggccatgccagcgatgctgttattaatattgcagacttggtcatctctcctggcttgcggtttcttttctcctcttccctccccttctcttttctctcacatgtgtttcacacaggtggtggggattactcaatgacttacagctcccttctcgtttattagtgggagggggttgaatgttggcagttcttacaaagcatttgttttcttaaacgatcctgtttgatccatactctgagataagtatgaaaatattaaaacatcatacgttccttccttttataccccttcctcctaatccccagcacacatcagaatgtaaacattggttagcagatatagaaaaataatttcagaacgggaacatggattgaacatcctctttcaggctgacagcccttaaatttcattaacaagccgccgagcctctctactgctctgggaatgatgctaccagtaagaaagattagccaggtgagagtccccacatgaaatctttgctcactaacctgtgacaccagctggttacttgaggcgctgcaaacagttcagtgatggtggaagtgggatgcagaagcagagcagagcagagcacacaggagctgaaaatgtatgtgtagatagtggacacgctgtctatacacaacaaatccccttgtcaggattaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaactatacaagtaaatcacagctctgctaattttagttaatatcacgctactgatctaaataatataaaagaacaagatagatcctcataaatttataggagctttttttgatctttgtatcatttgtctctgatgacgagactctcaacgtttgttaaatgagtatatatatatttttaatggtcaatcagacaaggtttagagtttgttcacatttccaccaggtggcacccttctgctgactccagtgggtaaaaatattgcctaaaaagcgtggctgttctctcagctccaaaagcaaaacaaaaataaccacacaaaaacaaaaacaacaaaaacaaaaccatcccactttttagagtatgactaaaaagcatatttttaaaagcaactatttgactacaaagacagcacttgttatgcattttctttaaaaaaatgcattttggtaaaaaaccaatctcttacaattgaacgtgaagctgtcacttgatgaaataattcatgaccagaattgagatcaaatgtgtaatgtgtaaaatgccttctctgaaatatcgatgtgctttagacatttaggtaatatcaacttaaaatgttttaatacagaaattggtattcagtatttttattttacctttggtctagcaaaccagattaaatattcaaacatatgcttaatgaaaaattgcaaaagagttattcttccatgtgccctttgctaatatatacacatcataatttgatcaataaactattgtttttaaaacacaaccatgaaaagagctttcataaatcatattgaaaaattttaattaataaaaaacatattacttcgaattattcaacatataaaatgtcatatttaattgggagtagagttctatataatttggttataaaagataatatacattaaataaagatgttatatggaagtctatgatttgagagaaaatatgcatttcctactctccctgaatttcttatttttatatgtaaatattatatattatataaatttataatataaatatatatataaatttataatataaatatatattatataaatttataatataaatattatatataaggcattttgtttattaagaacatacaacaaatatctcttgcttagaatcttctaatatatctatatatctgtttgattatttcaggatctgagcaaatggtacattttaaaaagattaaattatataaaacaacttaaagaaaattgtattattaaatatcaatgctgcattatcttatgaagcacattacattggaaacaaaacaaccaaatttctcccagtctcagtaaaaataaagcaaattcaaaattttggtttcttgaattatttatgattacagaatgtcttaagctttactacttataggcacattttaaatttacttacagtgtgacatgtagcagacacaatgccagaatgctgtgactaagattgtgagattttgtgctatcaacaacaaatatttattcatcactgtctatgggttatgcactggaagtcacagagtcaagttcatatcccaggtccgccaaagaccagtgtgttttcttgggcaggataactgaatttccccatttcacctgtgaatggaggtgactgcagttccctttagatgtttgttctaacggttaaatgaaataatatgtaggagtttttgaataaggtctgactcataccaagtcttcttattaaatgtgtagtctgggaataagagcctagacaaaatagaaaaaaaaaaaaaaatctgggcctggtgcagtggctcccacttgtaatcccaacactttgggaggctgagatagatggattgagcctaggagttctagaccagcgtgggcaacgtaatgtgactttgtctctaaaacaaacaaacaaacaaacaaaaaacaaaaaagaaaataaaaagaaaagaaagaaagaaagaattatcagggtttagtgacatactcctgtggtcccagctactcaggaggctgcggtgggaggattgcttgaacctgggaggtcaagaccacagtgagctgagattgtgccactgcactctagcttgggcaacagaacgagaccgtctcaaaaaaaaaaaaaaaaaaaagcctcagattattaagccgtgtatagctgatccattattttaagtttacagacaaccatattttgcagtgcacatattagtatgattacacatgagtttttgggtgcatgcaaatattatattaatggatttggacatcaatcctattttggcaggcatccagatttcaaaatattctgttacatcctgactttcattcaatcaaaattgaatagtaaaattctttactgttctactctgtaagaagtcaggctaaaagtaaactttggctaattctcaccaagagttgaattagctgctgaatatgttgcatattgttttcaatgcaatgtacttcccaaggtaatcagcatgagaaagaggatatttaaaggaaagacagatgggatttatagaaatatgtcagggggtgagatttcagtcaatgtagcaggagagtgtgcttggcagtggagccaccaagaacccagggtgcatgtccctactgttatggggaggggcatggaattggattaaacataagtcaaaagactttttcacaaattttttctacacctttttctgtgtaacctttaaacacacatgtatgctccacttattaaaatcatctccatatattttcatacttgctaagtgacttgtgtgtcctaaccaagttcatgtatgactaacattagaatgggggccatatactaagacatacatcaaccaaaaaaaggttggaggtttttccatctgaagacttgtgcaaggtccaaaaagaagccagataaatgataaagggactgtaaacttcttcataaacttatatccttatggatagttagaattgttcttgctctagtgaatgctgtcctgccttgagaagttgtggagtttagtattgattattcccagcatactcttgttttaaagtttttattgacctgatccacaagttttctggcaataaccaatctctgtttatttgtccctatctaatagcacctgttctctaaggcttttaaaattagcacttaccttctttctacacggtagacattcttatcattgactacatattaactcaaggaatggttgtcgttttcagtatagtagagaaggctgggaagtaggttcggtggggagactggggcactgaaaagaaagctcttctattgtagatttatgtttgttaagctttcctaaattcttagaatctcaggcatatccatttgtaatggtaaatgtgtcatccactgccaggctaaatacagaaaactcacttttatccaaaactgataaaataaatattttgaattgttctgttctgtaattgatgtgaacagtattcttttaatgtcttccacaaaataaaaaaaatttttttctaagtttttcatgccatagtttatttaaaagttattaaaatattctataacatttttggaattgccaaatgattttcaaatttaattacattttggggagaggcaacgtgatgtaagactgagaacaaggtcaaacagatttcagattgattccttcctctgccatttactaggcaatttataatcccactaaaatcattctttcatcttgaaaagggagaggatgatgagaatgttgcaataattagagaatctatgtgaatgagtttttattgcatctggctcaagcttgaaacctagtaagtattttcattcttaatgctatcgtgcttctagatcatctcagaaggatattttcttcttttacaaaagtaaatttgcacttatgtgaatgaaaatgctgaatatgtgtgtgtacaccattatcaaatatatacacactatacacacacatatatatatatttatgatctaaatgctatggatcttttataggtagattattatagggcgttagatgaaaatgaattcgtgacaacttgactgatttctactatttttagatgaagagtctattttcacaaaagacttagagtcttgtttgatatgttcatggtttaatattctctttccagaagtttggtgcccaggaatgatttacttagaaattctttgcatacgggaacaggtgatattatttagttgaaatttaagaaaagttagttgagtgcataatcaaaaccgactttacatttgggaatgttctccagccaagctatgtattatctaactttaatattattgtaattcgtcatgcttactggttttctcaggtcaagacaaaataactatgtatcagattataaaagatagcaaatgaagaaaagggaggataaaagctatttttattattcttatccccactctctttttgatatgtaaatgaagattcagtttcttattccatctgagaaagtctgctctgaaaacagaaatgtgacaaatctgtattacgtaatcaagaacttgagtggcaggctgccctgtgatttattttcaaataatggaccagagagaccacttgaagttgcattaataatgcttgtacagggagaaataggcctttcttgttattggaacatgggtttacttttggcaagagttgagtaagtgaaaactctgatattcatacttacattaatcacatctcacctccaggaatggttttaatgtaagttaatcaatgcaaaacatggctcttttttttcacttcacatgttttaaaacaagtactagaagtctttcataaagcaatcctttaaatcaatgtgtcacaaatttgcattgataattcttctctcttagacacagaatagaagatgaggaactgagacaatgtttgaatagaggtaaaaatatatctttttgagaggaaaaaaaactgaaatccatgaaggattcctcaaatttagaataggtcatttgtctggcaaaattagtctataatttaaatttcctaggatctatgaaattatgaatagattttctatctacctcactagcttttagggacttcaagggaaaagacgatacgtttcacctgtatgtacttttttagagtactataaaacataagtggtccaataaataaagtgaacatattttgaagccaaacccaacatcttcatcagggttatttctttttttctgatcttaggaattgtgtgtaccctacttcttgacacccatagtgagagtgataggcatgtgtgaattgaaccagaagttgaaatgaaagaaactcccctccctcacatttatgaaggttgcttataattgctccaaaatgagatttgctcaactttaggccactgtggcatgatgagtggctcattattacacatttctatttgctcagcgtcagtatctctgcactctaggatggtacttctcgttccttcatctctctttgcatgaatgccatctccaaacccaaatccagttccctccgcctctctacatttctgagagccatcgtctgtctaagagttgattgactttctgagaaagaatactttgatattggctgggcacagtggctcgtgcctgtaatctcagcactttggaaggccgaggcaggtggatcacctgaggtcaggagtttgagaccaggctggccaacatggtgaaaccttgtctctactaaaaatacaaaaattagccaggtgtggtgccacatgcctataatcctagcgactcaggaggctgaggctggagaattgcttgaacccaggaggcagaggttgctgggagccaagattgtgccacttaactccagtctgggtggcagagcgagactccatcaaaaaaaaaaaaaaaagaaaagaaaagaaaagaaaagaaaaagaatagttggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaaaaaaaaaacaaaaaaaaaacaagttttaaaatgctttgtgtccataggcaaggctcatttgacatttcttgatttctcctttgtgatgtgctagttctaggtcagtggtccttagacttttggcacctggccaccagacatcacagaagtgcatatgcatcttctgtactttgccatggcaagaggttacacgcaaagccataatgccattctgaacgtaaactgtgaaattcactactccagtgaaatggcagtgccaccactacacaaacagagttgactttctcaagcttcccctcttacactcagcatgaataagcaactgctgatatctacacacagcatctgaaattgcaactcccagcaatgtagtagcaattgggtgaatccctcctaaaggagagatgctcttaacaactggggaatgcatgcaggtaaattttagagctttcttgggacattaatggaaacaacagacttctgatacactgggattcttggtaagaaaggcttctcccccgggcgtggtggtgggtgcctgtagtcccagctactccggaggctgaggcaggagaatggcttgaacccgagaggcggagcttgcagtgagcccagatcgcgccactgcactctagcctgggcgacagagtgagaatccgtctcaaaaaaaaaaaaaaagctatttccagaagctgattatttgtatttccagacagagttttcagagcaccaagttccaatacagaccagagaaatgattatatgctaaataaataagtccatgaggataatttttcagacacatgtaattatttttagtggatagacccagggatttctactcatttaacctgacgttaaaccctagaaccttgacatactagtttgagcaacttacccagcctctctgtatctgatgcttcatctgaaaatgaattgatgtttattttgcagaactgttgtgaggatcagcaatgaaataggtttactatccaagaggtgctgaaaaatggtggtgcttattatttggttattaatatgtgttgggttgttataccggacatagacagagcgatggaaaatcaaactatgttggatgttgaagttcccagaagttggaaacacagctttaaagcaccttttgtcattgtttgacattggaagcttaagggcatctttaatattgagctcctgttttggttggtatgcagattatatagagtcctcctgactccaaagcaaacatggattgggagttggttaagaagctgcatggcatccatttttatatttcttatcacgcagagaagttgacaaagtttatattttgaaaatggaaaactgaatatgcatttacttttctgaatttgttttttttcccttccccatccccatggttaaattccgtctcatgcttataatgtattctgcatttggactgcagcttcgttccttctcagagctacagttcttgagctgtaacagcgaatccaaaaaaactaatatggaatcacagatggtgcaaatatttgaaaatagataaatacaatctaggattagctgcttggactcagaaatgtcagcttcacattgcttattggtcacacaaggcaattttagttaaggaaaacacaggacaaagccatcatgatataaaattgctggtttgaagatgtgcagcataacaagcccataattgttatgtaaacctcaaaatgagtcattctgtaacaagaaaaaggtattttagagagatcacaaagcaccaacaggttatatagggctaaaaaattaagcagataccataactcgttcctgttgtacagtaccatctgctgacttccatttacagccaatttttaaggagaaaatatctgttctaatgggtatgctttaggtaggcacatattaaatgacctgagcatgagatgcaacagtcaaattgccagcgtaaaatctgcagatggtaattattagtaacatgcactgtgggctcatagttctgactctgagagtcttaaataatagaatcccattttctctccattatccccctttaagatgtacatatattctgaaggaatcttacaaccgactatgtgattaagttatctggtttactgataaggcagttgagaacgataaaggctgatttgctcaaaatcatacaactgatcagtttggtacagtagaaagaagagttcctcccacctaggttaagagttggtagaaggagcctcactcaattatcagaatcatagaaataactttggattgtctgtgatgatgtcgataaagaaaaaattgatgagaatgtaagtggaaaggttccagctggtttaggattttatttttatttttggtagcaggtttaataagaagatgtattgtatagattctatctgaaagcaataaggttaactatcatggtttgtgtaaagtctaggttttctgcagtatctcattttcctgatgaagtagaagagagtaggaagacccgttccagatcagacatgaagatctataagacagtattgatcgctttcaatgtacatgtttccaaatgagaaaatgtggttctcgtataagtatgtagtgaatatttgtcaataatttaacttattaaaggagccatcaagatggtaaagttggttcaaacagtatttgaggaagagagatttatatagtctgaaaaggaatggcttacaaagtttccaaaattaaatacaaaactggttaatattcaggccataacttttgtgtttgtctttgatagcagacagaaatttttgggtacttatatattttctataattaacatctaactttatagactgtgggcctatgtaatagcaaatagtaagagaaaatagggtacattcccctaaaattctataatcatatgtcggctgattagatagtgccccagtttgacattgaaaagatgaatgtatagttatacttgtttttatttacagttctcgaattgttttcttaacattcccaagctcagaaaaattgtgcaatctgggcctacacttgatgtcacagccaacttcttaagtcatgttattaaagttttctgtaaaccctgtggagcttccagtgtcagatttgattcaccagcagtgaggtcctggaatgcagccagtcagccaacattgcttgtcgggtttgtcccaagaaattgatgcaggtgtctatgaaggctagaggagaacaatttggtagtctcaaatagcttttctttggagaagatgagataggataattgcacacaaggaagtgagaaaccattcttgaaggatttagcaaaatgagattcggatcaagctgcgtggtggtagttgttcctggagatggctacttttagaaactgcccttagggagaagagagattaactaccaacatggtgtgatttaaggcatatcataaattttcattcccttgtgactcgcatctgtgactgtcagtgctctgaaaaatagctcttctcattcatctgtgtagctctggattccaccatgacttcctttgttcctttaacttctggctgggcaggggatattaacaatttatgtctaacttgtatcatttcctgctccgtgattgcttggtatgctctgtcttgagaacccatatttgggggccagagaagatgaaggtcttatgaatttaagaggggtgggggaacaggaagaaataaacatatgaatgggattgggaacctcaagagagaatcaccacttgcacatggggcaagctacttcccttcccttgccctttcctaccagtgttaaaaacaaaaaaataagtttacatgagtacttctgtgcagtgtaaaaaggggttcaatgaataatttggagtttaaaaaacttattgaataattgaaccttagtttcctaaaatatcttttactttctcacagaaaagaccagcgctattcaatagtacatactggaaagatgaaaatgttctgtattggtgttttccaatatgataaccaccagctacacatggctatcatgtttaaacacttgaattgtgacagtgacactgaagaattgtatttttaattgtacttaattttaattaatttaagcttaagtagctgtatgtggctagggctactatatattagagaatcagttttagaacactatccaaactttaatgtgggtatgaatcacttggggatattgctgaaaagcagattctagtccagtgaatgtgagctggggtccaagattctgcatttatagcaggtgcccagatgatgcctagtctgtggaccacactctgagaagtaaggctttatttctcaaaagcaaggattctctaatcctaatttatgtctttagccaggctgacacttgtcctagaggatgagtcagatgagcctgtagcaaaattacaaaatatgactttcaaattataaaaggaaagaatttcagtgacaaaattattagtatttttattattgacagtagctaaaattttgtgtctatactatttatatatgttgtatatttatattttatatattttataaaaaatttaaatatatttatatataaatatatatttgttatatataaacattttatatttataatatttatatatttatattatgtaatgtaatcaattgcttaaattttatttaatcctcaccataaccttatgtaatagattccacttttattccagttttgcaaatgaggatctgaggtttattaaagttaagagactcccaagactccacaggtagtaaatgcagaagttgtcttttgatcacatacagtcatacatattataataaccatcaacttctttcctgttattaagtggaggccaatgatttcccacttgcggctgatcaataaatcatatttgattcttttctacaaaggataatagtaagagccatactagtagttgtagtagtaatgctcactagaactctgtgtacaagttagaactgtcatcctcacttcaaagatgaggaaattgaggttcagagagggaacctctttggttacataatttgattacgaccacataacttgtaggtaggtggcagaactgggttttgaacctggattgtctgcctctggagtccatgcccttgtctgttccagtagacagtttctcatgtgtttggtgagcacctgctcccttaggcaatgcactgtgagcatggctactgccttctgtatattcaattgaaaatggagtttactttgaaaattttaatcatgtataattttatgtctatcaaaaatattttaagacaaaaagtcactctttattgtccaaaatgtataatttagtttgtagcatctttgaagccagtttttaaattcgtttgtcatccatgaagctgactttttaattgtgcatatttagttttagatcttacctccacttttttattagtgaagaactggtgagcactgtaagacatgtacatgtacgtgtgtgtatatgtgtatatattaatgtaaactttacaatttagaaaaacttaaaattgtcttccttgtctcccgtaatgaacttgaacgacaaattggcttcatcattttatgaaagagaaggtgaatgctttgctcccggtttttcagtaacctaagcatctgatttaagccttatttttcagaggtctttgtcattttgtttagttcggcagtcggtgctaacggagtctatttttttcacttccaattttaaataaaacacacaatcttctttaatttctgaataacatattcatgtagttcaaacatcaaatattacacaaatatatacagtggaacgtctccttcccagagttgttccccagctgtgcagctcctcattctgtcattcttttgataggtaatcactaatattattttcatttctttcttccagagaaatgtttgtagtttcaagctagtctagacacattctttacctctccttttataaaaatgttagcagacatgtttattttgaagtgtataacattgcttttgttttgttttgtttttgtttttgtttgtttgtttgtttgagacagagtcttgctctgtggcccaggctggagtacagtggcgcgatctctgctcgctgcaagctccgcctgccaggttcatgccattctcctgcctcagcctcctgagtacctgggactacaggtgcccgccaccacgcccggctaactttttgtatttttagtagagacggggattcactgtgttagccaggatgatctcgatctcctgacctcgtgatccacctgcctcggcctcccaaagtgacattgcttttttttgataaaaaccttgatattatcaaaatagaccctctaaaagttggcttctttaaaaaatgttcctccttttttcatgatgaattagatattatgtgcctcataatctgataagtgatagccagtcttggtgcaggtgtgtttactgtgcccttgcctacaaacagaagggaagagccatgctctccacacattgcctgacaaagagtaggtgctcattaaacacctgagacactgtctaccggagtagacaagggcatggactctaggggcagacaatccaggttcaaagcccggttctgccacctagaagttatgtggccctagtcaaattactttccttctctgaaccacagtttcctcatctttaaaatgagaacaacaaactaacttgcacacagtgttctaatgagcattattactaccacgactactatgaataccactactgtcatctgtggaggagagtggctactttactggtcaaccacaatcagcaaatcattggcctctatttaataaagaaaataaattgatggttattatgatatgtatgattgcatgtaacctaaagataactactgcatttattagctgttctgttttgggtatcccttaacctctctgaacctcagctcccaattagcaaaactggaataaaagtatttgatatgttggcatccacttcaatgctatatctgtgcatgtgtgtatgaatatgtatgtatatatacatttatttatatacatgctttccaacttaggatgaggttaggtcctgacataaccattgtaaatcaaaaatatcatcgggtcaaaaatgcatcataaattgaaactatcataagttcctctacctattatgggattgtggtttctactggatgtgtatggctttcacaccatggtgaagccaaaccatcataatcgagggaccatctagatagcattggtctacatatgttaatggggatcttaacaaattaaaagtagaaaagcttcctccttatccccagcattagactcaagtatgtatcccagcttttgcagattttaataagttgaaaataatgaatgagcctttcctagtagatgggtaaaagaaaagggctattattgaaatattctgaaacacaattctataccttataagatattcatgttaaggaaacaataaaataatatttagaaattttaatgtagaattgaacaaattccctctattttcttttataataagaaagattatattcctggatgtttgaatgacactgtgaagtctaaaggctagtaatggacataatcccgcattattaaaatgttgtttctgtattattattaaaaaatatagagactctcaatacatgataatgaatacgtggtgtgcttacgttttcttatataccgtgggataagcataatttgagaaatgagaggcatttctttaaacaatagactgtgctttattcacctgtcttagtctaaaaaggctatatgttgctgtcagtcacagcaaaccaccctctcagtgaataaggagataatagtatttgaggtaaggatagaagaccttagactttgcagaattcttttatgtttgcaaagaaaaattacctcgataaattataagcttatggatttttgtgtccttaactcctcatatattgaggaagctaagaattattctaaacttggcaaatttatttggtcaaaatattcctctctattccatcaagtagtaatggaatttaacaaacacaccaggaagaaaaatagcagcattgaaatgttttattgatccgtaaggatgaccagctctaccaagactcgaaaccgtttcacagaaggaatttttagttaaactattcttaacaataggaaaaacaagttatttcttttaagattctgtagagattatagagctttttaaaatcaaataacctcttttctctgaaaaattttaaagaaaaatcaattttttacaatacacctgctgaattattgcagggcatatttggtagctgctaatcttttaacacaaagaagaaacttgtagttgttaatgcttctaggaagtcaagctgctgaatggaaagtggtttttagagttcagattaggctttaatctttgatgtcctgctgggaatattaggagatgtatgggcatggttgaggagaggtacactgatagaaatcaactacgactttgataatttttttcaagaatcttattaagtaacccagacagaaaaggtacatgaaatgttaccaggcagattcctgatttcatattataaatactgaataggtatgacttgaaataaattttaatcagtcactacttacatattcgtacctaaaatttgggtaatggtaccatttgattctatcataaggaatcaagcctcttgtgtgttataatccaggatctttaggtcaaacctcttccttttgtgaattaacctgaaaatcctgtcagatcttctaattacggtgatatagggaagtttaataggaagtcaggattcccttgacctctgagatttcagtgtttggcggagtaccaagctctctgtttcaccagctactgcagagtcttatgacatacccaatggttgaattataagttatgcccctgaatacatctaaccatgacatcctctcactagaaatgtacatatgtatgtagatacccagactgatgctccaaggaaatgtttctagattgaaagggtgggagtgggcatgaaaaaatgtcctttctgcttatttatctcaatgtccatggaggtaactatttataatggaaggactgagggtaaccccaagaactcttgattataatgatgctctctccctccctccatgcctcccttcctcctgcctccctccctttcttaagcaaaaaagcaacaggaaataaagaagtgaataaaagttgtctcttttcctaaaaatatacgtcacttagtgaacacatctcacccctattttgatttacgaataaggacaacttaaaaactatcttctaatatgaaacaccttaacactaagaccttgcaaggtgcatctgttctttttatcctggagattaaaaaataatttacagacaaacagtttgggtgtgaaaatacttaaaatgaacaactttcattatcttttaagaaatcatgacggaagttctggtgaatgtctgtgctaacctgaagatattgagaaagtattttaggcagattctgttttatctgttacttcatatcatatcactcccttattcggtggcttaaaacaacgattttatttctcatgattctgttggtcaggagttcaggtggcttggtgggcagtgcttctggttcaagtgtgttgtttatcttgactgcattcatccggtagctggaaggtcaggaagacttcactcatatgtcttgtatattgttgctttttcatatgacctctctttctttctccacatgggtagtttgaacttcttcatagcatgggtcctagcatctcttaccaggaagttgccttctaaaagggattattccaagtaccgagggaaaaaaacccctgcagatctcttaagaatcaaccttaggagttatggagcctcttttctgccatatttccttggtcaaagcaggacacaggagcagcccaaatacaaaaggaggaaaaatgaatttcttgtttccataagagaaatggtaaggactgtgcagtcatctcggatccaccacagactatcattggctaaaacaacagaactgtatctggatacagacattcactataatagaagcatgtggatgatttaagaacgtttgaatgttaaaaatattataaggataaaagcgatgtcatgatgtcagtgctgtattcagccataatttttcaacacataccgttagccataatctatcaacacatgcagacaagttataatttatagaaaacagtctttcatgtgcagtgatgcttaaaaagataagaatttacattttcactgtaaaatagaaataaatataaagcaatcacctttatatagatgtagttataaaatatatttatttgagaataaatctaatgtaccgcttggttgaaaaagatggtatattccaaataatcttttcgcttcagggaaattatgaccatctagagtaattttgtgtcaaaaattaaaatatacagctagacttctcagaagatgtgtattttaaggaagggacaagtacacagaagttggttattatggccacaaagatactttagttgtgagatataattacattaatgaattctgccactgtgaaatccttgatgttgtcacatttcaggctggaagaagtaattgatctgggattggtgggattccaaagatttcacagaagaaagctttttcagatggttgggggaataatcagggaaaacagtctttggggttatcaggaatataatataattctctatgaaatatctttttaaaattattccagcccctctttgggcattaacagtgcatgaaagtatcctgttctcagtgatctaacctttttaaaggtactccaatgcaaaggactttaacgcaaagtgtagatactcctttctatggaatataaccctagtcatgacaagtttctcctttgtttactccttggaataagtgaaggtgatttaactcagagaggaaggtagggaagctatttcagaaggaagatacctccctaacctgagtgatgggggttacctttcctttgcttcccactcctccacattgcctgttttgcttaaaatatgacttcatccctttttcttcttttgttgtcatgggatattggaatgtaggaaccaggatgtcctgagtggtaaacttagctccactacctgagaaggacgatgtggcatacacccaccccatggacaacaggctgctgggactcctttttggaaacatgaaatatttacacgcacacacacacacacacacgtacgtgcatgcgcacacatgcacacagaggcacgcacattaactaagggaaaatttttactttaacacttcccttggaataataagccttgtagaactaattgtggccagattttattcaaagcagaaaataacatagaggaaaattacctactgctgtaatgtgatggttttgtactccaaaatgaacatgagaatgttcattcattttttagagataggttttttattcacggtataaattttgtggaaaaaaaaaatgtcattcttccaaactggttgtgacctgtggaatttgggaataaagccacgtgtgcattttaagcattcctaccttggtgctttgggttaaatgccccccagcggtcatccaatagaacctttttcttgcctccctcaggctttgaaattacctgtttactggtgtctctccatatacctacacatttcttgagggcagggactggactttcttcattttgaatcatcagtgaagagtttcaaaaaatatgtgtgaatttgcatttgtagtagaagtgctttgaagaaaagagagtttgaaatttaggagagggttccatggcaatctttattaagttgattggtatttataatatcttccagtctgtggatcgttttaaaggtatgctaggctagcaaagctgataaagtcagagtgatctcagattgacaggtgggataaataattagacttttggtatataactctcacagagaaaatctagagtgagttgatgcacagtagaaggaaaagagctctaaaagctagatcgaaagagctttttaaaaattaggaagagcaagcaaggaggaggggaatccagaggacaggaggatgtcagagggctgtgtttcatgggggcctctaaaagtgtccatggaaagaacgctagttgcagagctcctgggggagacaggaggagaggtgcacaagccaaactaacaggccagagtgttttgtttgcaacattagttttaactttaaatacagccagtttctttggactcgcagcccagacagggagagggaatagggaactcaacgacttcttgaataaacaattgcaagaaagtcagtaaaacccaatgagaccaataatgaccccacaaggtagggcctgatcctgtgggagattatgggtcagaataaaaacagttagtattttaaacgtgtgttcagtcatctgaatgatataaactttagctattattattatttcttcactataatttgtcaagtggaattcttttgctgcctgatgaagatgatttgtgcacttgagctgaccctgtattggatagggaggaagaagaggtcatttcaaatagaaggggaaagtaaagaaaagttgcgtgaatatctgtagaagacacgtgtgaaatcttatttcttctctttattggacttttacaagacgatggcagcagcagccagggatgcaacaagagtcacattcgctttgaaggctgcccttgaggaatggccccatttttcacaactgtacagaagtcatctctaggagagctgcagcaggcaaagccaagccggctctaattaatgacccaggctaatattggtctttgacgttcttggatattaataaatgttagataagaaaagcagctgtttatctctttgcccaatacaccttcaaacattcgtacaggagatagatatcctaatgtaaacatttgcagcctcacatattgtcgggatctctgaactgtgactgttgacagcaggttgccttaagtaattgcaatgagacagaataatctagtagaagctattgtcatcctaagtaatattttcctgagaaacagttatgaaaaatgaataatagcatttagtaatgcataatgtgagagtcaagaagaatattgaagacaaaggatacaatcatcattgcttgaggaaaactaaattttatatagctgtcctttgttgttatgttaatcaaattataaaataagcgatagtaggagaatagcattgctgtgttataaaattagttttagaattagattagttctgtgacatgagatggatcacagtgagattatacctcatgagtactcaactcttgtaaacactacaatgacatcgttaaatattccatgcttaaaacgcacagcacgttaactcctttatttcaggggttcgcttttatagttagagaaggttttttgtttctttttttttttttaacttttagactatacgcatacaatatattacaggtgcctgtgactcgctctaaaaatgttggaagctgaactgcatcatattcttgagggagaacttaatgtcaagaatttaaatttgcaacacccattaatgtgtatttagagcatttcaacaaagaaatacatttagtgacaaaagttttaaagtattacagaagagtcagaactgaaagataactcatggaattttaatgtaccattttaccaaatgtcctaaaaaatgatgagtactttcacaagtaaaaaagtacctaaaatttattattgttaagaaacattttatgtcaatctatgttaaaaccacaagtttgtaaatttctgaggaaaattgcattaagagtgtatggatattttaggataatgattaaaataatccaagagaaaataacataaatacagatatttaatgatatccaattcggcatagatggatgtggctctaattcagtgtggcaggaactccagaaagctaattttaacaaaagaatgtaatctgaacaatattaaacatgtaggtcactgtatttagagataatcactataattttaaacctattagtaaaggttgtaatgcaagtgtgttgtgctagagttctccaggaattactctcacttctctactgaaaaatattaaaactaccttcaaagataaagctgattacagcataacaaagcaactcactaccacctctacttcataataaatacaccccacattgttgtgttagacatgagtttcacacaatttattgattagttgaacttttaaaaagtctattatgttgacttcatgtctaacccttttataagtgagtggaaataagttcttttatttcttcccctattccctcactctcatcactgcggagctccgttgtttttattatcttattcattcctggtcttagttctcttagctttgttctgttttacgtgtaaacccatttctatgtggaagttcttctatgcagagagagcaggagtatattctttatgcttgggacaataaacatttatagactgaacattatacaccaggaattgtgctaattgctagatttacattgctggaggagacatgatagtcctctcagagcctacggtggaatacaaacagagcagcacagtgattttctgagtgtaacagagcatgcagtcaatgctctgggtgtcttaagagctttgcttagcttatccttggtggtagtagtggaggtgagtcaaagaagtcttcctggaggaggtgacctgtgacctaaaatgtgaacagcagataggacgaagaagggggaaggatggaaggtggtcatttcaagaagtaggaagcagcatgctcaaattgtataaccctcaactgtatagtatttgtggaaaaattataagcaatttatgtgactatcatatacagttctaggaggtggtgtgtgatgaggtaggaggagccatgtcatggaaattgttgtccttgtaggatattcacagcagcttgggctttaccctagaagatggggagacagttggagagttttaagtaggtaactggcatggctgactttacatgcatcattctgccagcaggacacagaaaggacttagaatagttatatgctagggtacagcctctagccagaggatgtcgacaaaggacctggactcaaatcatggtccacaattctgccaggttctagccctactgaattcagaaggtggtgcaaagattcttttttttttttttttttttttttttttttttttttgagacggagtttcgctctgtcgggcctgcggactgcaatggcgcaatctcggctcactgcaagctccgcttcccgggttcacgccattctcctgcctcagcctcctgagtagctgcgactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtgcaaagattcttacaattcataaagagaaacaaatccagctatggagaagaacttactttttagtatagaaactttcagatatttatggacatttttcatacatactaaatcttgaagcagagagcgacaaagacatacatttgtgattcaccagcatatacatggtcgtgaaaattgtgaaagtggatggagttttttaggcttggtttatattaatataatgggaaagtgatggtccaggacacctaggaagtttgggagttcaataacaagggaagaacttccagagagagctggaaatggaatctgtaaattttaaagcagctgggaagcagggatgaaatataatgtagtgggtgggagcatgacaaagctcagtaggcctggtgtggtggctctcgcctgtcatcccaccactttgggaggctgaggcggtcagatcgcttgagccaggagttggaaatcagcctgagcaacatggtgaaaccccatctctacacaaaataagaaaaaacaaacaaacaaaaaaattagcagggtgtgatggtacatgcctgtagtcccagctacttgggaggctgaggtgggagtatctcctgagccctgagaggtcaaggctgcagtgagctgagatagtgccactgcactgaagcctgggcaacagagtgagactatttcaaaaaaacagagagacagagagagagagggagagagagaggcaaagagagagagagagagagagagagcgcactcaggagagaagagaaatctcaggagagaagtaagtttcaagaattttgctgatcaaggaaggaggaagactaggaatggaggaaacatgaaattcagcagactaccttttgaaaatttttgttttatattatttgtatgcttttccttcgtattttttaggataaaaataattgaaagatgtgtatgggctacaggcaaagagctagttgagactaagattggaaatatgggagaaaacgggataattaaagaatcagggtcctgggtgaatgtcaggtaactggatctttctgtataaagaagtttgggctaatatctagaactacattatggtaaattttcacggaaattaactcagagggatcatttccagagtaattttaagcctatagagatattttaagaaatcaggccatattttagggtctctcaagaaaattcacagaccaggtcataaaatacaataaacgaaatgttttctaaccacacataaagatccttatacttgcttataaaaagagatataggaatttatactacactgcaataccatttatcaccttgagattggcaaaatccaaaagtagtgaatactgtcatgggaattgctgttggaaatgcaaaatgctacacctctttatggagaggaatttgacagtgtctagtaaaattatatatacttttaccccttgacccagcaatcacacttttagacacctatttcacaaacctattggtaaaaatatgaaaaaaaaaagcacacctaaggctgttcactgtacgtctatttgtaatagtgaaagactggaaacagttcaaattttctttaatagtattgttgcacatctatacaaatgcaatacttcacagctataaaaatgattcagaaaggtaactatactaaattttcatcattatatatgtatacacacatatgtacaaatatacaggtgctccttgatttatgatggaattgttataaatagcactcgaacataaatttaattttctcagcaaggcagttttacttctatagaagggtgtgacttgcagatggaacaatggcaagagcacccctgaacaagggaggggaaggcgttcttattctactgctgtgtcattcccctgttgtctagggttggaccacacagtctaagctaatgccgattggctatttttaaagagatcaggggtataagccggagtggcggggtgagtagtttggcaggaaggatggttacagaacaggtgactcaggatgagccgggacagagcaggcgacaaggggtgactcaggtcaaagcaggtgaccaggggaacagatgtgaactactgattggaactgacgggaaagttatttactgaaactagagccaaggggtgaagagaaccaggaagttaaactttaaaatggagcatcaaagaataacagagctgaacatactgacatactgattctttgaagagaaacttggggttcactatatttaacaatcccccatcttgaattttttcagttctttctcttcagacttccttaacatgacttggcttagttgttctgcttgattctctaaaagaaaaaacttctctgaataaggtggaggagaatttagaattaataatgtggaggacgttttagtaagtgctgcctctatgagtctgcgccccagcccacagatgcatgctatgacacaacacccgagaagaacgagtacaccttctacgctgcgagagaagtaagcatcgaggctatgattcctttccatttactgtaccatttttctagccaccctgtgaaggaggcatttactcctcctgagtttttggctaactccttggacagagcagttagaccttgcaatgcctttgttatacttccatcaggggtggtattgtttggatgaaggtgcaacattgagttttcatcatgaggtaaactcctccgctttctgctaatatcatgtctaaggctcttctattttcccaagccctctggctggtagcccctaattgctcagctattcctctaacagcatctctactgtagttaataaaccactgttggtagtaataaatgtaatttattcaaactatgttcttattaattgtcacccaccaaaatattgacttaaatcctgcagctatttgatcttgggttttaaattcatctggtactcctcgtggaactccaatagcatctatgtaaacatgggggtcaaaggacccatgtgaggcacttcttctacaatttttttttaatcatgttgacggaatcctagggtgaaaggcatgaccagttgaactagagcacaagtgctgctctaattactcggcagagtacccagcaagagtcccccgcaataccaccacacatctgctaggggatgaacaagggcagactggtgggtaagctcttggaagggcttggtttcactgcaccctgttaagtctacaaggaatactcgcttttcccccggcggtgaaaggcacctgttgaagttaacatcaggggctggaggccagatggccctcgggggctgacccacagggttcaacctcagggaacagcagtgaaagagtctcgcatgactcatcgccccaggctgtggggttttggaagagagctaccatacagctcatgcccggtccgtgagagaaccgcccaagtggaaaggggataatctgggtctctggcctgcctgtcgcacataacagtcgcttttgtttagcgtgcgaacagaatatttaatccattccagccaagcatttgtgtcctgatatcctgtttcaattgctatagtttgtttcaaatttttaacctctacagaaactactttggttttatcattgggtttataacaagagaaggtttggttagcggagaactcaggagaggaagaaggaggtgcaggaggtgaggaggcaatgaagcacatttcaaaggatcctatggggtccttccctgagacttctgctcctatactatagaaatggcttaacgaaggggaagaactctggggagcagagatggtaatctgtactgggttacagtgatttatctgaccacggggagggctaactcctttagtaaaatgaatatatgtggttttaagaaactgcaagtactagctggggcggtccatccttgctcttcggtgttttacagagcattggaccaacttcggcagagaagctctgctctaggaggacaagatttccagtttacactggaattttcgtcaaacacttctcaaactaacttgtcccagttcacagatttttagtctgaggaaagctaggaaggataaagtacttttctgaggtggagagttgcctctcacctggcaaatctccacagggtataacgaggcaaggatcaaatgtaatagtttgaggcagaattgacgtggttacgttaataagtaggtgaccagcaatagagtgaggaaagaagaaggagtaatagaatagatgaaagagagttacatttttcttagctttagtttggtagggttttcccctaggactatggcccatgacttgggagggggcggcgctttcttgacttgagtattatgggtccatcctttttctggtgtccggactgtggtttcggtagttaggagcactaggtaagatccttcccaggccggttcgagcttttccttctctccagctttggatgaggacgtggtccccaggctggtgttgatgtactggaaactccaggggtggcacctgtgctaaaagacctttagctctgagggaagagaaagtggaagataaaccaagtatataacttctgagaaactgatcttttgtttcaaatgtcgggagatcagtagtagaatgtagataaggcagtccataaagcatctcataataggataggcctatgtctttttggggaacagttcagactctcaacagggtaataggcctttctactttccctgatgaaggtgggtgccagggattatgatattcccatattatatccagtacctgggctaatttcttaatggcacgtgcagtgaaatgagtcctgttatctgaagcaatgttttctattaatctaaacttgggtataatattttcaagcaatgtcttgactgcattattagcagttgtacttggaaagaaaatgtcttctacccaatgagtaaggtggtctactattactaataaatactttagacgaccaattggaggcatctctgtgtaatcaatctaggtactttggaatggccttaagcctggactccttcccccaaggggtaatcttttactaagcaattgtctgtaaccatttggccagggtataaatctctatgcacccataaactctgaggactgcatcacacatggcttggggcccccagtgggtcccttgatgcagttggaacaagatttacctcataaggggtttggataacatttctctcagtctagcaatatccagtttccttctgaattctctttagtacctatttttattagtttttagaccaaagaaaaccaaacagcattttatatttgacagtgcttcctgtatgatttttataccagataagctaaatttcacctttatattagtgggctattaatgttaaactcaattttaataaaaccttgtagacatatttatccaattttaatgtctgaccataacataagatttttatagactctttttaaccctttataatttttgttaaagagcaggttagtgctttaagaaaaacccattgtgctttgattttaataaaaaattaaaataaattttaatttattttaattaattaaataaattaaatccttttacacggaatttcctttacaattaacgtttcaaaacttgcttaaactttaaaacaaaaaaaaaatttttaaccttttaatgtaggtatgaatccacattcttatgcctccttacaatccttttaccaaaagtatattttactttccttacacaccttgcaaataaactgtttcttcaatagttttacattcaggaggccgaattacttttaaattatacaacatttcttgcataaattcccttttataacatgtttcacaactttcacagacaatctttgacatgccttaactttttgacttgttgtaaacatccctttttttaaacaaccagttaatttactttcggacaagaatttaccatgtaagattctttttacatgaactctcctttttttaatgtcaaagatgataacagttcttttccaaagcaagcttcctttatgtctgtggactagactgcctaagaccaccagattagaagttaggataatacatgttacagtgttaacttttagcaaactttacttttgttgaaaacctgtaagtttgggattttaattaaagaaaggcttttctgatgtccagggccatggacaatagctgttccttttggcaagtgaagattatttatacgtgggtgattaattccttgtggaacaggtcttggtctttgctattaataagccctcattcagtccaaatttttccaaatgtatggaccactcaaaaggcgtacttagaatcggtaagatggttccttcctggttctctaagtactttaaatcttggctgagtgcaaacagctcacatgtttgagcagaccaattattaggcaattttcctaactctatttctacaagagtttctctatcaattattgaatacttattgtgtctttttccctcaatcacccgggaggaaccatctataaataagtgtcatccagtcctgaagggagtttctcctaggtctggtcgggcctttgtatggtaattaattaaatctaaaaatgtgtgctctctcttacgatttggatcccctgttaggaaacctgctgggttaagtgaattatcagtggttaatgttaaatcatctttttctaacaaaatagcctcacactttaagatttttgggtcagtaagctactttttggctttctgacttaggatagttctgaccttgtgaggtgtgctcacaatgaagtttcctccaaaagttatttttctactttcttctgttagcaaagccgttgctgctaccgattgaatgcatttgggccatctgcgggttactgggttaaggagtttgttgtttttttttttgagacggagcttcgctcttgttgcccgagctagagtgcaatggcgtgatctcggctcaccgcagcctccgcctcccaggttcaagcaattctcctgcctcagcctcctgagtagctgggataacaggcatgcgccaccacgcctggctaattttgcatttccagcagagacgggatttctccgtgttaaggatttttgataggaaggctacgggttgccagtggccttcgtgcttttgggtaagtatttctaaggctacgcacttgtttacactgacaaaaagatggaatggctgcttgaggggaaagctaggacaggggcagttactaatagatgtttcaacctttccatctgttggatttctggtaatggccaaacgaaggggtttggcccgtcttgcgtgagctttttgtataaaggctttgtttttagggcataagagtctatccatagacaactgtacctgactaattctaaaattttttaagttcacagtgttctgtgaacatttgtggaatctacacggcagaggactagaatggacatttatgagtgatgtttaacataacaatgccacctgttggatacagtaggagattactctgtgtttcatattcttagacactgatctcagcagacacagaatctcgggtcccctttggaaaacagcattttatgaagagcctttgatgcattatgcacaggagagaaatcgtggcggtgaatttcctagtgttgggttttgcctgtcagataaacttaagctgggacagtgtcttttgcagatttggggatatattttggacattcagtgtgcgctcatgatgatcactgactggacaaacttatgctgatgagtcagtattgttattagaagatgagaggggctctgtaatttgaaatctattttctactcctgagacattgaaagggattccaatttggattcaatgtgggtggctttcaagatagttcttttaagatcatgtgatctttgcccttctcacagtttagtgttgtctatttttaaagggtgttaggagtaaatgttgtttatgtttaagcatgataatataaccatacctcaccgccacccctaaaacccgtagagacgaatacatgatagggattgcaactgtggaaggtaaacaaataagcaattttgctcatttgttttttaaaagtgtgactatttgtcttgatagtaataccttgagcttgtgcttcaaaaatctgtccagctattctcttctgcagacatattcacactctcaagcctgcttctgttaatgtgtttatgtgattgttctaacacggtgaatactgcttttgactatatgtacccagaaattattattacatttttttgtaatttacagaaattattattactttttttgtaatttagataacgaaccaaacttgtggaccttttttgttcatttagaagtggtaaaggttgttccgtgccttgacagaattcttaacagctgcctctgccttggttttgctttatgcgcttccttccctcaatggccatggcattgtatttcgggacactcttccctccacaaagcaacagggcaattcttcagtggatattagaatttttctcttctttttctgcaaaccctgatgcacccatacacagcatatcttttgttttattacttccagtttggtgaaaaactggatttgtcatgacaaccaagtatttagtggaacagaagcagagataaagaacacatcttgaaaggaatacacaggatcaatatttcatgtccatctgaagtgttttcagtgttgttgaggaaaaagtatacatctcattgaagtgtcctttttttcccagggaccagatgttcattttatttatcaattgtggacaatccgtcaagcccagcaatatttttccagagatttccccctgtggttttctaatttatttgatatttaggaaaagaagaattgcagctgctgcagaagaattagagttcaacttacgtgtatgtgatcattggagcatgttcctccgtcagacattaaacgtttaacaggacacagtaacttatgcttcgtttgaattttgcatctgcctgcttctcctaactgggtgaagaatgctgacaatgacctactggattagttattcctctcctctattttatgaaatatttcatattttatatttcaaaatatgaaagcatattttaaaattactataagactatatttattttagatactctccacataattagtattgcagagcttcctgcttcaaaatgtatttgtaatttttttctaattgcactgacccataatagctaagattgaacctacatttaaaaaatttaatttcccttcatgttagtgggtaactataaccataaaagagactctttttttaaaagattggacttttacatttattaccactgtaagtgcaatgagataaggcctctgaccatgttcttttggagattgttaaggcattcatgaatcctttggagctgtcagcctgcacttctcactttgtcagaacatatggatgtgtgggtgtggtatgcaagctaactgtcctgaagaagcttgtcaaagaaatgtttggaggaaaaaacaccataacactgagcataagtttgaatatagccatatactagaataaaatatggatatcaggaaagagcttcctatcagagattgctaacattggaacttaaattgcatcttgaaaatggattaataaggtttagcccagtagtggtaagttggtggacattactagtgggtaaacattacatgggcaaaagttagtaatggaatattgaggaaaggagtctgggctgaggaaacgaaggagtaggcaaggccgggaggggtggctcacgcctataatcccagcactttgggaggccgaggagggcggatcatgaggtcaggagatcgagaccagcctggccaatatggtgaaaccccatctctactaaaaatacaaaaattagccgggcgtggtggtgcacacctgtagtcccagctactcaggaggctgaggcaggagaatcgcctgaacctgggaggcggaggttgcagtgagccgagatcatgccactgcactccagcctgggtgacagaatgagactccatctcaaaaaaaaaaaaaaatagaagtaggcaaagaggagaatggaataactggagttgggaatatggactcataaacttacctttaggaggagttactaggagagtttcacatcagcagtggtctaatcaaaaaagccaattaactccagccatttttagtcactgtaatttggctccaaattcaagttttagggtaagatatcttattggctgtatcttcaagttctttaagcattgacatcagattttctgtaacgcctttagagcctgctataaaccctaatagatgactttatctgggtagctagaatttgagatacctgtgaatcttggctgtaaaatttgactcaatttgcatcccatttggatgaagcaacaggatattagggttttgaagtatgcttatgaaaataaatatgctatgacgtttgtaattggtatgattcagaatttaattagataaactacctagcatttctctgtattttcagaatcttattaccaacttttgtagtactccccaaagagcaatttcagtaatttgtagtgtatctctggacgtgataaatgctattatatcactgtgatttgtaatagcagtgcttttcactgtgaaagatttactgagattttctaattgacttagagcattgcctctcaaactctttctctatttcttattcactgtactttctcatcacaacttagtaatcatattaatcttgctttcttggaaatgattcatatatttgcatgaagactaattaaaatacatatgcctgtcctaaatgattaggctaagacttaaatgagcaactctcagcttaaaatcctccagtgattccccagctcgctcagagtagaagccaagcctcttataataggtcgtaacaccctggtacttttctggattcatctcaaacaccctcttactaataccactcagctttatggcaccacttttggttgtggtgaaggcaccaacaaaaatgtttattgtctgaatttggcatgtgtgtgtgtagtagtgtatgtactcacatatctgaaaaatatttaccctttaatataactttctgtcactctgtatatacacctccagattcctccagttcagacatgcatttgcctttgctgtttcactggtctggaattatcttctctcagatttcttcatgtgttactccttcagcttcttaaacacgttgatcaaattacttccagtgattctttccctagagggatttacttaaaattgcatcactttttacttatttattctcttcattgtttgtgtcttctctctgctcatccccccagccccacccagacttaagatcagtgaagaagattttttttcttgttcctttacattactaaatctccagtgcctatgtcaaactccagcatggggttaataaatgtatgtagaatgaaggaaagcctcttccaaatgagtgcttaccatcattattgcctctcaagaagtagatcttaatatgaaaaaggatgggaaagttctccttaccttttcttctaattctttgccatgcttgaaacattaaatggaaccaaatttctagatttatttctatttacatctccaaacatttgcaatccttataaaaaacatggtagaggctaatcatgataatgtagataataatagtagtagtaataataatagctaacatttattgaagacctattaaagttcagatataacttttattatatcattaacaaatgttattaatttaataaaacctgtaattaaatttttaacaaacttcaaattcttgatgagcaactgagttgataatcctatttgcccattttgaatatgataaaaaacagccacacttacagtaactttatttatttgtgtgcatattatgtatgcattttttctgcttgggatctgttgtgtatttgtatggggattttagtatatgtagtgtagagactatcactgtcaggtaaattctgttatttcttttggagcctattggcttttaagcactcggcatgaaatatatatttcaaataactattaagttgttatcatctgacttttttaaaactttctacattaagggacttttcattaccttatttgaactactagttcttggtttgaatgtaacaaattcctgggaggcccgttttgaccgcaaagaacaatgtagcactatcttttttaaaataacatacctacttaccaaaagaattgggagaagaaatcttgattcatttaggattagactaaaaagttacattactttttcttttattcattatctttttgtttatagcatgtatcaagactgaagagatgatgattttaaaaagataggcattgtattatgatttgctttttcttcactgtttttataggatgattaaaaatatctggatttcataaggcataattgacaggttgcagatctgagttggagcacatatcaaataatatataaaaccttctgcttgatacttttgagatcaaacattgtcataacacccacagtgttttaaaataggccagaggacagcctcctggatagctgacctttaaccaacaggaagtatataaaatatctgcagagtagaatgactatattccaaacttagattagacagaaatgacaccagctctgggttccatcactgtttctgtgcatccgttgttgcatctgagaagcagagtgctttttgttcccccacacttcatctagtttgaagcaagaaaatttaacagtgcaacaaaacgaactgccttttccagctgaactctatcttctctgacagatggttcggttgggcgtcttttccatccagagcagtgctgtgtttgaagaatgaaagcattgagagagatcatttgttgtatagagcagagtttcaaataaccattactactggcaatctctgctgtaattcctggattttgagataggtgtacaaggaactctgtggtgagattaaacattcagctaatttttttttcccccaaagtcattaagtagctagcatttaattttttatatgtgcagattaaaaatgaaggttaagtaccaacaaaggaagctccgttcaggaaaactctggtatactctttggtgtctttggtggaaatgactattcattatgcggaagaataagactttataagaatagtatttccctaagcaggcacagcacttgagaaggttacagaatacctgtttactctgctaacctaattctctgtcgatttctcttgtcaatgccttttgatattttgacacagaatgttctacctaggaccactctgctgaatataggtcaggctctggactctttctgaacctattctcataaatcgcaattttattactgtttatacttgtctacttgagtcattccacacaatgggaacttatttttaatactaatttaaaccgaggtgctactgagtatcttgcttaacatatttgcagttcctgaagacttcagagttttatcccaaagaaataatgctcatagagaggaagcagatatactagttattccttggaagaggaagaaaacaggaaatggatatttggaaacaagagagacttccatgttcctcaattcatagcaattatccagtcctactttggatcatcctcctaatcctattaagaaaataaatgagactccaggcattacaaaatctgaaaggtttttagaaaaacaagctactctgaaagcgtatctttggtcaacacagccaaacacaactcacagttttaaaaacacagaaccggccgggtgcagtggctcatgcctgtaatcctagcactttgggaggctgaagcgggctgatcacctgaggtcaggagttcgagaccagcctggacaacatggtgaaaccccatctgtactaaaaatacaaaaattagccgaatgtggtggtgcatgcctgtaatcccagctacctgagaggctgaagcaggagaattgctggaacccgggtggcagaggctgcagtgagttgagatcataccactgccctcaagcctgggctacagagtgagactctgtctcaaaataaaataaagtaaaataaataaaaacatagaaccatttggtgattcctttagagacaggtcggatttttcacatcacttcgcagtcgatgaagccttaaactaggacctactaattgtgtctagacataaacagaagaggaaatgagtccaacaagaggaaacaagaatgattctttgtcaagtacactatttcttttcaagagctcatgttatcctcaagttatatggaaatcctttcttgaaaaatgactccacctcctgctctgtatgtgctcccagcccctccttccacagtggagcagtaagagagtgaaggctttatgtgtcctcaagagcaatgattttgcaaattcagaattgctacttcctcaggaaaacttgaagttaaaaaaaaaaatccttatttgaagaaggaaaacattagggcattatcgggtgagaacgtctctcatttcctctcacacattagggtctttctttgaaaagtagtgtttttatgtcttaggatgagggtactgcatgattcagggttctcaattttgtgttaaattaatatctgtgcattcttaagatgctatttatcaaggtggttttacatttgatcagaactcagccacagatgcattttcattatttatttttatagagatgtagtcttgctgtgttttccatggtggtcttgaaatcctggcctcaagggatcctcctgcctcagcctcctaaagtgctagaattacagacatgagcacccatgcctagcctacattatataattaattaaaactttaaagcaataaaggctactgaattttaagttaagcaattttctatgacctagaaacataaagtaaaatcactctagtttgtcacaaaatgaaaaatatatgctaattaagaatcagaaaatcatggctttatggaattgaacatattttcaatttgctgattaaactccctgggaattttaaagtcatctaattcagcttcttattgagaattttctcttttaattggacagctttggtctaaatacttccagtggacctacttgcctctacttttcgaggaaagtctatatcagagacacttgtattattttaatgtgtttcataattttgagaatacaaaattggattctgcatagctttacttgcttttcatatttctctatgtaatggggatatttttgaattctagagcagcactgtccaatagcactttctgtgatgagtaaatgttttatttctgtttaatatggacatgtggctaatgagcactggaagtatggctagtgtgactgaattactgaattttggatttcatcaatttttaactaaattaagttgaagtagccacacaagtcttccatatcggcatagttttagaaatattgttttcatcaaggacagagaaagaagaaaatacctttctcttgtttgactgcctaatgggcaaaattccttttacaaacgttgagaaacaaacaaacaaacaaaaaacaacaacaacaaaaaatcttttggagttaatgcttattttgcatagaaataaaggcataaaggaaatttcaatatatggccaactcaagtttagaaaacagtcagctctctatggtaactaaccaaggaagagatgaataaggaaggtgtagaaggtggggaataagacctgcttaccagcttaaggacaactgaaaaatgacaagaattcaactgccgtgtccaagacaatgttttctgcaagaatgagtggattttaagtacaaggaagagtgttggcttgagtctggtcttactatgtttttccctctccaaccttattttttcccaggttgttgacagtgtgtaatttcaatagatgctcggcacttttctcacatctccactggagatgagctttatacaagtgaaagtgctactgagatgggaagatgttagataatggcatacgtgcttcttttttaattttttctatgatttgcctccattccttaggtcagcatgaacagattggagagggagatgctgagtgtgtcatactgaactgagctaaattgatcagaactaagggtgatatgctcccaaactactaccctatcctatttacagcttcatctaactagtgaagtaatttttctacctcaggaaaattaaaaagatccacacatacacccccacacccagacatacacatagacacatgcacacaaatccatgaagttggcactttggctttgacctctcatgatcttcttgacctctctatgatctgcctcagcctcattttccctgtccaaacacaaaatattttatactatccaatatattttattatggattttttcttgttaaatttccttttctcctatctattcaatcaaaattctttccctccatggagaggtttccctaacaatagacttctacctaattttcatattaaagtaacttatacttagttgtgaggaagttctctaggttaagaataaatatcatagagaaactttattgtcaaatgaatacctaaatgacaaatttctgtggcgatgggcgagtttaagcagaagagactccccctcacgttctatgaattttcttcagttatcctgatttgacttgattttaggctacttgtgaagaaatagaaattttactaattagtgaaatgtcttctacagttaaaaatccattaaaccttttctgtctatttctgatgtgcagttctgcaaaaactgggccctcttaaaaggctaagtgaccgcttttagtttaggtgagatataaaaacacaagtagcaaagaaagtaatttacctttgtctagagaatttattctctaaatatgcacaaagaataggccatatgtcagactttgtccttagaattcacgggaagaaggaaaaagactaagcctctagcctcttgctattgacaagagcaatagatactacatggattatatagaccttgcatgcagttgtgatgaattcgttgatagtaacagaaaaaaaaatagccttttgacaatgccagcactttacaaaacattttagtcacaactctaatagcaaaacaaccactaaagcagatgttaccaccctcattttagaaatgggaatctgaggctcagggaaatggcctctgtggatgaaaactttaggttttgttcctggcagtagtaacaaaaaaccaaactcactaaacaggtcataaaagtaaggaagcaactcagtttcatctgtctgcctgttctgtcagatagtgacagctcctcccgtggggagcagtgaatacatgagtgagaagactttttaataacagccattctgactggtgtgaaatgacattcattttggtattgatttgcatttcgctgattagtgatgttaagtattttttcatgtttctttggccacttttatgtattctgttgagaaatgtctgttcatgtcctttgcccattttttaatggggttgccttttgctttttgatttgtttaagtatcttatacattccagatattagatctttgttggctgcatggctagtgagtattttctcctattctgtaacttgtctgtttactttgtatatagtttcttttgctgtgcagaggctgtttagtttaattaggtcctacttgtcaatttttatttttgttgcagttgaatttggggacttagtcatagattctttgccaaggccaatgtccagaagggtatttcctagattttcttctataatttttgtagttttaggtcttacatttaagtctttaattcatcttgggttaacttttgtatatggtaataggtaagaatttaattttattcttctgcatatggttagccagttatctcaggatcatttattgagaagggaattttttctttattacttatttctgtagactttgtcaaagatcagatggttttaggtgtgcggtgcggcttcagttggtgggaatgtaaattagttcagccacagtggaaagcagtttggaggttcctcagagaactaaaaatagaactacaatttgacccagcaatgccattactttgtatatacccaaaggaaaataatttgctctaccaaaaagacacgtgcatatgtatattcatcacagcattattcataattccaaagacatggaattaacctcggtgcccatcagtggtggattggataaaggaaatgtgacacatatacaccatagaatattatgcggccgtaaaaaagaatgaaatcatgttctttgcagtaacgtggatgcagttggaggccattattgtcagcaatttaacatggaaacagaaaatcaaatactgcgtgttctcacttgtaagagggagataaacattgcatacacagacataaagatgggaacagtagacactgggagctggaagagggggaagcagggagtggtacaaggattgaaaaactgcctttgaggtcctgtgctcactacctgggtgatgggttcaattgtatcccaacttcaccatcacacaatctatccttgtaactacctgcatatgtaccccttgaatctaaattaaaagttgaaactaaaaatgagtaagaatctgaaaagaggaggagcaacttctcacttcagggaagctttcttatgggagtatgttttatacacacatatacatggtatgtatatatgaatctgttttatgaacatacacctatttccttacggactatgaggacaagaaaatggtgtttccctcgtcaggtgactgggctgctacttggatttatgtttggtaaatatgttagtgtgagataatgtaccatacgcctccagaaaccaattttttaaacaatctatagcaccataaattagcattttctagtgtgactttcaaatattaattactattctctgaaaaaaagtttcatgaagagagttcagttcacagagtccaggtacatgtgagaaactgccgagtaggttccttcctcaaaactctgagaagcactgcaatagaaaaaacatttgattttgcttaaagcaattttccccatatttgacaacaaaaccatgtctatttgctttttttctcttccaaagtcaagctattgacatatttgttctacagaagacatctgagaagatttttattaaaccaaataaatgagtaacatggaaaatttgagcatcatagtgggattagagaaacatttttggcaggggatgggttgtgggcaaccattttattattccatttagcttggtttactcctctatttattgatgtctggtactgtaagtgtataattatttagtgttcagtaaatgctaagccatattaaatggtaatggtaagattaagcatgtgcatgctatttgtccaatctagatacaggctaggctcaaagtatgatgtaacttcagccatgctgagggttctataggctttaatattcttcaaagatgttatcataagacctaatagaactagaaacagaacatgaataaaccaatatgactgtattggagatttttccgattgtcaacaagtgtttcgttgactgttccagacttttaaaagtgctgtaacttcaacatccgaatctcctttttgtgtgcataataaacattcctgctttgtgtaattttaactagaccaaacgatgcttacacttcccagataccagctgttgaagcagcaactttcaaatgattttgcagatcggcaaacacattatatcattgtgtgttttgcagctgtctcttcagttagcctggttttgctttttgcagagtaacttgtgtacagttacagaagagtatttgttttcctccaacagtcttggcaattagtgctttcctagcttcagttttactttggtgcaataggcaccctgtattgtgaaccgtttataaaccaaggtaatgacttgtgggtttttaaagagtgcttactgcaccaaaaaaaaaaaaaaaaaaaaaaaaaaaaaagctttctcctggcttgagtgattttaaaaccgtttagtcaaatgtttgagtgcctattgtgtttaaggcactctgtaagtgttttgcatccactgagcaatacatagtagaagttagttgtatcacacgtagatgggaaggttattctaaggaacaccacttttcaaacgcaagagagcatgtccctgtgatgccacagagggaaactcagtgagactagagcagagtacaaaatcagagtatcttatggtaggcgtgcaagaagtagattgcagaaagctatgctaaagagtttgtaaccgaattgaatttggaatgaatggaaatcctttggaggattcttttttttttcagggttatgcgaagatcagatttgtgttcttggtgaaagatcacacagtatagtagagagaatgaactataggcaatcacattgggtgcagggaaacgagtaagcatactattgcctagttatataacaatagattggcaaaactggatagtagagacagtgagtcctagttagttttcttaaatgaatctattagccgatgtacagatattagatagaggacgatagcattttagagctggaaaatccactaatctaagcccattgtccaagatatgaaaactaagtcttgggccaattgaataatcttgataaaagctttaaagctagatagtatcaaagctagaatcacaatccacatctctaaggatactttgctttacattatttctctttttttttttttcttttttttttttgagatggagtctccctttgtcgcccaggctagagtgcaatggcacgatcttggctcactgcaacctctgcctcctgggtttaagcgattctcctgcctcagcctcccaagtagctgggattacaggcatctgccactgcacccggctaatttatctcgctatttttattttgtattttattaactttatcattgagccttaactgcatagattaaaagagtaacttcttttaatgtaattatacattgctaaaatgaggtctcatagcagaagagaaatgtttaatggcagcttcctttacctcttgctacttgactttgagcaatgcattcctttagactcaaaatctgctttttattatttaccagtctcccttatctgcattattcagtgtgcaagtattgatttccacttatgttccagggactgtagcaggtgttgggtgaataatatgtggaaaactctatccttgaggctgttatggtgttggagaaatggacaaggttgtgggtggctctgcaaccacagtggcaggacgtcctgcccttctggggagttcaaaatggctttctggacatgaaacttgattaagagcagtgccaacatcatcgtttcaaattatctggaagtgtacatttaggagcaaatgtacaaagctataaaaatattcataattcttttttacacctaatacttgacccttgtgcttggctctgacgtgcttactctgaaactcttttgaaattggctttgtgtgtagacaacagatgagttctcagatcagaaagtaagtaaactggcatgatgttggattttggctagctctaactattaagtagtgatgacaagggtactcagctctgaagcatttattttttattttagatgacactatcttaatctcaaaaagatatcctttgacttgaacacctttcctcaggtttaagctgtaatcaagttaaaaaaaagtcaaacattctcagtttcaggaagatattactgctgtctaaaacctactaaaacatattttgcctatccaaaaggcaaaatatgtctctgaagggaacatgagcaccttggcagaaaatgaagctatttataaatcttattttctttactctttcattccttagttgtttttattggtcatatttaagatatggacatttttaatatatgtacactcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctttatctcctgagcaggcaaacaaacctctgggcaatgtggtcttgcagctcagaacagcaaagaaaaaaaaatatttaactcgataactgcaaagaagaaactgtgtttcctgggagaggaattattgccaaagtagatgcaagaaaaatcagctctggcagagacaaggaagaattacacatatgtcttaagtttatacttcctagatttctatcacaatgatagtaacaaagatgtgaaacacttcatttctataatatcttaagtaggccaggttcagtggctcacgcctgtaataccaagcactttgaggtggaggattgtttgaggctaggagttcaacactagcctgggcaacatgagtcgtcttctctttttatttttattttttatatatattatactttaaattctagggtacatgtacacaacgtacaggtttgctacgtatgtatacatgtgccatgttggtgtgctgcacccattaactcgtcatttacattaggtatatctcctaatgctatccctccctcctctcccaactccatgacaggccctggtgtgtggtgttccccatcctgtgtccaagtgttctcattgttcagttctcacctatgagtgagaacatgtggtgtttggttttctgtccttgtgatagtttgctgagaatgatggtttccagcttcatccatgtccctacaaaggacatgaactgatcattttttatgggtgcatagtattccatggtgtatatgtgccacattttctttatccagtctatcattgttggacatttgggttggttccaagtctttgctattgtgaatagtgccgcaataaacgtgtgtgcttgtgtctttatagcagcatgatttataatcctttgggtgtatacctagtaaggggatggttgggtcaaatggtatttctagttctagatccttgaggaatcgccacactgtcttccacaatggttgaactagtttaccatcccaccaacagtgtaaaagcattcctatttctccatatcccctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgtgcgtcctcttctctattaaaaaaaacttaattagagattctaatgatacagagaggaagatcaaataagtcaaaacaatactattgagaaatattcaagacatttatgttttaaggtaatttgtttattttgccaaaagcaatacataattatttgatcaagcatataaatctgcttcaatttttgtattatattttaaagtttaatatataacttgaattgtgctactccctgtgaagttttgctaaaatatttaattattattttacaaaatgtattgttttgcaaaatgcaaaatctttttctcagaaagttgagttgcttacttagtttcttttgttggtcttactgatttttttttttttggtcacatattttagactttgtgtggcccagatgataagttatcatttctcataggaaatcatatggcctaaaccaaaataaaacaaaagaataggaagtctgtgagacaaaacatggaagtcatttagcatagataatacctaggaaggcctgaataaattgccattggttacttcttaccagtcctacaagttttactgtttctgcttatgagagtagtcatctaccttccatcatcaatgcaggcatatattggatttaataacatttgctcttttgcctattgaattgtattattgctgacatcaaaactctcctaataatgtttttttttcttttctccttaaaatatcggctctgggaggacacttacccaattttctttcatttaatttggcagtaagatgctaacggtccttttttattgacagaagcaataacaattaatacaacttcagtgcatcattagttgacatgttttgtccatatattgtttcaaatctctttaagaaacaaatgatatccatatttgagttaaatacaatggtagataaactaagttagagatgtgtgcgtgtgtgtgtcagccaatactttgagtgttagaattgttttcctattcattattttttgaataaacaagtaaatgctagttaaagctatttgatgctgtgactgtttagctccttatgcaaaagacaggtcaacacccttggatttgttgagttgactgtgcattcagcattatgcaaagcaatgacccagggtgcatgtcttagctctgaccttaacctgcagttacttctcaatgaagctctgatgcctttgtcaagtacttgtactttatccatagattagctaattttcaagttgtggggttaatctttatctgtgttacctttaaactaaacacttactgttccctaaagcactttagtgctttagagaacatgctggagtgaacctccctgcctgaatctgttatgtcatgacccttcattacagactcttttgaagatgtgaggcagttttatattaagcaaagattatcggagcagcctgctttatggaaagaatcaacccaatgtacatgacatgcaccagtgtttctctttgccaaagggaacacactagtcactcacattagagatggccttaagttactatagtcaaaatactccactttggtctgtattttctttaattcagtgtaaacttttgtggagcatacatctgaaaagtccatgctggcactcagagagttactcttttagcgtatgagacagagtgatatatgttgcacgatatttttgtgtttagaatggtcatctatggaatgagattacagaaccaattttctttaatttaaaagaaaaaaagtatttaacctacttgaaacacatacaaatatgttaaaataaataaaaatagttatttatgtgtatttgcacacacaaatagataaaatattaccttgacatattttattatagcataacttgcatcagtatatgtgtacatatacatattggggcatatttgttcataaattcttaaagtagcctggttatgcatgctctgtcttaaatgagtttaatatgtcattatttcactttgagaaatgcatagttattcacattggtttatcacatatggagttgaaagagtctattttacttctctttcaggatcatacaaatagttcatttatataatcacaaaatggagatccactccatgattggccctgcccattaatattgaattttcatcacgctgttattctttacgtgagttcttaaatataaccctggtaagggctataacatgtacatttgaaaggattataaactgtgatagtagaaaattctgagagaattataggaaagtcttcactgaggactcactggagatagctggggtgtatatctccccttgccctaggaggatatcttgcatttttactttacatattttgtctcagaatgagtaaaagacataccttagagtaggatgcaacagtgttctcggatagcactaatttagaaaaaaactgggattgtaaatgcaaatgtattagagaaccattttgcaaatctcttgcttgtaagaaattccccatatttttgccccatgtcacccatccatggtgattaatactcatccttaagccttcaggttttgtcttatatcaggtattcatggaacaatgtgtgtttactttatctatctccatcctgactgatcatatactgcttaccttcgctctttttagactaaagtctttttcttttctatttatttgttcctctgacactatttttctatgcaattttgtttgagcctttctagtaggggagaataggtctacattattgtttataatttcttgtgatcattccttgattttgcttttagttgtattactgcagttaatatttatgtttactaatatgcatatgcttaatcccaaatgatactaatatgattcattacagtgtacagtatgtcaagatgactggcaggtatctgattcctaagtactataatgagaagcttaggcctatagtacttagactactgttatttcagtacctactacaatcagtagatttttaggcacatttaagagatttatacactgactgaggttcctaagtcactgtttattttatggaaatagaggcaggatttatggatagaaaaaatcagaaaaatgctttttttaacccataaaattagagtaaaataatttttataaatctttaatatttagactttggttttgtagataaattctgtgtttgagaaacaagcctttcgtgggttggggttgggaagcagtcctggggaggaaacataatatcctggcaaatgcggccagtggcctggagagtgccatgcaaattgagaactgagagcagttgtggatgtggaatgaataggggtttggtctgggtgccaagtcaatgtaaggaatgaaagctacatcccatgaagatagtttagtgacaactctggctttcagcaagttgatgaaaagctttattattctaattctgctgcaattgcaggagtcccttctgtctgggggttaagcttacccaagagtgttacttcatttccaagtctaagcattaggttctgatacatggtatgaaattgttaaactctgtggattttaaatggccttttgaaattatctgtatcaaccgaggtgatgttaagatacactgagatcattttcaattaattgtacttcagccgatgttgagagggagcaggtagggaaatattgatcaatattgccatggggtatacattttatatatgaaataattacttgtgtcactgaacatgtgtttgtctcaaagccgtatgaaattgtcagaatctgtccttttttctgacttctccctttattcaataacactcaatgatcttatatcattcttaatgtgagattgacttttgtctctaaggaatgtaaaagttagcctgattttctgtatcaactcatcacaggcactggcattcccatacctctcttccaactgagttcttgcttgcttgacagaattgtgagccccttgcttcctttgacccccaggtttcccaatccactcgaattgacaatgcctttggctctcatttttttatcctagcacatcttgcctttcctgagcttgctgtcctgttggcagctagactgctgtctttgttgttgataggacacaaattgggaaatacagggacaaaaattttaacctgctccattacccaataggtttggttttttaaatctgtatttttacttcatacaaggtaatttgcgttgtgacatacctatatggtaatgactgtttggtgggtattttcaatgttgattttccagagttgtcttagaacaaaagtgttggcattattctgtaggctggtaaatacgttgtgcttccatttatgtggtttcaaagcataacttatgatatttgtccaaatgaagaaatatctttgtttgtttttatccagcaggaacttataacttatttcaataatgaatttttaaatttatttgaccaatatgattaacatattaagttctgattttaacaccaaaaaagaaaaaataaaataggccatataattttgagcatttgtgaattttatggaaatactttaagttttaaagtttttaaataggccacatgtctagtattaaaaatagttcacatgtctattattatttaagtcaaaaattacagaagtgggcaaagatgtggagaaaagggaacatatacatcattggtgggaatatgtattaatgcaacccctattgaaaacagtatggagaaaaattacagaagtgggcaaagatgtggagaaaagggaacatatacatcattggtgggaatatgtattaatacaacccctattgaaaacagtatgcagattttttcaaataaccaaaaatagaattatcatataatccagcaatcccattactgggtatccacccccacagaactaatatgatccagcaatcctattactgggtatctacccccacagaactaatcatggtatcaaaaacacctccattcatatgtgtattgcattactattcacaatagcaaatatatggaatcgtgctaaatattgatcaaaggatgactggataaagaaaatgtggtgtatatgcataccgtggatactactcagccaaaagagaatgaaattatgtcttctgcagcaccatggagggaactggaggccattatcttaagtgagataactcagaaacagaagtcaaatatcacatgttctcacttatatgtgggcgctaaacaatgtgtacacatggacagaaagagtagagtaacagacactggagactcagaaaggtgggaggatgggaggaaagagggagaaaaaattacctaatgggtgcaacgtacactattcaggtgatggttacactaaaagcccaggcttccccactacacgatgtaacccggtaacaaaactgcgctggcacaccctgaatctataacagtgaaaaaaaatttaattaaaaaagtaggccacatgttgtttcagctgatgtttacatggaaaaatttgaatctcccaaggtctctggagagataatggaacttcaaacatttcagtgactgattttataaacgcatatgtacgtaagtgtgtatgtatatatatgtctaacttagcataatcaaaaactaagtcaaggctgggtgcagtggctcgtgcctgtaatccaagcactttgggaggccgaggcaggtggatcacctgaggccaggagttcgagagaagcctggccaacatggtgaaacctcatctctactaaaaatacaaaaatcagccaggtgtgctggcgggcacctataatcacagctactcaggaggttgaagcaggaaaaatcacttgaactcaggaggcggaagttgccgtgagcccggatcgtgccatggcactccagcctgggcaatggagtgagactctgtctcaaaaaaagaaaaggtcaaaagctaagctatatatatgtatatatacacacccatatatagacaaatatatgtgtatttggacatagacatatacgtgtatatatgtgtatacgtatacacatatatacacgtatatatgtctatgtatatttgtctaacttaacatcaaaagtatacactacaattttaaaagattaattacagcacacacgtcaaatagatatgtgttgtgtgttttagacttatccttttatctgtccgataagtgggtattcatccagaagacctaattcacatattaatttctcatcttctcacagataattgttttcaccagagttttaccaagacacttcataattaggagtaaggaataggttttgaacattttagttttgaatcctacgtctgctaattaccagctgtgtgaacttaggataattatctaatggctttaaatcttaatttcttcatctgtaaaaggattaaataatagctttctaataatactaaatgaccctttttgtgagtgctagaagacatcatacatggtaaacacctaaagagtgctcgccacataaggctcattcaatattaattctgttttcgtggatgatggttattatcaccgttgactcaagagtttggcatttttgttttaatcatttgcttcatggctttacttcctttacagatagcaataattggctatgcatcgatctttcctcagaagctagcacatgtcagaaacatagtagatatttaattaatttagggtgaataaatgaagtatgccacttctttacaaaatgccaccagtgggacttgccagatacacatatgatcttattttacttcaatttcatcatcacctgttctaaagcatctgatctcccgcacatgaaaattaagctttttggaaaatcacaccattgcggttggtactgattgctttgcccaaattattttgtcttccaaaatacactgctgattcacatcttttttttcttttgctcatgtagttattgattacttctgtctagaattgcccttgcctgacttacttgtctgattcacttactttttcaaaactcaactccagtattgccttatctcagaccccagtctaggcttagatgctcccacgtcatgctctgcttcacctacttgtcatatgttatgtgacctttcctgtcattaactgattttgtctcttactcatgagattgtattcttttcaaggatgagcatggtttcagtgtctcaattatgaatgttttgccagagagttcttagttccttactaggattcagtaaacatgtgttaagctgaactgaatattgtatatagactgtacattctcaatacagtttcttgacttatattcaaaaggacaatttttatttttgcaatggcctacataaaatgcttctttaatccccttgtaactttgctgtaaaaattgaactcaagagataagtagttttgaggttttgggaaaggaaagaaacaacgatttgattcttcttgaagggtgatctcttgttacatatttttcctatgattttaatgagtgtattgcaaaaaagttctgccggatccttatattttctagaaaatctttatttccttactcctacttctgtgttggtttccttaaaacatgacatttgaataaaatttatgccttaggaaaaatgtatttcttttaagctgtaaggtttccaacatcgtactgacatagattcaaaggagaggttccatgtcaaattttgtacttcaacaagatcctgttccattccagttcattgcatcaggctatagctttcatttaaaattttttctttgagaatgctgtgagtgaaatgtgtggctctctttccataccaggaaaatcctctatagagtagtgtatactggaaagacttataataagatatactactgatttcccatgtctaacatttggttctctgatgtttatgggctctactaatcagccttgtggtaattggttttctgaccataatttgaacagaaaatattactgaattaattgtttttaattgaaggaaagtcaatgtagtttttataatacatttttactaagagggaccaatatcatatgttcccattggaattagactcaattaacctattagtgttagatgcataaatacccatcctcatacccatcacactgagtacttattacaccctacaacttttgtttagagatagcatgcattatcttatttatcaaagtatctgaagtaactatggttatccttattttataaataataaacagaggcacagaaagttcagagttacatttgaatgaaataacatgttaaaaaagtgaaaataggttttaatttttcatcccaagatggtaaacacatgctcataacataggtctgcattgacctctctatacctggaggctgaggttgagcaatttatatttctagaccaaaattctcgaaaatgaacaaaattatattgcatttatttccctgctattcattacataataggaacacacttaatttttgtacatgaatcatgagcatggttcaagatttccagctctgactctaaatacttttccataatcatcctacttctgttccgtaagtgtatacacacacacaaacacacatatacaaatacatatgtatacacctccactcttactactgttctttctttgtccgtggtgctgaaagcaggaagctgttccataaagaataatgacagaaattataacaataaaaggtgctgtacttatcaaccatcaaaatgatgttaatcatatattgtgcataacatagagatatttgtatttcttggtatattaccctaaattctcaatataaagatcaaaagaacttaataattaggagaataaaataatgttaaatattgttagtcacactttgagaaaccaaaggttaaaagactagccaacatctcacagagagctttgaattgattgcagctgactgcaaatatgctgactaattatcatgccctttaatagtactatcttgcctggcttttatgttagcctagggaaaattgtcatggaaaaatgtgaatggctaaatattttattcaaatttatcacctgtcatcaacaactagaaatgtatgagccagttattcacccaactacatgctgtggtaggatgatggcagtgattataacaaaaactactaccatttactgaacacttactgtgatctttataagggtcagctaacttaatctttacttcaacctcataaaaaataaaattcttattttggagttacagaaccttttacatggggagatttagttgcctgttttccttggtattggagcagagttactgttccaaaccagattatctacaccaaagtctatgctcttaatcattattctgtatcacctgcttcattttatacactcattgttggtagctatcaaaattgtaggtattgtattgccatgactgaagtctgtctttatgagtcagtgtgaaacagtgatacaaaaaatagtatatttccaattagttacctcgtgtagatcttccgtgtgaccttacgaaagataccttgagtttaatactatcctaagaaaaataaattcagggtcagcatggtgtctcacacctgtaatcccagtggtttgggaggctgaggtgggaggattacttgaggccaggagtttgagaccagcctgggcaacagagtgagacccccatctctataaaaataaaaatttaaaaaaggaaaataaattcagaaaaaattgtaccacaaagtcatttgtttgcagacaattatgtattgtgtagatataaccagtctttgacagacatgtcacttacactttggaaattattagacttgcctaaacttgtagttcatttagttgatattgctgaaaacaaaacaaatcactactgtgcctttgatgattcttgagaagttcaaaagggaaatacaacaataatttgctactgctgtgccatgcactgcactacatagctcacagaatttacttttaattatcatataccttttgctctctatttcatatgtatacatatatattcatatatcatatttatttttatattcatatataatatttatatgtaactaaaatattatataatcagtggcgaagccaaaatggtaatcagtgtattttgattataaaacattaaaaatattaactatatcagaagttacaaagtgttcaattcagtacaaatgcaatatttgttgcatttatatttccactttttttttgcccagagtgtgtgttttgtagatgttgcagttgttagagtttgtccatagtatttttgaattaaagtacgtcacaaagaaattaagatttttttctcttgaaatattagccatctggctgtgttaggctcatattcatgcatagatgtattgactaaatctaggtgtactttaaatgagaatgttctctttagggtagtgtagtccccacctggctcacttcactcatttgtgttagcatatgttccctgtaggaattcaggtttgttgcttttgcgttatactcaaatgcactaaagcagggttcggcaaaccatggctcatgcggaacagcctatttttgaatataagttaaggatggtttctgcaccattacaaggtaagagaaaagagagttaataataaaaggggatgtgacagtaactatacatggtccgcaaagcctaaaatatttactatctggccctatatagatggctgacctcttctttagagtattttatgggacttgtttattctacactgcctctgactctttgaaaaagattggtagcattattcaatacaatcatggacactagaagagattttttcatggcaattagcctggccatcttgggcaaaattagagcctttgaggctttcatgtttgtttctgtttttttttttttttttttttttttctatgagctaagagaaaaccatggtctataagatatttctggaagcaaaactaataaccccacatggacagctgatttctgtgttacttctgcttttaaagccagattgggcatcaaaggattgcctgaactgttcatttggagctatttgtttgaagctgattagtgaaaatgctaagtgtgagtaagcaatgttacttaaactctaggatttggagagttttttcaccagaggaatctgatttagctgattggaagggtacactgatagatttcttgttagtaggaatttaggaacacaggggagagcaggtttagcaacacaggcatgctgattatgaagcgtggtaccacttacgggggaagaactctaatatctttagagtaaatgagtaaagagggcctggagatgaatttgataatgtatacctcacccaaaggtactaaaatagggagaaacatagcaagtagcattgtgctcacccaaccagaggcatctctagctcaatcagttcagccatgacttctcattggtaatttgatttgaatcataattgatatgatttggccatgtccccacccacatttcatcttgaattctcacatgttgggaggtaattgaatcatggggcaggtcttctcatgctgctttcctgataatacataagtctcatgagatccattggttttaaaaagaggagtttccctgcacaagccctcttctcttgtctgctgccatgtgagacatgaccttcaccttctaccatgattgtgaggcttccccagccacatgaaagtgtaagtccaacaaacctctttcttttgcaaattgcccagtctgggatatatccttatcagcagcatgaaaatggacaaatacagtaatctttgactattagagtagaagacattcaaaagcattttagtgcatcttcatctcatgaacagcattaaaaaaaagcaaataaaatggtcataaaatttaattaatttgcccaaatttgtcctaaagagtcagcattagtatctagatatcctattgcaaatttggggctctttttattacattgtctataattccactgacttttttttctaaagagcattattaaaaaaatcagttgccgattgcttttgagtagcataccgaaagaacaaaggtcttaggattggataatcaatgtaatgaatatttataagactatttgtaaatggattttgactaatacaaatagatctggtagcaatattgtttcataacatatatctgtgaatggtgttttagtatcttaggggttggggcttccttgctgaggactcagctaagtaagaaagccagtgcattatttttggactcagaatagaccaatgtgaaggtattaacaagagtaaagacggcaataagagggttgagctattttagcttttccctcaagtaagttttaacttttgcttaaaaacattaattttaaggatgtctattttgtttttgaggccactgtgccaccaggttatttattaaaacaattaatgattaatttactatttttctgccaatgaaagagctaggattcataggtttaattatggctgtgtcagttgctctttatggaggctttggcaagtaatttaaattctgaatctaacaaatttcctaagaatggattaactagtagttctaggtacatactgtaaagtatatataggaaactaaaatttagataagacatatttggtttggcgagctgtaaggagttaatagttttaataaactgtgttcaggataatgtgagtgtaagatatgttcagctgaaagtaaagaaaatgattaaacaaaaatatgaaataaacaacaacaaaaaggaacgagtaaacgaaaatgcagtccagcagcaacaatatgctagaaagttggaggaaaccctgaaaaatggaaagctgttgggaccagactaatgggaaaaagtactgaaggggaaagttggaatcttttcgaagaaaatgattaatagcatgcacaaagatgtcctggaatgtttatcacatcagtacgagtcatagaatttggaagcaaactttcctttcaccaacacgtcttgttttaataaatcatgatatatcaatactttggaacattatgtagccattaaaatgatgttactcaattatatctattcatatcaaagctgcaaaatcacacttaaattattcaataaaaatttatttagccccttctaggcattggacactattatgtgtactagaggttcaatgataaactcaaagtagtcctgctttgagtttattgtctattaaatagaaaacagtcatcaggtacatatgcagattagtgagtgtaaagttacaactgtgaaaacattcttaaaagcctcatcttaaggaagtgtgcaaagtggggtctggatctaattggggatttgaatgggctttcctgaaatctgaaggatgaaagaattgagttaactatgtgaaagttagggggtaaaaatttaagggaggggagaaaaaaggtcatatgaccatatggatttttgctccttagaaattgaaataagatttctgtggctggaggttagaaagtaatctgtgaatgtaggataaagttgaatcagaaaaaggaatattaaaaatttgctaggtgagtttctctaagtttcctcatataagcgagatattattcacagaagcagtgagtagaatggtggatacctggagctggagggaaggtggggaggttggggagatgatcgtcaaaggacataaaatttcagttagaggaataaagtcaagagattaattgtacaacatggtgattgtagttaataacaatgtattatatatttgaaaatcactaacagtaatttttaagtgttctcatcacatacacacaataatcatgtgagataatataattgtaatttgttaaatttagcgttatacaaggtatatttattttttaaaatcatgttatataccataaatatatccaattcttgtctttttaaaaaataaaattgctgggtgacaaatattgaatgcttaccgcatgttgaacattaagaatgatcacactaagaactctcaatagcttttgagacaggtatgagtatcatttgcatttctccagataagtacactaggatgaaactaaacccatgtcacacagtactgccagagctagggtttgaatccagactgaatagcaatcactgtgctacactcatcttttgggtaggagatagtccataggtctattttaaatgttctggattttgatttttatcctaaaataagataacaagcattggcaagttgccatttttttgataaattcttaaggcatttgtggggaggaatattcaagtggagagaaagagaaagtaaaggaggccagcgagaaagctattaaataatgcagaggagaggtcatgatagctcgctccaagagggaagattagagatggagggaagaagacaggttgcagagacgcagaacaggtgaaattgcatggtactccataatggacctgctggggtgcaacgtgagaggccgatctcaggtctgtgtggaggatgacaacctgccttgagataggcagcactgaacaaagggcccgatgactatgagtgtgttctttttttttcttattgagtgcttcgaaacacttatatattgaagtcaaaccgcatgaatgtgtgtgtgtgtgtgtgcgtgtgtgtgtgtgtgtgtatgcatgtatatctggaactcagggaagtttactgagctggggatagatttgccaatcatctatgggtagttaggaattagaactatgggtatcaatgaagtttcctagggacatacatgaatgaatagagatgaacataataaatcaagtattaatagtaattatttctctgttataattataggtattctttgtgctagttttctttatttgtatttttgttttactttaatcagcatatattgatttttgtgggaaaaaaattgaaaaagattttttttttcaattgagaagaaaaagtttattgtatatggcaaagggtagaggagaagagaaccaagatggacccggggttttgtgtctggatcaaaaggcttttctcctctcattttgcactgtttaccccactcagtttggcgctaccttttattactcactagcagtatcatttccatcaaaactctaatttttaaatattttttggacagtaatgttagctgttatcagaagttgtcaacagaacttaaattcaattttacttatactttaacatacaggctgcacatgctaaatgcttgtcacttagaatgctgttctcattagtctggattgcagattttgttgtcatgatgatatgtctggcaacattctcatagtgggtgagctcgactgtctagggattatcttctattacagttcagtttatcatgctctgtttgatatgttctttattaagaaacttaattacctatagttctagatattatgtgctaatgagttgtacgtgtgagtaaatgtattccgaactcatttttggctgctgatatatttctacaaagatgctttgagaaaaagaagcgataagatctgcttccattcttggtcagaaaagttgccacttagtcataatgtggctttattccatgtttccatgaaattcatttgagacatagtaaactcatatttttgaatttaatatttgtaagcacactgtcagttatccacatagtcaagtaaaacttagccgtgaacaaaatctttgaactgtaatgtcatattgtgtcaggtaatcttattcagctatgaaatacttaatactttaaaaatgacactttattgagcacttctatgtataacagtgtttagtaaaatgtttattttgactacttactatagttacatcaatttggtatttccagcagtagtcagaggaagcacaatttaattaaatatgtggatggagaaaattgatttcagagcaaagtttcttgtttcagattacttgtttggatctcagattttgcgtgttgttaagggacttacatttgtataaccaattgtaataaatgaagatttccatgaggcatatggttgcattcatttcggaagaactacagatttcaagtaaaacaaaacaaaacacagaaatcactgaaccaaggcacatttattgagtacagacatcaaacaaatctcatttttgtattaaaatctaaaaattccatataaatagctatgtttgtaggttgttctcttaggctaaaaataaagacagatattgcatctttcatcaacctaacatcaagatatttgcgtgggaccaatcttctcaagatttgattttaaattgttgcttagtcttattcaaattgcatgtatccttccctctcaaggtacataaaatgaaatgttctgaaaagacaattatgtgaatatgggagattctagggacttacagactctactaattttagcaataatttttttctcatagtgaggtccattttcagagtacattaaatcatgtatgaatagtcttcatctttcagtaaagaaactgattcttccagttgaaatttaaactttcttttactctctttttcttttttctgttgtcaacttcattgaaatgtaatttgcatacagtgaagttcatccttcttagtgaacagttctgagttttggcagctatatatatctgctgccactattaggatacagaatagttagcccaaactccctcttgccccactttagtcacctttccttgactctcactctttggtaggcgccaatatgttttttgttcagatagttttgctttagcagattgttatataaataaaatcagacaatatgtagcctttcaggattggtttccaaagttcatctaatgcatttgagattcgtgcatgctgtggtgtgtgtatcagtctctgttttcttttaatgcagaatagtatcccattatatggatatgccatagtttgttcagccattttatgctttctttttattctcttttttcaaaattaattatttatttatattaattttgtgggtacataatagttgtatatatttatgagatacatccgatttcttttttttccttttttttttttttggagacagggtggtagtctgtcacccaggctagagtgcagtagtgtgatcgtggctctctgcagcctggaccaccctggactcaaccaattctcctgctacggcctcctgagtggttgggactacaggtgtgcactattatgccttgctgatttttttgtgtatttatacatatattttttgttgttgttgttgacatggggttttgcaaaattgacagactggtgttaaactactgggctcaagtggtctgtgtgtcttggcctaccaaagtactgggactacaggtgtgagccactgcacccggccctatacatggggtacaggagatgcttgatacaggaatacaatgcataccagtcatatcagggtaaatggggtgtccagcaccttaagcatttaccctttctttgtgttacagactataaaattatactcttttagttattttaaaatatagaatagattattgttactgtagttaccctgttttgctatcaaatatagatcttattcaccctatctaactatatttttgtacccactaacaaaacccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtataagtacaacaatttcttcatccactcatctgttgatggacacttaggttgcttccaaattttggctattttgaatagggctgcaataaacatagaagtgcaggtatccctgtgatacactgatttcctttcttttgggtgtatacttggtggtggggttgctggatcttataatagctctatttttagtcttttaaggaacctccaactgtttgccatagtgcttgtactaatttacattcccaccaacagtgtacaagggtccccttttctaaatatccttgccagcacttattactgcctgtcttttgaataaaagccattttaactgggatgtgatgatatctcattgtagctttgatttgcatatctctgatgatcagtgatgttgagcatctattcatacacctgtttgccatttgtagtcttcttttaagaggtgtctattagatcttcgcccatttttaattgcattattagactttttccctatatagttgtttgagctccttatgtaatctggttattaatctcttatcagatggatagtctgaaaatctgttcccccattctgtaggttgtctcttcactttgttgattgtttcctttgctgtgcagaagctttttaacttgatatgattccatttgtccatctttgctttcgttgcgcatgcttgttgattattactcaagaaatctttgccaactacaatgtcctgattcctcagtggtttttgtttcttgtttttgtacagtagtttcatagtttgaggtcttagattttagtcttttatccatgtttatttgatttttatatacagatctagtcttattctgcatgtggatatccagtttctccatcatcatttattgaagagattgttcttaggacctttgtcgaaaatgaattcactgtatatgtataaatttgtttctgagttctcctattctattctattctattctattctattctattctattctattctattctattctattctattggtctatgtttctttttatgccagtagcatgttgtttgttcactatagctctgaagtataatttgaagtctggtaatgtaatttctccattttttcttttcttttctttcttttttttttttggcttaggatagctttggctattctgggtcttttgtgattccacgtaaattttaggattgtatttcctatttctgtgaagaatggcattcgtattttgataggaattgcactgaatctccagattcctttgagtagtgtggacattttaacaatattgattcttcgagcccatgaacacggaatatctttgtatttttcttgggtctccttcagtttcttttatcaatgttttacagtttttattgtagaaattgtttgttctttttgttgttgttgttacttcctagctattttattttatttccggctattgtaaatgggattactttcttgatttctttttcagattgtttattctgggcatatagaaatggctattttaatgttgattttatgtcttgcagctttactgaatttgtttattagtttgaatagtccttggtggagtctttaggtttttccaaatataagattatatcatctgcaaagatgatttgacttttttctttccaagttgaatgcccttcagttctttctcttgtctgattgatttagctaggacttcctactttattttcattttgtaggtagtatttctgccatgaacactaggattatattaacattttaactagttgctgttgtatctacttttattttattttagaacttttccaatgagttgttatgattgtagactttctaattgaagagctttttatttattaaattatttgtaaacatttcaattgtaataagtattgcatttaatgaaaaatgaattgctttagaaaatattctattaaaattctagagatatgttaatgatttatttgttgtattttttggtatgctttttccggtaaaaaaattaattatgaaaaattggaaacaacagacacgtataaggaagaaaaatccatagtattctaacatggctcatagtttgctggaaagtaattacaaattttttcagtctctaatatctgcaatatcaatctcaaagattgagaacttctggcacaccatagttggaaattttaaaagtaaagccaaaattagctaatttagttaagtgagttaggggaagcaaggtgaacctatggagtacagataagaaaacacacttcagtgttcaagacatcaaaaagaaaaaaaagaggaaagaaaaatatatttcattatttgaactagattacattcttccctggagttccctacttttgttatcctgcataactgtgttttaagtagggttaaaactaagatatttcaaattctgtagtagaaaaaaaatagtctggtattatagattaaaaaaatgaattaaatataattattaatctaagttatgaagcctaaaaaattctaactcatttgtttaaaacacgaatgtccatattcttttactttattccatgatatatgaaagtataatagcatgcattctatttataaacatctatgtttatcttaaggtacatatgctaatgaacatttacaaattgcatcccttacattttgctatgaagaatttaaagcacatactttacagtttgattcatattaatacttaaggtctttttcatacaagttgtacctacattaaaaattagaaggggtcttagaagtcatcttagtccaagtaccttatttttctggagaagaaattcatctcttaaatggttagtgaatagaaaagtttaaatagatacaaggatccctagtttcaatacaaaataatttcgcctataacatcactgggatgcaatgaatctcaccaaaaataattttctatatgtctgtttgtaacaagcgttagcccccaagtattttaatcaagaagtagcgatatatgaaagaaatccagtcttgtggttcactcttttctgtgactctcaccatttccctccctctatgctcccaccacagtatttgggatcagctccaccttatctcttgtcaggccagtacttctcacaccttagaggatatgagagtcatctggagaatcagtaatgagcacaaattagaatagggcctgggcctgtggatttgcaccaacttttgtgggtgagttttatgccccctaaagaaatcactggtgtagactcctgcatgtgcttccacataagccccttcctctccagcctttctcattcgtctcgaatcaagaggacgtactttggctggcacaagccttctaactgcctagtccattgtattgttccaaacaagttaatggcatgcactgaactgagacacactttccaccttggcatcggaaggctcccctgtaacattctagcctgggtctctactccagcatgactgaactccggccctttaagaggaagcattaaaagtgtgatttctgttctcagaaacttgagttaagcttatagttactactaagagaaatgttctgagcttcaccatttttctggaaaaaaaaaaaggtttttaggtgctttgaatatgatacataaaagctgggtatgggggagaaggcacttagcaaacttggggatgataatatgataggctggtcacctttctgtttaattattttgcttacaatgtttcactgaccataggttttgaacttatacatgcttcaatcttcagttttgatttcactacttccttgtgccttctgatttcccttgctgtgtgctttcttactcttctgaacatgtatagagttgtcatatagccactggaaaaaaaattctgccatatatgagtgctcgtatgcattctgcattatcctcacacaaggcaagggagctgatttcatttccttttgtaatcactgcacatgacaagttcccaaaatacatattgaatgaagtcaatgaatacacttattttgaactcttaatctttataaacattaatattttctggtaatcataataacagctgctgtttattcagtagttaacatgtgccagccttggtgctaagtgttctgtgtatgttattattatgttcttagaacaactaccccgagatgcaagtattttaattccatttcatgtatggggcagtttgaagctcagtaaaaaaataccttaatcacttgcaatagctaataaggactagagttgagaactaaatataaactcctagcaactttatcgatagtgtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatgcagtcccgtgtgtgattataagacctctttctcccttccagtctttccctggttcagaaaagacttgactccataggcatcatttggagctggagaagacctgttcttttcccatcgccttcatgtgctccttgctttccccctggtggttctactttatagaggacattcaaatgggagttcactctgggatccattggatagtttttcttagggactctgggtctcccctagagtttcctggaatgagcacttagtctctgcaaagaaaaattgacagcagagtctgccacaataaaaatttctactcaagtttgtagccctcttgtgggcgtggacaggatgatactccatagaatttccacagcatccttttcactcatggaaaactcactcacctttgccacaccaaatgtgggatgcaggcttttccccatcttccacacacataccccatttctgctcacctgtctctcccttagcccttcttctgcccagtagtatcaggtggatttaaagcttagaaagttctagaactaagagataaatcagccttcaaaacagtaggaagttaaatggaggtagtgggggaaatgcttttcaaggtacctttatcttgaagaaagggacattttaataagcaatagaataatgatgaagaagtggttgtattccctcaaattcacttattcccaagttttatagatctgtgtttattatattttttctgcagcccacacttagaaataatttttgcattacaatcaagttggctctctctccctctctctccttttctcacacatcacatacctgaaataataatagtaaactcagcattcacctattttatataccctgcactatgtttccttttcttcttctatccagtactatcagtgtttaacttgcttgtttcgtgacccacaaaactgattagataaccttaacctttgcatgcgtcacgtttcacaatttataaagcactgctgtagaaggtaaagactaataaacgtgttggttgacctttcttcccttgtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggtagctgtgtatgcatgcacttacatttcctaaaccagttttattgtttttcctgaacatacatgcttgttgtttaaaaaaaactgttctgaaatatataattctttctcattcctgcagagtaatcactaattcaggtcttttttaagtcctacttaatacatataagcacccacgcatgcttatactttagtagtctttttgtttctatcacggtcttgtttattctaaaagttgatcattggagagaaggtgaccttgacatgaaagtcggctcttgcttcaaagtctaaactgggacctccttgctgccttgaagggtaaatttatgatctctctgggataagaacatgatctttagactctattaacttttatccaacttctttctcatttaacatgaaaatgcttaggtttttgtttttaaccttgttttttagctttcattgtgcacttgctgatttcgttctcagtgtgacctcttaaatatccaaagggaaaggaaaattgctttagaaaacctctgtgcaaggaagttcagagaattggacttacctttgtaagaataatatgagctggatatagtttactgggacacaaaaatctgcatataccaagggagtgggacaatagacgtaatgatgtgaatggtaaaaataataaagaggactttgcctcatttattgattttttcaagtattttccatctgagttactgagtacagatctcttcctttcaatttacaaaaactaaaagaactaaagataggcaattatttgtggtacagatgcatttacaacaatataattctgttttaaaatcaagttgccttactcatttcaaagctaaggttgtgatggcatttctggaaattctccaatttatcttaaagttgacagtttttttttgtttgtttttttggtgggggtggtgggtgtggagaccgagtctcactctgttgaccaggctggagtgcagtggtgcaatcccagctcactgcaacctccacctccctgattcaagcgattgtcctgcctctgcctcctgaatagttggggttacaggtgcatgccaacacacccagctaattttgtatatttagcagagatgggatttcaccatgttagccaggctgatctcgaactcctggcctctggtgatccacccaccttggcctccgaaagtgctgggaatacagacatgagccactgcgcagccaagctgacgtttcttacagctattgcctcaaataagtacacgatggaggatgtccttatggcttaagtctgcctcatagacgattgttcagtgaaacacttaaattactccctaagtctcaactctaattccttaggtcataactaaaaaatttacttttggctaaggagtgcaagaaacagacaagcaaccaaaacaaaacctatacatactccccctccaaacacacaccaagattctctttaatattcattatgataattgtaaccatataaggagttctttttgcgtgtctgacagtatgctatacattgtcactaaacccccaaagaaaacttagaggtattattactaagttacagataaaatttttttaaaaagatttaagttgttctaacgtcacgttggtgaagattttaacccatctttcagaatataccatggacatagttgtcaggcaagcaagttagtgtagagatgcctttcattgtttaatggtaggtgctcttttagatgtctggtaggaacccaatagttatcttgtttattaataataacaggatcaagaggggaagtcattttctttggttctcttatttccaagcaacatttctgcattagtaatgaactccttaaacaaacactgaggattcttattagctttctttttctatggcaaacattattaactgatcacggcatctttacactggaagggctgggcagcagaagcttccacagaaggctctctggccagacaccaccaatcaattattgaaggtatcaaaattaaaaccaatgtgccatttctgcctttttctatcctatgactctcttacactgaggattagaaagacaattttgaatttttcacttaagtcttaagagacatgttgatttgcaagaggtatttatgaggtgttatgcagagtaagctagttaactctgatatcctctctcatggagactaagtaagttggctttccctgttaaggaaaatagtgttaacatctgcatttcacagtgagttaagaattttcgggaatggggcattacatttacggcctaggttctgaaattgtacatgaacaatttgagctcaaagattacaatgttgaaaatcagtgattttctaacagctccttaatgtatagcagcagcaacagccatcacaataataatataacttttccaggttcctactatgaagctaagctctatacagacaaagcttattttattgtactttgtgttattgtgctttgcagacaatgcattttttttttccaaatgaaaaatttttggcatcatttttgcagcagtatatgcctaattcatgtgtttgggtcacattttgggaaatctcagaatatttcaaattaattcattattattgtatctgttattgtgatctgtgatcagtgatctttgatgttactctcataattcttttggagtgccatgaaccatgtcagtataaaacagcaaagttaatcaataaatgttgtgtgtgttctggctgctccaccgactagctgttgccccatctatctccttttccgcaggcctccatactccctgatacacagcaactttgaaattatggcaattaataatcctatagtcacctctaagtactcaagttaaaggaagagtcacacatctctcaatataaatcaaaagcaagaaaagattaagcttaatgaggaaggcatgtcaatagccaagacaggccaaaagctaggcctcttggttcagttatccaagttgtgaatgcaaaggaaaacttcttgaaagaaattaaaagtgctactccagtgaatgcacaaatgataaagcaaaacagccttattgctgatatgaagaaagttttaatggtctgtatagatcagagcagccacaacattcccttgagccaaagcctaattccagagcaaggccgtaactcccttcagttctataaaggctgagagagatgaggaaattgcaaaggaaaactttgaagttagcagagtttggttcatgaggtttaaggaaagacactgtctccataacatcaaagtgcaagctgaagcagcaagtgctgttatagaaatcacagcaaaccggttatccagaagatgtatctgagatcattgctgaagttggccacactagacaacaaattttcagtgtagccaaaacagccttctattggaagaagatggcgtctaggaattttagagccagagagaagctgatgcctctcttcaaagcttcaaaggacaggctgactcttttgttagaggctgatggagctgacagctttaaaatgaagccagtgctcatgtatctttctgaaaaccctaaggaccttaagagttaggctgactgtgctctacaaatggaacaacaaaccctggatgatagtacctctgcttgcagcacagtttactcaatatttttaagcccacgattgaaacctactgcttaaagaaacaacattttctgtcaaaatatacctgctcattaacaatgcacctggttacccaagagctctgatggagaggtgcaaggagaataatgttttcaggcctgccagcacaacattcattgtacagcccttgagttaaggataattttgtatttcaaatcttattttttcaaaagttgattccaaccctcatgaatgactttgagtggctcgagactttagtgaaggaattagctgcagaggtggtggaaataaaaagataactaaaattagaagtggagtctccagaagttcctgaattgctgtactctcatgataaaacctaagtggataaggatttacttcttatggatgagcaaagatggaatttactcccagtaaatacgatgtgaacattgttgaaatgacagcaaaggatttagaatattatataaagttggttgataaagcagtggtagattgtattagtcagtctagagggacagaactaataggagatatatatgtatatataaaagggagtttattaggtagcattaactcacacgatcacaaggtcccatcataggccatctgcaagctgaggagcaaggaagccagtccaagtcccaaagctgaagaacttggagtccgattttcaagggaaggaagcatccaacacaggagaaagatgtaggctgggaggctaagccaatctagcctttttatgtttttctgcctgctttatgttctggcagcactggcagctgattagatggtgccccccccagattaagggtgggtctacctttcccagcccactgactcaactgttaatctcctttgacaacaccctcacagacatatccaggatcaatagcttgcatccttcaatcaaattaagtcgacactcaatattaaccatcccatggaatttgaaagggtagactctaatcttgaaagaagttcaactgtgggaaaaatgctatcaaacagcatcacatgccacagataaatactttgcaaaggaaaagtcaatcaatgtggcaaaatccatcgtcttaatttttgaaattttcatagccaccccaacattcagcaaccaacaccctgatcagtcagcagctagtaatagcaaggcaagttcctccaccagcaaaacatttagactcactaaaggctcagatgattgttagcattttttggcaataaagtgttttctaattaggatatgtccactttttttagatgtaatgctgttgcacactagtagaccacagtataatataaacataacttttttttattatactttaagttctgggatacatgtgcagaacgtgcaggtttgttgcataggtatacacatgccatggtggtttgccacacccatcaacccatcatatacattaggtatttctcctaatgctatccctctcctagccccccaccctccgacaggccccagtatgtgatgttcccctccttgtgtccatgcgttctcattgttcaactcccactaatgagtgagaacatgcagtgtttgattttctgttcccgtgttagtttgctgagaatcatggtttccagcttcatctgtgtccctgcaaaggacatgaactcatccttttttatggttgcatagtattccatggtgaatatgtgccacagtttctttatccagtctatcattgatggacattagagttggttccaagtctttgctgttgtgaatagagctgcaataaacatacgtgtgcatgtgtctttatagtaggatgatttataatcctttggatatacacccagtaatgggattgctgagtcaaatgatatttctggttgtagatccttgaggaatcaccacagtgtcttccacagttgttgaactaatttgcactcccaccaacagtgtaaaagtgttcctgtttctccacatcctctccagcatctgttatttcctgactttttaatgatcaccattctaactggtatgagatggtatctcattgtggttttgatttgcatttctctaacgaccagtgatgatgagctttttttcatatgtttgttgaccgcataaatgtcttcttttgagaagtatctgttcatatcctttgaccactttttgatggggttgtttgtttttttcttgtaaatttgtttaagttctttgtagattctggatattagcctttagtctgatgattctggatattagctctttgtctgatggagagattgcaaaaattttttccaattctgtaggttatctgttcactctgctcatagtttcttttgctgtgcagaagctctttagcgtcagcatgacttttaaacgcactaagaaaccaaaaatgtatgtgacttgcatcatcacgatatttgctttattggggtgatatggagtcgaacccacaatgtcttcaaagtatgcccatactaagtacccactccttatacactcaattttcacaacaatcttgtaagataattttattctttataagtcaaaacaaaatatttacagttcaggcttcagtaacttgcttatcagcaacacagctacacttctcaactgaataccaaggctgccttttcctctaaagttgtaatgtgacatagtactaaatgataccagagacttttcatggcaaacctataaaaaaagtagtgttggtcgggcgcagtggctcacgcctgtaatcccagcactttgggagtccaaggcaggcagatcacgaggtcaggagttcgagaccagtctgaccaacatggtaaaaccccgccactactaaaaatacaaaaattagctgggcgtggtggcaggcacctgtaattccagctactcaggaggctgagacaggagaattgcttgaacccgggaggcggaggttccagtgagctgagatcgtgctactgcattccagcctgggcgacagagcgagactctatctcaaaataaataaataaataaataagtagtgtttctaatatctctcaggctgtctttaaaactgcatgtttaaacagtttgctagactaatatgttcagtatccttggtagttgtaagtttcttgtatcttctttctttactctttctctgcaaaagcataatccatctcattgctgatattctcagattctaatctggtacaggttaacaatataaagcagtatgcacttattcacaaaataatatatatttgtagattttgtgattcacaataaatcagtaatagcatattgctctctctctcccctactggccttggtgatagttgttctgggaattctataaaccatggcatcatcatgagagagacacacaggctttctttctgatgttaatcaaaccatttctatttcttcatagcttttcattagatggattttggctttatgtaatacagaaacacatcttacttttaaattgaactgtatgattttaatttattcttcatctttgctaattgttttactttggtcaaatctgaaaatccttctatacctcagaaatgtatctggaaaaatggggataaacataaatcacagggttatcataaagattttaatatactagtgaggaattcctttgaaattgagtatgcattgactgctattgttattactagaacgacttggaagtggacatgaatcatttttaaatagttgtttggtggtacagtttttttaaaaaaaatttctataggtttttgggggcaggtagtatttggttgcatgagtaagttctttagtggtgatttgtgagattttggtgcacccatgacccaagcagtatacactgtacccaatttgtagcgttttatccctcatgctcttcccaccctttccccctgagtcctcaaagtccattgtatcattcttatgtctttgcatcctcatagttgagttctcgcttatgagtgagaacatacaatgtttggtttctcatccctgaattacttcacttggagtgataatctccaatcccatccaggttgctgtgaatgccattaattcacatttttttttcttttatggctgagtagtatcccatcatgtatatatcccacagtttttttatccactcatcgattgatgggcatttgggctcgttccatatttctgcaattgcaaattgtgctgctataagcatgcgtgtgcaagtatcttttttgtataatggcttcttttcctctgggtagatacccaacagtgtgattgctggatcaaatggtaattctacttttagttctttaagggctctccacactgttttccatagtggttgtgctagtttacattactaccagcagtgtagaggtgttcccatttcaccacatccatgccaacatctatttttttttttttttttggttatggccattattgccagagtaaggtggtattgcatttttggttttgattggcgtttccctggtcattagtgagattgagcattttttcacatttgaaaacatagcttagctcccacttataactgggggccatttctatattttcttttaatttttaaatagtttaaaaacataagcaaagctatatagtctcatattttaacaactagcttgaaagtatttaatggaaaaatttatattagtattgcttatgtaaacctttattggtagttggtgatacttctatcactcatgttaaattctcttctcaaataaattatagtgttttataacacacacatacacacacgtgtgcacctaacatttgttgtgatttgctaagtactaggcatataatttgcctcccaatttattacaagtaaggtttatcaaatattttaccactgcataacatggaatatcaccttgccagcctccaatagtatttccttgacaccagctgcctgactgctaaggcgttgacaactatttttgttttaattgtagcaggatcccactcttggtacttgtttaggtattagggtgatttcgatgggcccattaaccctactgactgagcatctcagtggctcaacacagaaaagatgcatttcttgcccatgctatatgtctgaatgactgttgattggctgcaagtcaacagttctaaaataaaactatgcttagctttaaaaaaataaaataagggtcagtaaaatatctagttatttttctttatttttattttctcacattttcatttaattttacattattttataaatataactgtacaaactgtaaagccagttatttgctaaagagttttttgataaaacaaaatgattgagtagaaaatctcaccatgatctttgacttacttaatggtagttacagaaaacaatttatataaattaaaaggccatacatagtccaagcaaccaacaagtatttgactcatacaaatctgtatcatgatgtccattagctcaagatgttgacttttcttctttttcttcttgctggtttttttttaaactattttttttttcatctagccaccagagaatgcttatgggaagttaacataaatatcaaacagtgttttcaaatattgtttatgcttgactgaatagggatttgcacaaagagtggttaaatatatggactaaaatagatgctccccattataaaataatatttggtagattacttataaaatttttcttgttattttgaaacccaaagttgtttatatatatagtcctactttttagatttaagccttttttatgtgtttgctattaactgacttagaaaaagtaataccttaaaataagaaaataaatgcttaggacaataggtagattgaaaattcatttgaaattaaaaaaaatctgtgacatttatttttgtgcatattagttccagaactgaaaataaagccctggcagtctcagtgtctatatatatatatgtgtgtgtatatatatatatatatatatatagagagagagagagagagagagagagagagagagagagagagacatatatatgaatgatatgaatgtgtactatgatacattggcctttttgaattacttttacaattgctatagttaagccataatcatagcaaaatatttcaccaagatgaaaggaatataaaaatgtttctggcattataaaaattgcagtgaagaaattggaacttaaagccaaaacaaatagcttacataattaaaacagagctttgtctgtggtaaattttttggcctggaaatgtgaaatatttcttaattcttgaaagtaatagttgtgaacacttcataaaattatagtgagagagagaatgtgctgtaattagcagctgaagagataaatagaaaatcttgcttagtcgtgtaccttacattttcatcctgacaatgctgaatacattttaatgagaataaaataaattaaaattaaagcatcagcatagattctatatatactgtttttccaatccacattccaagagtacctctgtgtttaccattgctatatatatatgtgtgtgtgtgtgtatatacatgtgtatatatatatgtatgcacatatatatatacatatatatataatttcattagtttgggggaacaggtgttttctgttacatagataagttctttggttctaatttctgagattttggtgtatctgtcacccaagaagtgttcagtgtacccaatgtatagccttttatccctcagctccctcagccccttccccccgagtctccaaagtccatcgtatcattcttatacctttatgttctcatagcttagctcccactaataactgaggacatgtgatatttgattttccatccctgagttacttcacttaaaataatgatctccaactccatttgggttgctataaacgccattattttgttcgtttttatggctgagtggtattctatggtgtatatattccccatcttctttatctattcattggtgaatgggcatttaggctggttcgtatttctgcaattgcaaaaacaaataacctcatcaaaacatgggcaaaggacatgaatagacaattctcaaaagaagataaacaaatggccaacaaacatatgaaaaaaaatgctcaacatcactaattatcagagaaatgcgaattaaaactaatgagataccaccttactcttgcaaaaatggccacaattaaaaaaatcaaaaaataatagatattggcatggatgtggtgaaaagggaacacttttacactgctagtcaaaatgtaaactagtatagccactgtggaaaacagtatggagcttccctaaaaaaccagaagtagaattaccgtttgatccagtaatcccaatattgggtatctacccagaagaaaagaagtcattataagaaaaaaagacccttgcacatgcatgtttataccattgcttttagattttactttgcagacttgtaagaattctgtgatacaatgggaatatgttacttttgttgctgagttttacatgatagatttctgtcatataagtcagcaataaaattaatgattaatgattcttatgacctccttatatatatcttaatgagaccaacattaaagtttggcattaattaaattctgggccaaaaaatatattatttcagacgcagcttgtacatttttttaaattgacttttgagctgatgttaggtttgattagaaaaacatattcaatgagctccaaaagttgtgcttatatgtgatgtcagaaatatccggatactgaatacagaaattgaaatgaaagatggaaacctgaagaagactacttttgaaatagagtgatctaatttttatatttactaccttcaaagcccacctctcactgtatacttttttggggtaaaaaaaaaatgtgcacttcacattcccagttatctacgaactgactagattcatttaaattcattacatagttatcaaaccttcactacgttacaggactgtgctacatactggctagacgacaataatgaagctcattgaaaatatcattagggacacacataatttgctgagctttccaccaatggaattacctaggtgctctggtacatgaagacaaactttattctgcctggggaaagcactggggttttccagaagaggtcatctttggttaagccttaaaagaattggtggattttttcaagtagaggtctttctgagaacactgtaaactgaatgatcagtgtgaacaaatgtatgggccgtaagtggcctcacagagacaggagaaatgtccactagttgagtgtttattgtagcatctgggcgaagtgtgaagagaaacagatgagcagtgtgtcaagtagggaggagaggcgacagaacggagggaaactggaattgtgaggattcagtgtatgggacacacacagatgttgttggggcggtagacaggacttgggaactagatttgaactcttattttactatatgtatacttattttacccattattatacaatgctacatattctgatagtaaaataagtataaccacatctaccatgttcacatcttgaagagggttgaagaaaatcaaatgacgtggcttcgaagtccttcctccgaaccagataggttctgctcagtgagtgagggtgtatttgcctagacatgcaaatgaatgaatgagagaagtgcacgagaaaacctactatcaccaaagacctacgtcagttttcccaaacagctttattagtaatacagctaacatttaaattcaaaaatgataaaatgaggagaaatgcttacatttgtcatttgtattagggatgagtgactacaattgggaaacagagaggaagacatttttgtatttgaattgttgatagatggtaatgctaagaacaggataaagaatggaggagaaaaatgaggagaagctggggagagacttcaggtaggatctactgtttttttacagttggtgaggtgcctgcatgtcctcatcattgagctacaattttgttttgatgtcaaccaaggtgtaaaaactagatcatccgtatacaggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgagaaagggatcattactcttgccccaagagagtcagtggtgtcttgcattgagtacttttcagtggagtggctggagatgaaatacaattgcaggaaattaaagaatgcatggaggtaaaaacaaagaaacagaaatgcagtctacactttcaagaaggttgatgatgatggaaagaaatgtgtttgagaataaaacaccccgtgaaagattagcatgcaaagacaacacaacaaaccaatatactgttttgtttttccctttggtcctattccaactagctaatggtggctgtatagccttcttatatgactcaccatttagtttaggttttctgtctccagggagagcataacatggtaaacccttggaatatcatgtctcctttgctagttttcttctttccagttcaggggattgcagtgatattttccatcattgactgcagcaaagatcccaaaggtggaaatatgcctccctcaaaggtactgatgtcatctccattaggaggaatttctgtataatctcactaaagacaccatgaagatttgtcctgtgttttcagtgtctgatggatgctgctgtaaggcagctcttagtttttatttgcacttttatgctttaatgcaattctccctctctctaggactcaagtatgagtcccacaggagaagggctggcagaggcattaagtgctagaccatgagctgtattgcatcattctttcattcagacctggctcgtggttttaaactatagttgtatactctggcctctttttctttagaagatatttctttcttttttcttttttttaaggggcctctctgactatgcttacagacttctttttctttgtgagtcaatcctgcttgcccatcacaagtactcagattaggctaccaattggagtaacctgctgctacgttagttattacagagggaattgtgttatacagagggaataagttatacagaggtaatgatgaagtaggtaaagttcaaattgctgttctcttgcttttcattgaataagggagggagatggggtaaagggtagcaaactgataatggaaaggaagagtggtgctactttcattaatatctaaaaagcaatagccgacataactgtcttcatgctaaaatcaaaagtgtaagcaatatgataattcttaatactgccatgtgcagatgtaccaatcatgcttgtgttaatgcaccatgtaaccgagaagatgaagaaatcaaagacatgtgattacatccaaagaccaggagaaaatcacgatagtattgaggatactttcaaagtaagtggctaaggaaaattttgctacatctttcatgaatgtcacagaaaaagagacagtttgaaaatggaaatttttccaaatcttattgaagttttgctagtatattttactgagaattgagcaatgatttttgagatcttcattatgctgaagattaaaaataccaagttgttgtttctaaactcatttttttcagagaatagatagcttttcagcatttaatatgtacaataaattgcactgtggcgatacacagatgaatctgacacagtgtctattctatttaattaatgtcctgatataaaacgcactttagaaaacattaagcattataaggggtaaattattgaaggtgttcaaacagattatgttcatatatagcgattaggaaaagccttgtaaaaattttggcattagttggacctttataatagatagcacttagaatggcaagagaaaatatggtgccttccaaatagagggaaccacataaatcacgtggtagaagacacaagcaatgaacatagaatgcatggcctctttttattgggtcgagtgattttatgaaagaagttaagagaaatgaggttgaaaatgcagtttgaggcaagtcatttcataccataataaggagtgtgggttttatctgaaataatttcattgggtaactttaaaacaacttgttaaatgatctgatcggaaattctacatagaagctactgcagatagcaagccttttgagttctactttttttcccctttcaacaacttctacgtaagaagaattaaagtccacagactatcagaattaagggaactttgattttcttcctcaaaatgatgcctactgttaagtatgaaaggttaaccttactccaggaaaggaagagtaaatctatggggtcaggaaggctgttgtggtgaatggataacttaatgaaatgatcaaatagtcctgaatgatgttaattagggcaattttgtattactataattgctttgtatttattgaattattgcaatgggtgagttactagacagaaagaaatctatgcagtacgctgaccaaacactgaaaggatgacagaattggaatgctcttggctgttcaattcactgcttaagcagtctccaaatacattaggctattttttttctttttctctttttcttcttgctcattatctgctcattgtccttggatgggacagttccttatttgagagtatatcacatgttcagatctttttcatataaactttcctggcagacactgattctacaagtgttgtacattgtttaatgattttgtaaaacagatatttactgagagactgcagtaagacagactcattacccaagatcagtgaacccactgcatgcaatagatgaggaagcttctctcccataattccgaactgaaatacaaatgctgcctttagtcgcagaagttaaaaccttaaaagtttgtgttgaatagggaatgtcattgggggacatatcgaaccatgtgttaagatgtgtgaatggaagggtctggagaaaagagagaagattggaagagaaatgtatgggtggtacatgtagggaatagggactcaaagggaatgtctgagcaatgggagacactgtgaggccatgggatgtggcaatggcagcctcagctcatagtacggttacattatttattctttttagttttccagaaaaaaaataatattgccaagtatgccaacctaaataacaactcatgtttcaacactgtattttctaggttgttactggcaacttagaaagcctttactttggaaagagtgcttgagtggtattgaggttcccacattggcttagcaaagtcttctttgataacttacttctagaattatattaatgaacagtagtaacttgctatttcaaacatgatctttatggggaaatgtgtactgaactccagtaaaatgacaacagcatatatgtccacaccatgacagtcttttatgccactggaaaatgttcagaagtggaggcttcctgccagcagtagtggacagaagaatgaaagtaagagtcagattttttggaaaagcatttcatagctttcgtccccggtggctttggaggaatatgccacttctgttactgtgggaagtgcagtcagaaataatagtaacagtggtagctgccagggataggtctgtggactttgggaactgaagtacttgaatttgctatctttatcttgattggaatctatgactattttaaacactttctccaatttacaacggcttctctaagaaaagcttcacagctttctttcagaaaagctttgagaggtaggtttgattggcctagttttattaatgatggctttaaagcatattgagattgaggctgtcactgccaaacatagcacctctctttgtgaggccctatttctccaacatacacatttctcactctctgccactttttcagctgtccagtttctctgctgatctgtaaattcagtcatggaggaagaataagcttaatataatcttcttattagaaagcttttactgcgacaaaaaatccccaggatcttagctctaagtctcttcaacccctgtctataggacctacgtaaagggcaaaagtgtaaaataaataaaaggagataaaatgaggagaggggcaaaaacgaaagaattacttattaggaaaagtaagagaatgtgaaaaagaattatttgcaatgtcaaggtttacatacttctccaggtcaagtttatttttctccaacattattaatgatttattgaatctgaaccccaagcataattctgttctaggcagtgaggagtcataaatatgatagaaaatgttcttaccttcagagtggttacaatgtgatagaaaagtgtatatttataaaatattctaagttatttcaaaatagaattgagaatgtgacaaaagcataggctgtagaaaaaatggttttaggtagattttctctgggcagccccaccttccagtatcagtaaaaaacctgtgttgaaaattgctaccagacaatctctcttgttgagcatgtctaaaaaagtttcatgcctatcagttttgtattctatcacatatcagtatggtgcccttaagcagattccaagaggacctcctcaatcggaacatatcgcctcataaattataggattaatttgttttaaagatgccaactttctctcttattcaggaatgctttttttctgaaaatatacttagaatcttagtagatactctcgtgaatttcatgactaattctaatttgttcaataaactgttgattaaattacataaaatttgggcacactggataataagtacagagaactcatccctgtcccttcaaccttgctgtgggagccactgttcttaattttctaaataattccagtgagtacttttacttaaattatttgaataattccacctgtgcaaacctgactgcaatgggctgttaacctagaaaccctgagtattagattatatctgaaataattgccaagcttattgtttagtttaaccctagtttaactcagatataccaatgcctcattatgtttgttaactctattctgattcttcacatatgattaattatgatttattgagaacatcgttttccctctgtgtttactacagtccacagagtctataggagcggaaatctaatgggtttggtgttcactggagttgttcctttgaaataattaaggctttattttaaacttagcaatagggtaaggactgccagatatttctttatgtacttgaataaaatttgcttaaattcttcaaatctctggtctcaaactaattgatttctctgatgcagtgcttccttctcccaattgtgtgcctttaaatgaaaaatctctcttctaaccctctagctataaggagtttgccaaaggcaaagttgttaaccaagatttttattttgacccatagttccagctttcttttcgttttgacagttaatatgaatatacagaatctcagtgtattaggctattcttgtgttgctataaagcaatatctgagactgggtaatttatgaagaaaagaggtttaactggctctgtaaggtgtacgggaagcatggtgccaacatctggttggcttctggggaggtctcagggagcttacaatcatggaagaaggtgaagcaggagcaggcatatcacatggtgagaacaggagcaggagagggagtgggggaggtgccacacactttaaacaaccagatgttgtgagaggacagcaccaaaccatgagggagccttccctatgacccagattccactagtctctgccttcaacactggggattacatctgcacatgagatttggagggaacatatatccaaactatatcattccaccccgaacctacaatctcatttccttctcacattacaaaatacaaaaatcttgtcccaatagtcccccaatgtcttatttcatcccagcattaactcaaaagtcctaagtccaaagttccatctgagacaaggtgagtcccttacacctatgagcctgcaaattcaaagcaatttatttacttccaagatgaaaggtgggtgcaggcattggataaacatttctgctccaaaaaagagaaactggctaaaagaaaggggccctaggtcccatgcgagtttgaaacctggcaggacagtcattaaacctcaaaacttcaaaataattttgttttactacatgtcccacatccaaggcacactgctgcaaggggttggctcccaagggcttggacagctccacctctgtggccactgctctatcaggctgttgggtgtttttccaagtgcaggatgcaaactgctggtggatctaccattctgaggtctctagggcagtgtcctccttcccccagcttcactaggcaatgccacagtgggaactccttgtgggccctccaaccccatatttcccttctgcacttccctggtagagcttctctttaagggctctgcccctgaagcaggcttctgcctgggcggccaggcttttctatacaccctctgaaatataagtggaagctcccaagccttcttaactcttgtactctgcatgcctgcacgcttaacaccaggtgaaggccactgtgttggtccattctcatgcttctaataaagacatacctgagactgggtaatttataaggaaagaggtttaattgactcacagtacagaattgctggggtggccttgagaaacctacaatcatggtggaaggggaggcaaacatgttcttcacatggaggcaacaaagagagtgccaaagaaaagaggggaaaaccccttataaaactgtcagatctcatgaaaactcactcattatgatgaaaacaggatgaggggagtgaccccccatgattcaattttctccacctgctctctcccatgacacatgaggattatgggaactataattcaagatgagatttgggtggggatatagccaaaccatattattccacccctggaccctcccaaatctcatgtgcttgcaatttaaaatgcagtaacgcccttccaacagtcccgcaaagtcttaactcattccaacattaacccggaaagccaagtccaatgtctcatctgagaaaaggcaagtcccttcttcttatgagcctgtaaaatcaaaagcaagttagttacttcacagatacaatgggagtgcagacattgggtaaatacacccattccagatgggggaaattggccaaaacagaggggctacaggccccacgcaagtctgaaattcaatagggtagtcattaaaccttaaagttccaaaattatctcctttgactccatgtctcagatccaggtcaccctgatgcaagaggtgggctcccacagcatttggccgctccatccctgtggcttttcggggtacaggtgctcttccggctgctttcatgggctggcgttgtctgtggctttacaggtgcccagttcaagctgtcagtggatctgccattctgggatctggaggacagtcgtcctcttctcacagctccactagatagtgaagcaatggggactgtgtgtgggggctccagtcccacatttgccttccacactgccgtaggagaggttctccatgaaggctctgtctgtgcagcatacctctgcctggacaccagggcatttctgtaaatcttctgaaatctaggcggaggttcccaaatctcaacttttgacttctgtgcacctgcaggctcaacaccatgtggaagctctcaaggcttggagcttgcagcctctgtacccgtggcctgagctgtaccttggtcccttttagccgtggctggagtggctaggagacagagcgccgagaccctatgctgcacacagtaggggagccttggcccaggcccacaaaaccatttttccttcctgtgcctcttggcctgtgataggaggggctgccacagaggtctctgacatgccctaaggagactttccccattttcttggtaattaacactctgctccttgttacttatgcaaatttctgtaaccagctttaatttctccccagaaaatggggttttcttttctatcatattgtcgggctgcaaattttccaaacttttacgctctgcttcctctttaattatttgacgcttagaattgtcttctaccagatatcctagatcatctctctcaggttaaaatttccacagatatttagggcaggggcaaaatgctgccagtctctttgcttaagtataacaagtgtcacctttgcttccgtttccaacaagttcttagactactgtggcctgggcgtcattgtccatatcactatcagattttggtcaaaaccattcaacaagtctctagaaagttccaaaccttcccacatcttcctgtcttctgagccctccaagtctctaggaagttccaaagtttcccacattttcctgtcttcttctgtgccctccaaaccgttttgacctttgcctgttacccagttcaaaagccgcttccacgttttcgggtctctttacggcagcacccaactttctgtggtaccaatttactatagtagtttgttctcatgctgctaataaagacatacatgagaccgggtaatttataaaggaaagaagtttaattgactcacagttcagcatggctggggaggcctcaggaaacttacaatcatgatggaaggggaagcaaacacgtctttcttcatatagcggcagcaaggagaagtgccaagcaaaagggggaaaagccatttataaaatcatcagatctcgtgagaattcactcactatcaaaagaacagcatggaggtaaccactcccatgattcaattacctccctctgggtcctttcacagcatgtggggattatggggactacaattcaagatgagatttgagtggagagagccccaaaccttgtcagccaccgaggcttatggcatgccttctctgaagcagcagactgagcagtacctgggaccctctgagcctgtggctggagttggagcagtcaggattcagggagtagtgttccgaggtagtgtatggctctgatactctgggcctggcccatgaaaacattttttctcctaggccaaagggtctttgatgggagtggatacctggaagactgctgaaatgcctttgaggccttttccccattgtcttgtctatcagcacctggctatttttgagtcatgcaaatgtattaagtggttgcttcacagcccacttggattcttcccctgaaaattttctaacacctggccaagctgcagattttttaaacttttacactcttcttccttcttaaacagatgttccaactttaacatcaattatttgctcctgcatctgaatgaaggctgcttgttagaagcagccaggccacatcttgtacacgtggctggttagaaatttcttcccacagatactctaaattatgactctgaagttccaccttccacaaatccttagggcataaacagaatgcagccaagttattcactaaggcacaacatgtatgacctttgctccagttcccagtaggtgccttacttccatctgagaccttgtaagcgtgaaatttcactgtccatgtcatatcagcattttggtctcaaccatttaaccagtctctaagaagttctaaacgtttccttatcttcctgttttcttctgagcccttcaaactcttccaaccctttcctgttacccagttccaaaggttcttccacattttcaggtaatttttagcaataccccactcctcagtacaaattttctgtattaggacattctcgtgttgctgtaaagaaatacctcagatggggcaatttataaagaagagaggtgtaattgactcacagttctgcaggttgtataggaggcatggtgctggtatctacttggcttctgaagcctcagggagctcacaatcatggcagaaggcaagggggaagcaggcatgtcacatggtgaaaacaggagcaaaagagggagtgagggaggtgccacacattttaaacaactagattttgtgagaggacagcaccaagctgtgaaagattcttccttatgtcccagaaaccacccaccaggccccatcttcaacactggggatgatatctgagcatgatatttggagaggccatatatccaaactgtgtcactcagtatggcatttcatctggataggatgtacaactaagtagaagcccccttagtttcagatgttgagtatttttttcctaagttacataacatttggtctacattagtccattcatataacataggtatatgccttgatgatataacctattttgtcttctcgtttaaaatcatttaatagaatggatttcaagtcagtaatgtcaacagaattgaattcaaagttataaagagtcctagaaggggtttttttgttaagagaaggattcaaactgtggaaaagagataggatatatgtagaattccacttgcaattaaaatatatgtaccgttattttctcttttcctctactcttgtgattacttctattccttaaatggaaacagctgtcattaaaacgtgaaaatatttctgtttaaaagcaaatatttattgatgctaaaagcatcaaggaaacaaacacactttcaagttaaatttgttattgtcatggtacactgaaatagattttgttatactttatatgcctgaaattagtatgctatgcaaaaggattagagtgaaagatttaagcaggtcagcagtgaagatgctgccagtagctggtgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaaaaaaaaaaaaaatctttaaaatgttgttaaataaattataattaaattgaaaatcaccctaaattgaatatagaataatttgtaataataaataaacatgcattcaacatgttaaatgagaaaaagcagattgcgcacttcaggtataatgattctattttatttcatgtgcttacacacattgggaggctgagatgggaggatcacttgaggccaggagcttgagaccagcctggataacatagtgagatgagggcatctctactacttagggcacactggcatgctcctgtagtcccagatactgtggaagctgaagtgggaggatcacttgagcctgaggctgcactgagctgtgatagcaccactgcactccagcctgggcaacagagtgaggccctctctcaaaaagtaaataaaaaataaataattgtgcttacatatttatcttaccaatgaagattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaaaaaaaaaaaagaaagaaagaatagcaaaagaaacacacttcatttatttgtacccatattagtaatagtaccttatccagaatgaccctagaaaaccatttacttattgttcattggccaagaacataattacatggccacacttagttgcagggaagtataggaaatatttatagtctgtacctagacatattgctgccctatgtacctagacatattgctgccctaagtactattcttggatgaccatttagcggcctctgtcatgacatatttgtattgaatgaatgatgatattaaaaatacacatatgcataaacatattcacacaaactatatatgatatatgctatatagcataattttattatctatgtgcatttttctttacttacaaatgtttaatttggtcatacttgatttagtatatctaatagtcgttataggtcagtcggtcatatgtttctttttatttataatttaaaatatgttttaccttatataattacacttttaaaaatgatatgtttaaaaactaataaatttgaaaatttatacaattcattcacgcttttccataaaacaacacttctggcattaatgagtcactgctttccataaagtatacataacaattatatgtatttattacacattctatattatattatatatacattaattatgatatataattgtatcatgactatgtataacttcatggtattatgtatataacatcgtggtattattttcaagccttttgttaatatcagactgttttacatagcaattaggaagctagaaatgggttcaaatcattccgttggtaataatttgaacttacttttctttcatggcatgaaagtttttgtgtgctactttttactattcctaaaccaagaaacgtgaagatcatgtgaatgtatttgctgttcaattggaggtcagacgttcaactcaagaaaggcttggcgcaagataaatcactctgctgtgaaatgagtccataaacacaatgcacttgccagccctcaaacaaagtagatttacaagtttttaaaaatctcagtgagaagtactgttgtttccttgagtgtaagttactcttattcatgaatatgtttaaattttagaaaactggaccacaaaagtctatcctaactatagtagtctgtgattaaaatggcaaaagcaaagggtgtatgatttttaagctcattttagtgctattttctagtgttttaaatttttttggtttgttcttaaataggttttaattggaagtgttcttttgagaaatggaactaaaactttgagtggggcagtatacttttaaagtcagagtctatccttgggttcataagttcattcaatttggaaattaaaagtagaggaaactgacaagggagttggggcgtgctgtagaattactctcaaagctaaacatggagttaaaactgtgtcaaaaccataattagtatttgcccttgaattgtccttgttaatagaagtggaacagtggaaaatactgcatagaggcattgtctggaaactgcatttcatagccaataaattcaaaccaccttagtggaatataattatgaggaggagctatagtctctgtggctgaagaaaaaacaacaacaagaacaacaacaacaaaaaacgcagagcatgtcttgctctacattctaacttgcatcatggaatccgccggatctatgccattttggatttcattgccaccggttgaaagtggtagatttctttttcttaagtcggctagaagacctaattttagtaagcctaaagggcactgagcaatacaactactttggtggatcgtttccagtttgaggattcctagtgcacaatcagtgaatgttgtatggaacgcatggtgaagaaatacggtttagtgaatctggaaacttaaaaaaattggccttggcatcgtgaggaattcccatttggccttcagcatttttgtctatgttggcttttctgtcccaagactttctataatccaatttatcacttgctttttgggttaaagggaaataaaatttccacacttcttcaatacatgtgctggagaggacaaggggagggaatttattttgtgtgtgtgttgtaaaatcagaagcaattgttgaaaggtgatgaacagtttgaaaggtatgttgttctcttgtactacatccagtggttactatgaagtttttctcatcactcttttgtatcctttcttaaattctgctgtgtggcagagtatcttatttatctccatattaacatgccttttgcaaggtttagttatattattgcaactgttctcaaaagatacaagcttcctcctaaaacacgtcacaatcaggttttgctagacagctactaacagccttaaattaaacaggatctcaggatgtcttgtcagtttgggttttcagctgcagacagttgacaagggataaagaggacagaactaatgccacatgccatctccctccaaagagagaatccttgacccctgagtttaccattctcatttttgagattccattttcacttctaccacatacaaattgctttccttgtttttaacacagtgaagtaatttgaaaaaaaaatctgataatgtatctcatatctctatgtcttttaataggaagagggcacatattaattcaacgtattcatttgcaagaacacaaaatcctggacttttttttttaacttactgatcattatatatctgagaaatttggtgtaacaccaagtcttttgtcatcagtagctcccattttttaaagacttctatctctatattcaataaatgtcacaattatttgctatcattattttaatatgtttactattatttttattttaaaatatgttctcattttcatatacttactattttatttttagtttaaaaatattttttcagaaacctaaaatgtcagtgaatacaggtaaatatttattcattttgactacatagaaatctaaagcaaatattgattgtgatatgtacatctacatattaatataacatttttataaacgtattgtttctgtttcaaacatgagtcttggtcaataattgatataaataaaaattcaagttttccacaaaattttgcttatgtaaaattaaataaggtaacctttatattcagtcagttctggctcctggataaattgcatgcttagaaatttcactttaataaaataaaagttttctcctcatctgtaatgtattctcccttttactgtactggcatctacatattgactgttttcatgaattatttcttcccaagatccctacaaagaagtaaaactcattcataatagattgtatattaatccccaaattccatgtaattctacagaaggaaaaaaacataaaccaaaatcatggtacttgcagtggaagaagcataagcatcctacatttatacccttttccccataaatacatagtgtgactggcagcctgcacagtaatgattaaatgagacaataaaatcttagcaattcttaccctgagtctggaagtgattaccgtgtccaagagcaagtcatttcctttttctaggtgtagtttttttattctacaaaatactaggaagagattatctccaacagaagtcacatcttctgggtcaaattaggatcacaaacatgtgtttgtgtattaaaatgttttaaatttgaatcagctgacaatacttcaaaaattgggagatttgatattaatatcttgtaacacataatgggtaaaagactgcccctggcaaaagcctgcatctctggttctccagaagccccacccttcccccttgctaccagtcacttaaaccaagtctgtgttgtggcttaatgtctaattgcctttttatttaaaattctgactttggcccctggcctagaatgaccattaatggtatatttagccatgatatctatgattctttaaccaataactgcttaaggctatccttgccttgatgtttctcccagagcttgcctagtcaagcttcatcctcttagttaattatggtcctctatagaatatgtgctattctgtcttttaaaggcttttccagggatacatttgacatatttaaacatgatagctaggtaagctgtttcaaaggcattatcctccataaacattctactcttgtataaaaagtcatttcaaaatatactattttactagatttattcatgattaagtcaagagttgctccatcggattagtatttattttcaattgccttccttatatacatgttagatagcgttgcactctgaaactggatttgaaactttatttttttctttataaaatattagtgcaaaaatcacaaagggattcaaaacacacacacacacacacatactcattattcaatagattttgtatgtttgaattcaagaaatgatgagttataagttatatctgaaatgtccaggagagtgggtcttaattcagaaagaaaaaaatggaaggtagttaaaaatgatttccatagtaaatactcaatagaattattcactaagaagaaggaaattatgttgaaaacttaaacttttgaggcttttcaagagtgttaacaggtatctgtgacatattttttagtactttaatttggtggacatattcttataatctgagttacaaatcaatttattaaaacttcaattagtttttgtgaaaataatgctgtacaataaatgatgcaaaatgtcaattgactaaccaccgacaaaatttatccctcactgaaattcctgtatgttgttaatgtgtccctgctttgggctgtaggttgggttcaggtatctatgtgtcttttaatctggagcctatcctttgctggggaataatatttgtacaggatagggcaggatcgcataaacaagtcaaaccacacatgtgcatctacatcctggttggatacagcttattatattaactcacattcgattagttgaagcaagtcacaaggtcaagctcaaagtcagtgaagaggagcattatagaggcattgtggctaaaccacaataagccatttcaatgtggggaaggaaggaagaattgtgaacacataatactatctgtcacatgaaatatgcttggtaatttgcattattttggatatttcacataacaaattcaaaatatagcttgagaaagataatagacaaagatgtcacatattttggaatgatgtttaagaaagatgatgctgtttcagttctgtaagctcttaatatttatcaatatgtcatctttgttttaaaatgtaaagctttatctacatgatgattgtgaaaagtgggtaccaagttttgggctatgtaatagtacatgaaaggaaatagtcataagaaaatcatgaatttagaaaaacaccattgcattgatagattttattaggggtgtcaaatgtttcagcttataggttagagaaatataagcccctcttttcatactgctatgtggtatgacttgctgttattataaacttctgtacattgcacttgagtttgatgaagatccataaagatttagtcattgaaacataacagccattgtgccacataaccttgggttgaggtctcaattcagagccaacttcagacagcaccatgaataaaatttgatcttgccaatttcacattccccatttctcccattcaatatgtacacatcgatgttcccaatgtctttattttgtcctttggctttggattccatatatatatatatatatatatatgcacacatacatatatatatgattctcctttaatttcactcagtatcctgtcttacccattttgaacatctgtttaataaacagttattattaggcactctgaatttaaataatcaggagacatggttccctaggatggtggtattcaaatgattttacaaaaatcctggcagattataagaaatagattttaattgcagtccactaaatacatacatatacatgcatacatgaagcaaaaatttcacaaataataataaccttactacaggtatacattatgatttattttatttcattgggggtgagtgttggtagccactcactaaatgaatgtcagtccctagtgtttctgaattcagtgtataatagcactttaagattttaggtttaatggtggccagggataagggtcagggaaaggggcagctacacatatctccagtattattaaatgccaaataaatagtgcagataataagtgctgaagtgtttagaaaaaggggccaggcgcggtggctcacgcctgtagtcccagctactggggaggctgaggcaggagaattgcttgaacccgggaggttgagactgcagtgagctcagatcatgccactgcaatccagcctgagcgatggagcgagactctatttcaaaaaaaaaaaaaaaaaatttagaaaatgaagaagcttattttggctaaaatgtaatactagaagttatcaaagatgaagaagaagaggtaggacttgaatttcatattagtgtttcaaaatatattaacatgaggaggtaatttaattattatttaggaatggttatcagcaagacatattttagaagctctgtaatagtttcgagggattaagtataggagttcattttgggaattactgtgagataaacatgaaacgaaggattgattatgtattatatctgaacatgaattccaggccaattatctcaacatttatctttcatgcaatggagattttctttgagtttctgatatggaagctagaatgatgtaaaaaatatttaggaaggggaattcgatatgcaccatggtcacctacgtgctattgtattttttatgtttttcttagatttttcaataaaaattctaccatgtgttttctggggcttgttagcaatttagtaggagttatattgaatagtactttaactcaagtgaaggataactaggtacactcttgagacaggtgttcattggcatatgatgtattcatttcacacattataggttctagccttagaatttttcatgttttaaaagcattattccaagcatccaatgtatgttgcgtttatcccatatgattttgtccagaatggttactgtccacagaggttttatctttgtctgtggtattaagctttttgaggacaatgcaaatggcttcatattcgagaatgataataatttggtcaacttttatgtactgagaaattaattgaagatttcaaaagactaaatagcatgaaatatttataattgctgtatagtgaaaaataatgagagattttcctatccttatacggtattttgcagagggtataagcaaaagctcttgtgatttttattcattttgggggggagaattggataaattatgttatgtgtttaaggtactggtttttgttttattgtaagcaaacttatttactttttatagtgctagtcgttatcaatgccagaggactgctgaattgtcctgttcccacctccagtcctataggacttcaccatctaaaaacaccttagttcccatacagctttgctctagagtctagaaagatgctaatgattatatgctagaaggaatcaagtaatatttggaggaattgttcttgtgtcttctagattatcattttagaagcaaatcatgctttctgtgagatgtccataagtgcctctatcagagacggattataatgctgtggtgttatgggtctgattctgtggggagaatttagcttactaatttcgaacatatatgcaatatgtatcaaatagtaagtgctgcaaagtatgtccctgtgctttaaaagggaattactgaagaaatttctaatttcacaataaaaaatattttagagtagcagggacttgtttttaggaaggaaatctgccatatattagcaagcaccattacattttaaagtgatatttttcaggcatgtaaagagtcaagttcttgaaaataagaacacctttattatcatgtaactgcatttcagcactgcatcgctctctgtattcccctctcctctccttgcctacctctctcacctttatttcactctcttccttctaatcttgtcactttgcttttcctgcactttccttcctcgaggcatttgtttatgcagtttctgtagccccacatgcttattcttctcctataggtaaacacaattccaatttttcaaaatccatctcaaatcacagagccttcacgatggctcccaaagcttccatcagatttaatttgatgtccccatatttgccatagattgtgcttttaaaaattgtagttatccttctctgtcttatttaatggtaatttatgtgtgtccactcatttcataatgctctactgtaggttaaggcctatgtctggctcacaaacatcttactcattgacacagagatttgcatagagcagacaccaaatagatagttacactgaatattttatgaatcatattaaaatctataggtggcttttaaccatactttattgatgttgtttaattagaagtctctctcaaaaacttcatatgctttgatgctggggaggatgcctcactcattgttgtatccgtatttgtaactaacatttattgagttccagttatgtgacagactcctactagctctttgcactttatatggctcatctcattgagttcttagaataacccaccagaataggtgggcagtaatagctgcagtttataggggaaaaaaaattatgagtcagaggctaatttactttccaaggtttgaagaggcagtaagtgacaaaaccaagataaaaactcagaaagcttcattactttctgcaaaccttgaacaatctagtgaatgaacgaatgtgtcttcagagttatgacataaccagcaggagaaagaaaccatcatgcgacttcctaaaatacgatgcattatttctttcaacaaattatttaagtaagtgtactatgcttagtagttatgtgaatcattatcttggattttattaactgtagggctgtagactttggaaagaaagatcctaatactgtgttcaggaatcaatgagaaacaaagatattagtagaaaaatggagtggaagagaggcagtgggtgtatcgattatgtactttggtgattatgatttctatgctatggatatttaaaattttattttcctcttaatcttcaatttccatcttctggtaacttctttagatataagaccaagacactttctttaccgttatatctgctagatttttatccagtgtattttaagaagtcttttttatccagtgccttttaagaagctcagtccgggtgcagtggctcacgcctgtaatcccagcactttaggaggccgaggcggcggatcatgaggtcaggagttcaagaccagcttggccaacatagtgaatacctgtctctactaaaaatacaaaaattagctgggcgtggtggcacgcacctgtagtcccacctactcaggaggctgagacgggagaatcacttgaacccgggaggcagagtttgcagtgagcggagaccacgccattgcactccagcctaggtgacagagtgagactccgtctcaaagaaaaaaagaaaagaaacagaagctcaataagtgttatttgggataaagcattaactggtttaaagctcaagattttaaacaactcaggattgggcattaaagaataacagaagctaccatctattgaatttttattaagacatttcaggacaccaggagtaagaatacagggtagctgtatttgttatctattgctccataacaaataattccagactttctggcttaaaactactcattatctcacagttcctttgactaggaattcagcatctctaatttaaggtctctaaaatgaggttccagttaagcgattgacagggtctgtcgtcttatctcctgataagactaggaggcttgactagtggaggatctgcttccaagcttacttgtggggtctcagttttctgctgtctgtgggccagagctctctttcagttgcttgctatgcaggtggcctcatgggactttctcatgacatggcaactggtttctccatggtgaacagtctaagaatctgtcaagatagaagccacagtgtttttataatctaaattggaagggacattccatcacttctgccactttctattggtttgtagtaagtcagaaagtctagcccacattcaaggaaagaggattatggaagggcataaataccagaaagagaattttgggtgactcccttagaagctgcctatcaaagtacttaccctgccattctgtctacttatcattgtatttctctttaatttgatcttgaggttgtaaagtggctataaactttagccctgccctgatggagttccaggggatttatttggctgtgggtatttatgatgtgcctttcactggatacttctttatcctagtggataacctaattcctgtgcctaacttgttactaggtatacttcacacacacacacacacacacacacacacacacacacacacacacacagacacacacacaaacacttatttatgctggcagactgacagtcacctttgcagctcttgtctgttctgccaagatagtcactctctgggaaagctttgaccagaagaaaaattgggtatggatgtattggtcaggagacgtagagaaggcagcacagcaaaacatatgaagtataagaagcagtttattactcatgagtccacgagagaagacggctactatataggaagcagggggcaaggttgcaggggcaatgtgctgaaccatcagatcaggagcagatagaaagaggacctgtggggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagacaagatttgggactacaaaacattctcgaggtagtgttccaggaagctactgactgtcaattatttaggattggaactccatttgaaatctatttgttctttatattgtttttttttaagtttatcttcattaaaaagctgcaaattaggtattcatttttttattccactttggagaaaacaacaacactaagaaatgtcaaaattaatcattgatatatttgtgaccagtaccttcaaaactagttcaacctactgaaaactactcaagctctttccaccacataatagcactttcagatattgtttttgcagcttaaagggaatttgcatttaggtatgtgtacaatatcaacaaattggtgctacaggcacattcaatgttcttctttttagaggaaattaaattcaatttgattaggttgatgtggacaacattaaaataaatgttaaccttattctgtatttatgaatcaatactgatagttttaagatacctggccattctacttgttggtaaggtcttggaataaggaaatcttgacagaagttttgaagagtatattctttatcatttcaaactgtgaaaactatgcactttcctaagagtagattttaaagtcacacaagggatcatgctgaaaactgacttctagagtctttgctcagcaggttgttgcattttttttctttactattgaacactcttttgttcatgccttttttcttattgcttgcagaaatgtgacaagcttcaaacttacacagaaagaataagtagtagagatactaggtatcattgcacagcccagatgtcttttgaaaatatttattcagctgaactagaatttcaaaatctattagaaaggtaaaatatatcttggaaaacaaaagcagattttgaataaaacataggtaaaaaaacttttaagtaagaaaatatgaaaaaatggcaacagctttaaatgataacttgatggcttccacagaataattcatagtgtaggtattttttattaaaacttgacaaatattctaaaaaatgtaaaagtgaaaattaggtattttaactgagaaagatgaaattggcaccatctaaaaaaattttcatgagttccatttgtgttaagaaaatatttcttatttaatcaaatacatgtgcaaaatgttatcttaaaatccttttagagttttgataaagaatgctcaatatgagcatacatattcagccattagttatattcacattctcttccagaaataatctgttaataattaaatgtgttttataaacacttacataatgaaactcaaattagcttctcagataaattgttgttgctgttgttcagctggtattgttataaaccatcattcatataactttattatattgtgagtgttttctttgaaactgatcaacctcagcatttaggatatgtggactattagatggagaaatgaatatttgccttagcatagtaataaatattgttagactgacacaaatattagcctgcactcatagtgcctaaaataggccattccagtaattgcttagaaaaatattatttgtacagcttgtagaaatttacaaatgaacagaaaaactctgcatttgacctaggatatatgaattcttcaaataataaatatatcaaatatattctgagtttgaaatagtctttaccttgagccaccaaaaaggaaaagaaaatagaatcaagattacttgttaattttcaattttggggtgaaaaaccttattaaacttctccagtaactaaatcacataaagttcttcagtacaagttagattgtggaaatagttcatgtagttattccacgtctccttctaacaaaatatcaacagttcaaatatccagtttccttttcatttatgcaccattgtagttgctaatataaatgttggatctttctgcctcccactcacacctccagcccctcccctgcccacgcacctgcactggctcacattggtgctctttttctgcgggctgcgctgagcagaaaaggtgaggctattcagggttctgtaatgctcaattccatgttccgtttcttttcctcagaaacagttgaaacctatctatggatgaaaaacgcttcataatccaaacattacttcaatcagatgtgaagagtgggtttgctgcactgtaacatgctattattgcttaggtttatttgacaaaagtgaacaaccacaactttcaggaaaaactttttttttttgaattttatgtgagttgtccttttggaaatagatagatgagagagagacagagggacaaataatctgtatgaattttggcttttctcttgagtataaatgtttatctttcccccttcaatgtaacttgcttggatgttcaagtgtggagtacatttcttttctaaaagacaacatatttttcaattttattcattgatttatcactcaaaacatgcacttgaaggtactcttagtactctccttcatggccagtttatctataccgttttttcagagtttcttgagacagcttgcttttttttgtttgtttgtgttttttgttttgaccgagtctccctctgtggcccaggctggagtgcagtgatcttggctcactgcaaactccgcctcccgggttcacactattctcctgcctcagcctcccgagtagctgggactacaggcgcccgccaccatgcctggctaattttttgtatttttagtagagatgggttttcaccgtgttagccaggatggtctcgatctcctgacctcgtgatccgcccgcctcggcctcccaaagtgctgggatgacaggcgtgagccaccgcgcccggcctgaggccgcttgcttttaaagagctctcgcaaacaggtagcataggtgactgccttttgacctaaaatgtgatattttagaatatgttactagaaatttgcaataatgttcttaaaattattaatcttattgatgtgtttctggagcccagtaccaaacactgatcctaaagattgaatttggaacgaggccaatttagtgtttccctaaactgttttgggtagaacgctaataataatgccatgtgcttttactagtatttcatagccaaatacatttggggattacagagttagcccactcgtagccgtcttgtggactgcacggagcctttactgtgcttgcatgcatcatgcacccacctctccgagagtggtgtcatatatgtccattgattggaatgagcaggttactcctgcttccctctgtagagcgcatcatgcagaattgtttgtgtgtgtgtgtgtctgtgtgtgtgtgtgtgtctataccactttggatatcactcagttaacagttattgtctaaatcattcttgtgataagaatgataatcttattatataaatgatagaactatacttgagaatacagcctgattgttttatctatccattttatcattaaaagtgaattgaaaactttactattatgaaccctgtcgtttcctattgaggttctttaacactagaacctgcagaattagccatactttgacattaaaactattacattgccatcctctctttttccctggtgaatatttaggtgcactttgagatctggtattgctctagtggtgtgcctatttttttttaatattttcatttttgtttaatctacagagaagttccgagatcctccagagctctgatgggaagaattgtatagcgtgtcccctgccaaaagttctaataaaaaatttacacagcggaggctttgattaaatgaattattcattgacaactatccatcagggaattagaagtttatggcaacatgagctgtggaaaatagaaagaaaaattacccattactaactttttaaatgagaaagtcagaaactcagattgaatgtgaatttaaccctgcacatggaaagacactatgcaaaatattgagaggagttacataacctttatgcaatttattacttaataagcacataattggctgctaattaacagttgtagcatctttctttcttgtctttcctctcgttaagcgtaatattatgtgtagaactagcatagtgtggtttctgactttaacattcttctgtaagatcacttgtgttcagcacctcgcacagggttctattcacagaatagaatcctattttgttttcttttatattagaaatagtccatggcatcttgacaaggtgttatgaaccagagaggaaaggtcaatgatttaaaccagctttaggagaagcatatatagaagttgtttctcggctttctggaatgaattttaacagccacctataattgaaagcatttcatgcagggcatttcacaaaatggacattcaaaaactacaggttgacctgtactgaagacgtgaaattgctttgtgcctttgagaagtactcttggataaaccatgccattgtctatattgagttccctgattaaataatagtctctctctatctctttatctctctctagctagccatccatctatatatataacacatgcacatactcaaataaatatttacataacgaatctatcgatgtatattagtaagtactatgcattcagcacatgattagggtgcataatctcatatgcacgttgcaaaaatctttgaggggtagtatcattagtaatatttcatatatgacaaaactgaggtttaaagagtttaagggacttttccaagttcacatactaagagaaacagttactatataagtcacgttagccgcaaaggcaagcctttcttctttttttggatattatataaaaattatatagaaaagtttctttttaaacctaagccatgggaacaattcttcagttttcattttattctagtaaatttcttttcttttcttttttttttttttttgagacggagtctcgctctgtcgcccaggctggggcgcagtggcctgatctcggctcactgcaagctctgcctcccgggttcacaccattctcctgcctcagcctcccgagtagctgggactacaggcacctgccaccacgcccggctaatttttttgtattttttggtggagacggggtttcaccgtgttagccaggatggtctctatctcctgacctcgtgatccgcccgcctcggcctcccaaagtgctgggattacgggcgtgagccaccgcgcccggcctattctagcatatttcaactcttggtggcagaaacatctttcttaaatttcacccagaagtgaattacatgcccaccctttctttttccggatggatatgtggagagaacaattatagttctactttgctcttggctgtaggtatagttgttaataattagaaaacactcgaatggcaggttgccaattagagaggggagtataaagatacacagaacccgggcaattcaaatttgggacaatcgcctttaaagacattgagagttcactaaggttgctgatgaatcctgtcacttgtatcagtcaaaaggataatttgtaaatagcctgtagagaatcaaaggccagaatatactctcttttctgacaagcagaaaacacattatatgggctaattttccctgcatttttatcttaaaaaaaggagatgggtttctaattctgcaagcaaatatatattttttctaaatgtgagctatttcgaaaaacctaaaaccactcatcctagagcaagaacagggctaggttgagtgtccaagagaagactgtcacaggacctggcacattagtgagaaaggtgacattactccaggggaacttaatgatgccatttatttcttgatgctctgaggtacagcccccatttagacagattactctgagaattttgtaagatatccaatgagatacaatcatctttattggtggcactgtaaaggcaagtatgagagattttggcaagatcatctttttttagagacacatttatcatattcctttttaccttctttattaagtaggtactaatactatttctgattcactgctctctactccaaggattgcactaataggaaaattttcataaagcttttggctaagaactcctgctattgacctatgcccctttgtgtctaggttgatccagaagatacttcagcataaaaataaattccaacaaaatttagtttcaaattataaaagttgatatttctgctttatttgtccaaaagaggttctaaaatgaaattttctcaatttcaggtccattaaaaagtctgaatcttataaatatgcatagcttttataatacttataacttagatattaagaaaaatcaagatgtacattattaaagaaataacatttccattgttttcctttctcagaagtgggataaacaagcactgtaaactgaaataagcaatgcattctcagttccctcccaaaagaaaatactggtgtgcctgacttaccatttcagaaagtccagaaaacgctgcaaactaggcaggcagtcaagtgcaatggcaatgaataaccttataaaatttccagactttaagactgtcagtctggaagactacactatcttttagcacaaggtacttttggagattactctagggatcttagagaataattatacttaagtcctgccagggcctttttttttttttttttttttttttttttttactgtagtcaatagtacttccattgtactccttacatgacattatgttacagaagaaaatgttttataacaatgtcatttgagtgcttcagttgttacctctccttgaatacatatgaaagaataattacctttgtagtaaaggacattctagttatacatctatactttattggtttcttcatgtttttctcttcagaagtagaaacttaatgaaaatattgcgtaagtagagagcagtttatgacagtatttctttctaaataaattaaagattttattatatcttgaaatatatcacatatgtaaaatattaagtataatgtttgtgatcattttgaaacacagacttttaaactttaataaattatatccaagtaacattttaaatttgttatctaacttctactgttaacatctgaaaaaaattagaattggcagacatgcaagatgatgttgactttgcagccagaaaatgtggaaaggcctcaattagtatccctgattcacacttacaaatgggtgtttcagtgctgtgcagtttgataaggtagttaaggccatagtttgggagacagataggcatggattccagtcctggctcaggcatttctacttacgctattcgggcatgtcagtttttctttctaaggctcatttccctgtgtgtccatgaggaaataatgtgtttccttggtagaaagatggttgtgagggttcagtgcaatcatgcatatgcatagtaagtattccatatatctcaatatcatgatttatttcttgctacacaaacttacagtctactcactacctttgatgtaaagctgtcccactgtccttctgtgctttttctagaggttgagctcttccttcatttctggaatagttactgatttcaccagtaatttgccttttagatccgttgttacaggtgcctttttgaatctgactgctcaaaagctttgtccattttgtgttgctataaaggcatacatgaggctgagtaatttatgaagaaaggttttggtgctcatggtcctgcagactgtacaagaagcacggtgccaacatctgcttggcttctggtgagggcctcaggctgcttctacttatggtggaaggcaaaggggagctgactatgcagagatcacatggggagagaggaaacacatgggggcaggtgggtgatatgccaggctatttttaacaaacacttccctgggaactagtagggtgagaattcagttgccccaagggaggacattaagctattcataaggaatccgtccccatgaccaaaacacctcccactaggccccacctccaatattggggtcaaatttcaacttgaagttggaggagacaaacatccaaactatagcagaagcctttttttgttttttaaagctttagctttacctgccatatataatagttcaagcataaaattcaatgtcttttagcttttttagagttgtgctgccatcaccataatgaaactatgagacctttcaaagagaagacaggtgtaaacttgtgttatctttgattaggttatgatttattagatttgacaccaaaagcgcaagcaatgaaagagaaaaattcaagttagacttcaccaaaattaacagctgatatgcctttaggaagcatgtaaactcagaagccattcttacatgactggctcatggacatcattgatttgaccagaaatggacattaaaaccatgggaggctgatgcagtctctcatgtatgaatttgaaatagacacaagggaacaccatgaagagaatctctgtggaccttaacattttcaaattttagaaaacaacattttactatgtggaatggacagggagagtgtcaatgagaaaaacaggaggaggaggaaatgaagagagtttggcttaaaatgttaccactcaaaatgcctagcatgaattggggcaggtccatgaactgcttgttattggtctctacccaataagaagctggctccagaatgcagttcagttgacattttcttttgtaagaaagattttctcaattaaaaaaaatcaccgtgttgatttgcgtttgatagaatcttgtcatcagacaccagaattttgggtagcatttttcttttttttcttttatcttttttctttctttctttctttttttcttcttctttttttttttttttttttttttttttggagacaggatttctgtcgcccaggctggagtgcagtggtgcaatcttggctcactgcaacttctgcctccttgctttaagcgattcttatgtctcagcctcccaagtagctggaattatagatgcagggcaccacgcccagctaatttttctatttttagtagcgacagggtttcaccatgttgaccaggctggtcttgaactcctgatctcaggtgatccacccactttggcctcccaaattgggtagcatttttctagaatattgacactttaagctttcttatgatactcacttttttctttcctacactgttatgcccagtgggagaaggttgcttctcttaatagttctcagtaaatgctgattaaataaactgtagaagggtaaatagttaacaagattctgaatttggacttgtgatttttgaggcaaaaataataggttgaaagacatgttttttggatcaacaggcttgtatggaggtagacatttataatcttagtcatactagtgagtgatggacattttattactgttttgcaaaggtatggacaaagtcttaagatctatgtcttctacttttaggcatgtaggtaaaaatgtcagtaacaatgcagaaagccagtttatctatttaaaaaatgaatatattggaagccttgaatatgaggctgagtaatgcaagcttttcccaggagaactgtgacttcttgaggcccaaagctgcactccggaattataagtcctgagacatagtctataaacaataagtaaatatcagtcctatagctcagtgttcaccactgatgacttctcacacataagcaatatcatgttaagcagatagatactcatagtcatccaatagtttgcagtgggaaaatagtttgctaaaaagcaagatgtcatatgtgttgttatatttttcacacatgttgagaaattatctctgttgaagatttcttgagttaaccttggggcattagcctttgctgcaaggtttgaaaaactcaatttttcccattcagtgtgatctattacaagctattctgcttcctgaatttttgagagtattgctagttattttattctcagttacctaagaagggtcatatgagggaatgttttgattatcctaaattcgtttctatggataacttcatatctttgttcagatctgatttcttccatagtcacttaaacttgagaattctatcctatcttccacaaaagctatcattgaaatagctgtgctttccacttaaaaagtgaaaaggttaatggtatggagatgaaactggaatccaatcctcataaacagtactgtcttttccatttttatgttgcctttttggtcacctagaccatacacaagagattttatttttctttttgtctgattgcttctaaacagatttctattacatctccaaatttcagtttctctcccactgttcactctaggataaagtggagttcttactttatttcaatagaagctagaaataggtaccttaatgaggcaactcttgattttatttcagaacttggtaaaacttcggcttttcatttcaaaaacaaaagtaagcctctgtgcttgctgatctgtgttccgaagacttattctccctgtgcacccactatttctactagctagaagtaaggcagaattcccgtagagtaattgtgtttcagttgtatttcagacaccacagacatgaaagcttcacagaaaaggttgcttcttcctcagtggagctcatttggtaatagatgccaggtgcatgactgatgctggtttgaaatggaggacccagtaatggctatatcgcttggtgaaatcgcatgagctcaccagaattagaatatgcccgtaggagtaaacataacttctcatttttgaaaaattcgtaacttctcacaacttttgttgttctcattgctattgatattgttttaataatattcatctctatcagtgcccagcaagaaaatatatgcaacaaatattagttgaatgaatgttttaatccacacagtaagagccataggatataaatatacatgatcaatattccactgcagaaaccactggatatcttaaaacattataaagttacgtgcagaaaactattgctgtgctttatgattttaaaagtaaggtgtatttataataaaatatttaaaaatactgagaaattttagaaattttaaaatagtgacccaagaataatctttagttttagtattaatttttacatatgtacttaaaaattactgttgttgttattattattacatttgtaaaatgcaattggagtatattcattactttaaggtaggagtggggaagtggtttacttgagaaaaatgacatctagttttgtactttttctcacgctaagaagtacgtagaaacaagcaatcaactgaataactttagtgtttatttttaaaagtgatatatatcccaacaacttgtaacttattctttaaataacagaatttaagaaaatgaacaatattagataatattacataatagttatgtctcacttttagtatttttgtctttctacatgtatgaattttataattaactattacaatttttagacttccaaactaattttcatgattttggttatctgtattggggtacaatttacatacaataaaattcaccaattttacatataaaatttgattagttttggaaaatgtgtggtatttgcccctggttttctgaaaatagaattaaaaacccatcaaatcttttatcccccttcatctcacttccagtagagatatacttcttacattttatacttataatgtcttacctatagaaactgatagaatagggcctttcacaatactaattatttcatttggtgtttacagccaagcagttttgctcctcagaggatcttaactgggaactaaccctcatctgtaactatagtttctcacaccatcaaactttacttaaaatgtgccagagcctagttaaatgtcaaagaagaggcctggtagcctttgtttggaaatagaagacagtatctactttgaagttattgtttctaaccaatagcatcctcggattttaacatttttgttttattttgtttcagtctcactgacaaaatacctttcccattttgtgccttaatttccggtttgaatagcaatatcttagctcaatctttaaaaataagcactgtttttgtcccttttactgactgtttgctttttttaaaaaaagtccaaattagtttcaagatcaaacttctatgtatatttagaatctagccttgaatatttcctaatttatactgaattccatttatgtatcattcttggattagattttctaatctggccatgtttttttctttcagacctgttactagctcactcttttctattcaaatcttatttctcatcctggcctatttcccaagtgcaaagacagcggggcttcctgtgtcttagggctgcccagagctgatgcatatcactcaattacggtattataaataatatttttagaagtatataataaaaatattaccaccttaacagcttaaacctgaatttgtaatcaggttagaattaatccatgaaaaactttgtgatatagagcattgtgtttttctatgcacaactttgttgaaattctagcacttgggaaatgatgtctactcaagatttacattggctaattcttctcatactaattatttttactatgttgattatttattgttttatattggttgatggtttttcttgaatgctcaaataagcagccattcttgataactattgcttatctcagatgtgaagtatataataacattttattactggttttggttattggagtttattttaactaggattttactcttagttcagtttttaattcagtctgaaaggtattattaccaggtaggggagaggtcaaataacgaacattattttccaatcattctggcaatctttaaaaatgtggttccctgagtatgtatgtagtcatgtaccacgtaacagtgtttcggtcagtgatggactacatatatgacagtggttcaatgagattttattaccatacttttactgtacctttttacatttaggtacaaaagtacttaccaagtgttacaactgcctgtagtatttagtacagtaacattcacagatttgtggtctaggagcaataggctagactgtatggctcaggtgtgtaatatgctataccatctagatttgtgtaagtgtactctatgatgtttgcacaatgacaacatagcctaacgatggacttctcagagtgtatcccggtccttcagcaatatataactatacatatgatactgggttgtgatcatttcccagttacaaacaaattagctatcaattttctccataatatcaaactcttatgtgattctaagtaagtaattggcagaaaggagaattcacattagtttactgaaaaaaacacagtgtagttttatgaaatcttgcctgttagtgatataccctattcgcttttgttgacaaaatgcaaattacttctttaatattactcttctccataacattctgatttgtttaaccttgtcatgtttctgttaaaccagttcaacagaaagggctcatccacttataaataatgcattatctttcaaaagccctagtaattttttgcttataatctctgggtagcttcagtaagtcaaaacatgacttcatattctaacttgtcaaacttttaagcatcaagcaatttttcctgcacttttaattaactgcacaaaatattatctgtaatgaatagatatgttaacaagttatgttagaacaggacaagactagcttttggctcagtggggtagaaaaaagtaaatatattcttattgctgttgttaggaggtagctatgttagaatgttgctatggaagagagatgctactgaattgggtgcagtgaggggaaaacatgggagttaaaacatgtgggttatacacctatgtatctaggataccatgcagaagaggttggaattagactgatggttaatcaatgggataaagggatgtgttttcagtccttgtcagatgaatttctactttatcctctggattattggcccttattcttctttcccttagaacttatcattcttcaaaattacaattatttctgtaatcatatcaaattatcagcttcttaatgatgtttcttacccactgtgttttagcatctaagatatggatgtgtagctaattgtcataatagctaactagcattcattgcacgttcatataatgtccagctctttgttaagggctgaaagctcattatctattttaggccccacaacactctgaagttggtattcttaggaattctgtgaatgagaaagctaagacttcaggaatttagtgataaatttaggtaaaagttagagcaggcccaggacctacgtctctctacagtgacatacatgccctgaactgctactccctctctttctcacattacctaggcagcttttattgtgctttgttatctttaaaatagcgaattaacacttgctatttcataagcttaaagatgcattgcctgtaatattggaagctgatatgcagctcaccacatatccaaaggccggtaataatgaacgtaaaatagggaagaaaagacagagtatactgggatggatcattatctctacatgttgatttattttaaaagttcctttcagtgtatattaacaccttggaatgtgtgcaagttacaccggtgacctttctgcatagaactccaatgagagaaaaggcaacccattgttagatgaaatgcttttcatttcaagcatgtaagcagtaccacacttggtggattaaagatcgattgatctcagcaagcaaagaacgttgttaaattgttcagtcctcctttctggctttctctttttgctaagaatggaaaaagagaaggccttggtctctgttgtctcagattcttgtacctagggctataattgctgcagataaaacccaagaacaattgggttgtggttttcaagtttaattacattagagctgcttcttttgccctatagtcacatttgcaatttgtgattaacatattagtgggaagaaagtaatgatagattgtagttaatgaagcattttctctatctgttgtttcttcaatgcctctttcccgctacaggataagatatttatgttaatttttatgcatgctgtagttaggtttctatatattatgtagggaaagttctgcattagctctaataaataaagtgttcagttttaaatcatggtctttgctctactttatttatttgtatttactctttttcattactgcaggaggaaacagactcagtgttttatttttataataaaatactcttactctaagaaagagttattatgcatcctaatactggtatgcaaacatcattaaagtttacacagcaatggtttttaataacatttggagatattttggctgatgcagtttttgtgctaatattttggcttcaagataagaaaaactggatttaatccttgctagaatgctgggaaaaactgatgttatttgtaaatgaagatttaaaagcatttaactaagcttcgttttaagatatacatgtagagccacatctttttttttactttggaattttaaaatatgatttatcttcctttgtcaggtagactccagagtttaaagtgaaatatatatatgtaatatatatataatatatatatattacatatataatatatatatataatatatatatatataaaatatatacagaaggctgagaatcaaaccagtattgaagcattcttaccaatggcaactgggatagtgtttgagaatgagattgtggggtgtgtgtcgaggaaggaggtaagggtgtggattaaaagttttggaggtgagatgatagacaaggaagaaaattttattgttatatctttccttattgaaattgctcattagtttgaatccttccactgttgtctggactccccattaaaaaagaacatgatcactgagaaagtgtctaatttagatgtgcttttgatagcaaaataattataatagacaaatccttgaaaaggaatttccttgtcacatgacactgatatactacaaaacagttgtgccatggcagcttataatatttaagtttcctgattctaggtacaaagatctctctgtgaaagctggccaaatattcaagaatgtactgaaatattcaaaaggtgtacatttatgatctagaataattgataagagttgaataattggattgcttcactagggaaaggcagaaaatgtatgactgtagagttaacattcttgagattattaaggaaatgataaagataacaatggagaattcctttcagtgtactaaaagttagggaagcagtggaggcttttgctgaaatttgaaagagacaaatattgaggcaagtgaaaagtaatagtcgagtcatttgagatatgtgcattttactctgtcagttttattttatttttaattaattttttaaaatttcagtagcttgaggggtacaagtcgtgctgggttatgtggatgatcgtacagtggtcaagttttggcttttagtgtgcccaacaccaaaatagtgaacattgtattcaataggtaatttttcatccctcacctccctcctgaacttctttcctctgagtctctaatgttcattatactactatgtctgcctttgtgtacccatagcttagctcccatttataagtgagaatgtgcagtattggttttccattcttgagttacttcacttaggataatggcctccagttctactcaagttgcggcaaaagacattattccactcatttttatggctgagtagttttccataatgtttccgtggactcatttgtcagtacccaaatcagtagcattgctgtgcaccaacaatgaccaagctgataatcaaagaactcaatcccttttacaatcgctacaaaaataaactaaaatacctagggacatacttgaccaaggaggtgagggatctctacaagaagaactacaaaacactgatgaaagaaatcatagactattcctttccatggaatgataaggaaatggtatttccattttatttatccacttatctattgataggcacttggattggttctatatctttgcaattgtgaattaggctgtgataaaaatacacgtgcaagtgtctttttggtataatgactatttttcctttgggtagatatttggtagtgagattgctggatcaaatggtagttctacttttagttctttgagaaatctccatactgttttctatagatgtttcactaacttatatttccaccagcagtaggtaagtgttccctttctacgacatctgcaccaacatttactgttttttaatttaaattttttttttcataatgaccattctggctggagtaaggtggtatcttgttgtggttttaatttgcatttccctgatgattagtgatgttgaacattttttttctgtgtttcttggccatttgtataacttcttttgagaaatatctgttcatatgattatctcaatagactcttctgagtctattcaataaaattcaataaaatccaacatctctttatgataaaaaccctcaacctggtcaggcgtggtggctcacacctgtaatcccagcactttgggaggccagcgtgggtggatcacttgaggtcaggagtttgagactagcctggccaacatagtgaaacgctatctctatttaaaaaaatataaaaattagccaggcctggttgggggggagcctgtaatcccagctactcgggaggctgaggtaggagaattgcttggacccaggaaacgaggttgcagtgagctgagatcatgccactgcactccatccttagtgacaaagcaagactgcctcaaaacaaaaagaaaagaaaagaaagaaaagaaacaaacaaccgtcaaccaactaggtatagaagaaacatacctcaaagtaataaaaaccacatatgacaaaggcacagccaatataatactgaatggggaaaagttgaaagcattcctcttaagaactggactaagacaaggatgctctctttccctacttctattcaacacagtactggaagtcctagacagagcaatcatgcaagagaaggaaataaaggacatccatattggaaaagaggaaattaaactatctctgtttgccagtgatatgatcttgtacccagaaaaccctaaagattcccccaaaacactcccggatttgatcagtgaattcagtaaaggctcgggttacaaaatctatgtgaagaaatcagtagcgctgctatgatacaatgaccaaactgagaataaaatcaagaactcaaccgcttttataataactggaaaaaaatgaaatacctaggaatatgcttaactaaggaggtgaatgatctccacaaggaaaactacaaaacgctgatgaaagctgacacaaacaaatggacaaacagacaacacaaacaatgggaaaagcatcccatgctcatgcattggaagaatcaatattgtgaaaatggccatactgtccaaagcaatctactttggacaaagattcagtgtgattcttatcaaaatgccaatgccatttttcacagaattagaaaaaacaagcctaaaattcataagaaaccaaaaaaaaaaaaaaaaaaaggaagaaaagaaaagaaaaaagagcctaaatagccaaagcaattccaagaaaaagagcaaagctggaggcatcacattaactcatttccaattgtactaccagactatagtaaccaaaatagcatagtactggtataaaagtagacacgaagaccaatgaagcagaatagagaacccagacataaagccagatacttacaaccaattaattttcaacaaagcagacaaaaatatccactggggaaaggacaccctattcaatacttggttctgggaacactggatagccacaggtggaagaacaaaactagatccctatctctcaccatattcacattaacccaagatggattaaagacgtaaacctaagacctgaaaccttacaaattctagaataaaacctaggagaaacttttctggacattggcctaggcaaagaatttatgcctgagaccccaaaagcaaatgcaacaaaaataaacataagtaaatgggacctaattaactaaaaaacttctgcacagcaaaagaaataatcaaaagagtaaacagacaacctacagaatgggagaaaacgtttgcaaactatacatccaacaaaggactaatatctagaatctacaaggaattcaaacaaataaacaaggaaaagaggccaaataattttattaaaagcaggcaagtgatatgtaaattgtatttttaaaattataacaaaagagtgaaatctagtaaatgttatacctcttggtgtttaggagtgaagtgtactgaggtcttgaaatgcatccaaaattataagttagctttcaatgttcaagttaccttgaaatgtgtccaaaattaagatggattaattgacgggtggattaatggatgatagaggtatacatatgtggataaataggcaggtggatatgtgattaagcaaatataacaaaatattgattctagaatctaacactaggaacatggctgttcactgtgcacttctctcaactttcctttatatttgaacattttcataatgaaatgttctttaaaaaaggaaagctacctgagacaaggtgagaaaattcttaatgcctattcaggtaatactagctgaaaaattgaaaataaactttaagtggagatgattgtcttaatcccaaagtattgctgacacgggatttgttagcatgtctctaaggtgatgcaccatatattttggggaaaagcatttcattttccctgtaaatcatggtgcatcaataatcatgcacttgcaacaagattgtctctgacttctctaacactctagcattgcttatgaaggacattcttctatttggccaacaaagaatatttctgtcttatcttaaaacagagataaggcaaatcattttgacagtctctgaggcaaggtaatccctgctaatctactcatctttctacctcttacatacaaagaatgggctagagtttgtcatgggaccacaggaatcaggctttgtccctgagtttattatttttctgaggcagggtctcgctctgttgcccaggctggagtgcaatagtgtgatcacagctcactgcagcctcgacctcctagactcaagagcttctttcatctaagcctccagggtagctgggattacaggtatgtgccgccatgcctggccaattttttattttttgtagagacagagatctccctgtgtttcccaggctgatcttgagctcctgtgctcaagcaattctcctgccttgacctcccaaagtgctcagattactggtgtgagccatggcatcccacctctgcttcattctaacataccacttcttccctgtttcccggactaaatactcaaggtcattaatagaacattattaaatttgaagacataaaaattctaactttaagctttactaaccaacataacatattgaattttccccaccacaaatttccaatagctggtaaattaatggtgtgttttgtctttcatctttaaatattgaatgaagcacagttctgctagatactcatatcacaatacatgtcttcagaaacaatttatatgcccagtgtatcaatatttaatttatttacacatttttttcatcactacctttatttgaatgatggatgtgttgatgcctaagcccatttatcactaagaatgaaataactaccactgggaaacttttgggaattatatatccatgagcttttcagaactgatcttttgtgacgatggaatggtcactgaccagatccttattgtagactcattacttttgaacacattcatcaataccaaggctcgggtggctgctggatgtcacagatccatagcactgtgccaccacgtgctccctaaaaatctattacatggtttagactatgttttcccaagcttaaacctaggaaaattgattgcctttcccataagtttacataatcagagaaacccagaactggaaagtattttaagcattcattcaggtcaaacatttgtgttctaatagaactttcttaaaatatccaatacaggcaacagcaggtcttattctaaaatatttctggaaaaaaattattccatttagataatgccatgtatgtatccagtccttcactatgtgcagtggtaactagtctaattttaattactgctctttaagccagtattcacctaaacttcataggaatgaatcccttcagtaacatccttatagtagacttcatatatttgtaaagctacataactacatataaaaccaattatgttttttcctagtcatttttatttataatgcatagtctaaactcttttgattttattttagaacagcattatttaaactttcttgctaaatagtaccagagaagcctagaaactcaagaaaaactacttttgaaatattcttgggatctaaatttttgtctttaaaacatgccacataaccttttctcatgtctccatactgaatcaatgcttaccttaaaacaccatattttaacttatgcattagatagaacacttccacacatcaaatgttcaggtaaaatagattatctgtgaacagacttggaatttattctgctgcttgccaaatccttgccatgctgctgtttcctccaatgtggtatgtgtttaaatctggggagcatactctcagtacatcacaagtatagcctattattattgttgttgttattgatgatgctattggtttaccaaaaataatttcctgtgatactaagcacatggctatccaattgaaacacttaacttttactgaggatctgagcattgtcccatggcatattaggatgtgttactgctaaatacccttctgaagatggtgaccgaatccttgaaatgtgtctgttgtggcagtttgaaagacaagtgaacgccaaggtcaggctatcactcagtgaagccaactggctggctgcccacgtttctcataacatttcatttattttgatggattcaccaaggtatgagccctggcactcaggtttggggcacagaaactttgatgtttataagcacattaaatggttccatctctagggtacagattcacattaaccaagggcacaaagactagcaagtaagccacagtgccaaaggataaattgataaagaaaagaaaaatggccttgcagctggcaggatgcgggtcagtgcggtcaggcccttctgtccctgttggcaggtatttcagaaaagctaaatgaacatccagaagttgctgagtgagtgaacatgaaatcaggaaagaaaaaatcagttttatgattaaggtatttagtagtatgaaccgaatgtttccttatccattcatttcttcatagagactcacatatcatggaaatcagagtgggcaagagttgggagggcaatgatggtatttacaccttccaattgttgcacagcttctatagatgtattcagttaaccgtgacgtaggcagtgcctttctctgtagtctgggaacagttctttttcttatgattcaactctgagaaggcagtgctttctttttttcactattacaccatcatgtggtgtaggtgagcttctggaaagggaagaataaaagaaattatgttaactgttcagaaactgtgtgatttagtaacatagagcttcgttacagtaatgtaccctgtaagtggaaagacaggcagtatgggtattacgaaatgatttttttttaatggaagagaatgatggagaaagagacaaaggaaagttatgttagagtcataaaccctgcatgatcctgtaaaaattcatgcttgatccctgcagcctgaatcaacatggacatcagtaaatctctactcttgccgaagaaacaaactaaggctataaagaagtactttgtttttgatactcattgtcttccctgacagccaagtcaaaagatggagataaacaatgagcgattttctaacatgaaaaacaagacaagaaatatctttcttataaaggaatccactcagtctgttagtgtatatactttgccagtcattcctacctgattcaatgaatatttattgattaaagatctagtcttgtgaaagagacacttgaaactggacaaacagatgtagtttgttaagtgctaccagagggataagccaaatgccatgagcagactagggagggatgccttgggagcctcattgaatcattctgaagaagtttgaaaggcagtcatggtgtgggtgggcatgcatttaactagtaggttgacctaggagggaaatatgcttctgcttttagagattaatgaatgtatttatcaaatgtgtattgaaattctaatgcatatcaggcttcgttaacactatggatacactgagcaaaagaaatgagattcagctcacgtacacaagtaggtaaatttttgttttttgtttttgtttttttttggattagcttttgtaaatttacatctagaagtactggtattgttttgtactctctctttcttttgttttttgctttttggggggaaggggacttccaaaatggtattatgacttttcttctttgaaaaagagttcttaaatttatcttcaaaaatctcttgaaaactagaacaaaatgaaaaatgactaggactgcattgttaaccttatcaattgtgactatcaatatggaatccttacacctatgtagtttatgaaggcaaagcctacagttagtttgagacaactattaagcctgaccaaattctcagaatgcttttatgatgctaataagtatcactacaaaatgaattgatgtttctcatgcagccaaagtggcaatgattttacaggagggagaggcatgaggttggttatctcttcctggcagatgggctgtccctccccaacccctcctcccgacacagacacaggttggtaggattttttctacctacaggttggtaggattctctgggagaatgaaaatatttttaaaaagcaaaacaaaggaaaactcttaatttatatttaaattacccataatcgaatgattcacgcaaaatgaacttttagagcaaacgtcttttcaaattgtatgagggatggcttatttttaactaacggtactgacaggacattctggggactgctgcagatactggctgctctattcacaaagactagggggaagaaaaggctgtcttcagtaatgaatggaaacactgactggctttgaggcgagtaattgccttactcacccacacaaaaatttcagccagaaaagtcctcctttaagcagagcacaaatgatgtgaaatgcatacttgcacagatatagtataacttaccttgagtttatttaattattcctggtccatgggatttttgaaaaattgccagaatactacttttctgcagatataaataaaaggtccaaatgttgcttaacttcttttttcctgaattgcatagtatatatgtgttagaaatggctaataaccgtcacagagtagttgagaagttaaaacacacacaaattcttaatatttctaattaaaagcagcataggaatattgattactacagtggaaatgtaatgtgttctttctttcctttttaaatgcctatatggtacttattaacacttttaatggcaaaagcaataaaaataattaaaagcacatttagttcctgttctgcctcatttcattaatttctgcttttttttcttttggagaaaaagttgtaaaattgatgtcttagctgtagctgcctctttatgatattagatttctgtatgtaaagaaggtattagaaaaattttctcctgcactcaaggaatctttaaacttaaaataaaaagtgattataccttctattttcaaggcagaataaaaatgttttacaatgaatagaattcttgattttcaaagaagtttattacatttgattttgtcagagttaataagtgataataaataaatgtgtggaaaaataaacttttgaactagatcaaatgtgtttgtttctatttcagtattggctttgatgcctaagaaagcaaaatatttatctactgaaagagcttatgtctttgtggcccccagcttttcctctggtgagccttaggaaaaatggcacttgctctggaggcagggaggaaactccagatcagacccaggtttctggcttgggaggtggtggtggtggtgaaggaagtgcagttggttaagataaggagatgaggtgaattgccaaattttcacccagatgctcggcggcctctaaaggtcggtggtgttaccaggcgcaaattagtaatgctggctttgaacttaccttgaagctgcagtgccacttgttcttttcatgcagtcgtatttcgccaatggctttttactattttcttaacctatgtttggcatcttacctgactcctgggcaattacaacctttaaccactagaaaaggaagtacattaaacacaccttgttcatcttgaagagagagcaggggaatgggggtttcctcagcctgggatgactttcttctgcctttcagatctaagctctttctgacctggatcttatttaactgggaaacggccaggatagatttgatctttagcgtttctaacaaacatcatcagggatctctctttcctgaatcctatcacatttagcatcttgcaccacagtgctgagtatttttaaaaatataattttctcttttgttcttctgatgtttaatacattattcatcttcccaaatagattctcatttatctgggtgcaataagttcatctagagtccttccttacctactttccttcctttcttctttcatgcattccttcttccctccattagtaataggctgactctatactaagacttcaaaaatgtgcatgttctttaagagtttacagatgttctaaaactgactgtttcagaggaactactttccttgactcaataatagttaatcctcaagaacgattatgtatagtttttttaattcttcaactttgtgagatgtggttataaaacttaaattgatatagatgaaacagtttataaatagttttcacttgcattatttcttggaaagctcgtaaatactgtatgcaagtatcccctccattttctatgtgagcagcatgagcctgtattatatctacgaagtaaatgagtgggggtaggttttgtgacatgctggctgcatcagataatgctgcatggcataagctgggcacacactgctgttcctgttttatgcctaggaagatgaaagccttatcttaaatcataaaagtaattattaatgggcagcccaggtgggcagaccaggctgccaagtttactattttctatcgctctacaatgaatattccacattaggtatagattatctgttgtcaagagagttttatatcacactttgatataaaattaagtgtaaaaagctattgagaatcaatatttgacattctaaaagtaacttcaagatgataaagaataaatattatactaagcccaaaaatagtttctgggtttgttatattcatctgtttaataaatataagtggatgcgtggtgcaccaagaacttagcttggcattgaaaatgcaatgagaagtaactatgttctctactctccttgtggacaagagtctagtctgttaactagaaactacttctagatgattgggctgcaaatatgatccttctgctatgttttgcctagaactttaggcagaactttagttctaggcagaatgtagcagaagattatatatgcagcctgctcatcccctgaaatcaagcttaaagatgatggtctgccttgttagtaatccgtagaggcttatcaatcccagaaattttgggctattgttccagtctgtagatcactgacattcttttagtgctctttcaaccacaatttatagttcccaggatgggtcaacaactgtactcctgggatgtcttttctctctgtgtttgagatgcagatagctagttatccgccagtcctcacaatgctgaaatgcatccctcaagattaaagattctattcctaactttaaggaataaatctgagcttagtgcttcagtccaaatattttgtgaatacttagtatgtgctttactaggtgttatggatacagaaatgagtgtgaaatagtctctgacctggtagaactcaatttagacttaaacataatttggaaaataacacgtatggaggaagattcataagcctgatcatgtgtgttaggcataactagttaggcttataattatgcttaaatggattagatcaaccgtgtatgtaacagagctagtaaatagataattagatattaaaatgcaggtgtactgattccgaagccactaactcgtaatgcatctaccaaattcctctgagtgtaagattgttcattttagcagtttcagaactgtgtcactccaggacttaatctgtatggtaggggttctccaatttgagtgtgcacaggaatcatctggagagcttggtacaacaaagattgctcagtccttccctccccaggaactcactaggtctgagctggggatgaataatttgcatttatataaactcaggggtgaagctgaccatattttgagtagcactgaccttggggactgtttcccagacttcagcacatagtagagccatctggagagcctgttaaaagtggctgttaggacttccctggccctggagattcagaagggctgtgatggggctgaataatttttattttcaacaagctttcagatgatgctgatcctactggtccatggactgcactgagctaaggcattgtctaaataggtagacagaagtaacctactaagaaactcaattttgaaaaatatgaaggcttgatcaaaatatgtactctccttagcatggagtcctttcatcagagaaatgggaaaaagtaaaagtaggaaactaaatggcatgaatctcatgggcaattttaagaagcagtaggcactctaaatagcaactgactttgatatgtatggaggatgttttacatatattgggagaagattgtctgtctgaataatgtaactgtagaaagacccttagctttgtgtctatttagaggtcaatttcagtttctatccctctttttaaaaatatcttgtccgtgtattctgttcctaacattaacatataaggttgatagaaaatatggataatataaaaagtggtattgaatgatatcactagaaatagtgttcatgtaaagaaaagatatgggccagcaccaagttctgggcaactccacaattttgagaaattggaagagtggctggcaaataacaaacaggaaagtatggtgtcacaggagccaagaaaatgttctcgtgggaggcttcagcagtgaaaggattggaatgctgataagaaatactgtaagatgatggaagaattggctgtctaacttggctccatggagatcacgatatttctcattggaatgttttgctcaaccctaattgtccttctttgcagaatgaaagtcttgtgggaaaatagagattaaaatataactaattctgtctataaattatatagacatatataagaaatatataaattcaatctataaaatagaactaatgtgtttgtgtgcatgcaacatttttccgtgaaatatagttttgcttctgtatttttctgttcttattcatgccacacattattcattagcacagatttatattccattttgataactgatatccacagatattgttttcaaaattattattttatatgattatttttccatctaaattttaaaatcactttatcaattaagaaaaaagttttatttggattttcactggaattactttaaatttgcagattaatctaggaagaagggacatctttaccacattgaattttccttaacagggatttgaagattctctacatccttcaagtggtcctataaattctctaataacattttgtggttttccctctttgggcaataatactttctaaagacatttaatatattgttttgctattataaatgctgtttttatatgtttttattatagtactgttcattgacattaagtacatttgcgttgctgtgcaaccatcaccaccagccgtctctagaacttttttcatcttatcaaactgaaactgcataaccattaaaaagataacttcccattttttcctctcttcagcccctaacaactaccattctgccttctgtctctaagtatttgactactcgacgcacgtcgtttaagtggaatgatacagtatttgtccgtttgtgactggctttattccccttaacacagtgtttttaaagttcatctatgttgtagcaactgtcgggatttccttcattttcaaagctgcataatactcatacatacacacacaggcatacacacaacattttgttattcttttcatttaccaatgatcatctgggttgtttccaccttttggctattgtaaataatgcttctgtgaacagaggtgtacaaatatctgtttgcatcactgctttcaattgttttgggtatataaccagaagtggaattactattgattattaatgataatcctgttttactgttttgttagatatatcacaatatgaattcccagctacaattttggggtcattttaaatactctcagttttctcatgtaccattttcttgattttctttagtttgtcattacttttctttagctctcagagtgtatttaaggcagttgttttaaagtctttctctagtaaatctgaagccttgtttctttaaggttggtttccagagatttattttgatcttttgaaagggctggatttccctgtttctttatatgccttgtgatcttttgttgaaaattgggtgtctgaaaaatcagacacttcttccagtcactgtagactgtgtggaggaagatgttctctaaatagcccggtatgaaagtttaagattttctcaggcattttctaggtctgtgtcttccctgggcctgtgtgtgtggtgttctctcccaatttccccatagacggggctgcttttatttatttatttattttgaaggctgctttgaaatgttttattatccgtccctaagagtttcacccctgcttcttcgtgaaatcttggctgttcctctgtactactcttgccttaacaaacatcttgcccccagtttctgcatgtcagcatactcttgcagttttcacaaactatgttacccatcacagttttgcatggcttccaaactgagattcaaactatatattcattttcgtctgagagctccaattgaggcaagacagaaaccagtccctcaggcagcccacagacaggccagaactttgcaaaataagttccactgccctccttccttcctgagagaaaaatactggaaagtgggctacttttttttttttttttttttaactgcactcactgttccaaggtggcgcaagcacaagcaataatgccgtgaaatgtcctacctttttcactgtggctttttcttgatggggcattcacttggttggaaagcagtgaatttggctggttaccagagctcccaaaaagctgttttagtgagtcgctagtagtttacttgatgatcctgtggaggaatgaggacctggagctttctaatctgccatctttctgatatcaaatctgtttgtttgtattttgtcttttttagtagctttattgtagtttttaaccctaaatgtgtccagaatcacagttgcttagtcctgtcttagacctctaaatcgtgatgctaaaagtgtaaaactaacaccacacaatatattaaggatagctgtcatacttattttgtttctaatttactgttaattcatctaggagtgtgtatgagttcgttttgacattactataaataactatctgacactaggtaatttatgaagaaaagagtttaattgactcccagttccacaggcttaacaggaagtatgactggacggcctcagaaaacttaccatcatggtggaaggcaaaggggaagcaaatacatgttaccatggcggagcaggagagagagtgagtgaagggggaagtgccacacgcttttaaaccatcacgtcttgtgagaactcactcactatcatgagaagagcaagagggaaatctgccccccgtcatccaccaggccccttctccagttgatcccactaggccccttctccaccatgatattttggtagggccacaaatccaaaccatatccaagtgtgcaccaataatcgtaattattggggagtgataaatgtgaattgcaactcatataattgcgagttcttttataaacaaattaattgtaaaaaaacaaacccaagcttaggcaacatagcaagaccccatctctacacaaaatatatagaaaaaaagtagccaggtatagtggtacatttctgtggtcccagctacttgggaggctgaggtgggaggatcacatgagcccaggaggttgatactacagtgagccatgattgtgccagagcaggaccctatctcaaaaacaaaaacaagaaaaacaatcccggaacaaaataaataaaacaaacaaaaaagagcaacaaaagacacttgcttggcatttctaacaagcttccagctgatgttgatgcctttgtaccatagctcagattccagtatgatttagcatatttaaccttatgtaggtcaacagcataaacctataaagagtataattttgaaaaatgtgtaacttgtaataagttataaaaaaattactttactcagcatagagtcctctaatcatagaagaaggataaatgaggaaactgtgaatggcatgagagcaatgagcaattttaagaagcagtaggcggagtaagtattaagtgcaacttaaatataagaaataatctctatgattatattttctttattggtattcttaactgatgtcttgtaggaaaccatgactgtttctcctaatactagacaatagtccataatgtttgttatttatactaaactcttacattcaattgactaaagttgtctttagtataattacatttatttctttaaattgaatttgaattttctttttgtggtatttttttcagacatactattcagatgacacgaacttaataaaaatttagaatttttttctgccttcaatatgttataaaatattttaaatagtgcaaaagttatttgtttcttggaggcaaaaatcagattttgccttcttcttttggaaactccttgaaagttatctcagttccttttatgcttattaatctaatatagcttgtaaatgttgtcaattattttttccagaaggaaaagaaatgcacattttgtggacatttccaaatacctacatgtgtatttttatacacattctctacttttaaaaaaactcctctgattcctttttcattctagattttgtatagttacataatcccagcatatccagcaccttttttataggatgttgattgaatgtgcatagtgaatgttttatatcaatataagaaaattaataatttttttctttatttcccatagcaaaattttatgatttattcttttacctttattttttttaaccttgtattgtattattgcctagaaaattctttctcagactttatgctcactgggaacaggtcttattttaatttgtattcccagcttcatcttgtgtggtatcccaaaccttaacacactccagtacattttgttaaatggtaaatggtattatttaaggaaatttaaattgaatttctatatctcaaggcttttcaagccagagctggctaaacatttcttaggtgtgttgtaagagcatgtttctttaagatggagtttattccaggtatcttttaaagttttaactcttaaatgctgtttctttaatatcatgagacaatatagaaactcttaaaatattttaacttcctttaggatattttcggattattcagcataaatgtctttgaactatttcaaacctttccatatttgacattacttaccgttgaaaatataaacaccatcagtaaaataaaataactaaaagacagttcaaacttttgagctatttaacagaacgtgaactgatggaagaggagaccccattttttttttaattttgaggaactttattgaacttctttgagaaaacattaagattctatgtgaagatgtattgaagcaagtcaatatagggaagggataaaagaaagtgagtaaataagcttttgagtgattggtgtgattgggttaagaatgacgctaagaacgaacgtaaacagtgttcacactctagggctaaaaacccaagtacatcttttcacacggaaatacagatatttttaagaaccttccttgtgcttcttagaaagtagacaggtggttggagaaaatctatttttgttaaaacacacccacattcaatctagatgtataatttcaatatctcaatgatttttccttgtattttctctaaatgtcatgcttttcagactatttcaatatagatggattatatttcttttcagaatacatatggcagataaatacattgacgttttccaaaggaaagtacaaatggaatactatttcttaaaaaaacaaattttggtatcctttacttccttatgaagaaaagcaaatccgctggttaagattttttctttattttgccaaataaaatggtgtattacccttgcatttttcctacttattattcccagcatttttctccttgcacctaaacaaataaaaaatgaatttggacttagataaattatctttatagtggtaagccttgtctggtaaactaaactgttccctgaaggatgatgagtaatttgttgctggtagatgtaatgtaaatagttaggttacagactcagtttagtttggactatagcactaacgtgtctctaggcaatcacaatgtttaatatgatctgacgttgaacacaagcgtttcaactgatgcatccatccaccggggggctcatttacaaaagtagcaccatctatggatcatttaatgtttgcccctaagtttctagaccccctccttgtgatatcataatctaacatgcactttgttctgtgaccaaagcatccagatgaccatgttgcaagttcctaacatgttccttgtctaaggctgctgcccaggatcatacctgttctgttggtctggcatgtgcaattgattgctttcagatgttgggtggtagaaagccatcaaaaacaaagtcaatcaggatcactttcaccaccacttaattaactggctaattactttctaagcacctattaagagaacaagagattgttaactgacgtaaggaatctaaaattgtctaaggctgggtgtagtggcttatggttttaatcccagagctttgggagactgacacaggaggattgcttgaggccaggagtttgagatcagcctgggcaacatagaagacctcgtctttacaaaaaataattttaaaaaattaactgtgtgtgatggcactatgcctgtcatcctagctactcagaaggcataggcaggaagatgacttgagcccaggagtttgaggtttcagtgagctatgattgtgccatgggactccagcctgggtgacagagcaagaccctctctctaacaacatttttttaaattaaaaaaaaaataaaattttctaagatgtgattcttacattaaggagttaataactttaaacccaacagggatatgagggatctttatacatggttttaagcaacaccaacactaccattcaccatcatcattatgacgatgatgatgtcattcattcatgacataatgaatgatgagaaagagtacaagtatattgagggagaacattccaaacagttcacttagtgtaaactttcttatcatatacttaggtaagagttttttttatgagttattttattttaatccttccaacatttaaaaataattgtcattattattccagttgttcaggtaaaaattttgaggctcagaataatttagaagtgtgtttgcagtctcctagctctcaagtagcggagttggattcaaacttactggtacagtgtattttaggcacttttctttccagagaaaggaaagtcatatctggcttgcataactaggagaaattcccaagagaagagacatttgagcaggatgttgaatgactgacagtgtctataactggatgcatatgaaaggggttggatggaacagaattaggaatggaatggtgatgtgaaggttgaagcatctgaggcaaacgtaaggaaatggtaatcagagcagcatgaaatacaagattctttctcaaaagcagattgtgctggctggggaaacgggagcgtggatacagataattattcttctagactgacacatttgtgtttgattctttagccagtgtagggatgttaaagaactttggagaaaaaaagtaacgtaagtaacaccatgctttagaaatgtaatggtaatagaatataaggtggatggaaaggggagaattatattacattcattaagtcagcagttctcaaatagggacttgtatatgccttgagcattgatgagtcatttcagaggaaccacacattcttatgtgcatcactttatgaacagaaaaatatgtctcgctcaaatttgttttaccactttttaaatggtggacttccgtagccagctgtgacttggaaaatatacatttatttgcaaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggttaagtgtgatctttataatcagattttatgaactagaactccagctctcctacttattagtgataaaaggatatgttactaatctcttcaaatcccgttttcttatctgcaaatttgtgaagatgacactaatcttaccagattattttgaggattatgtgagattgcaaatctaaaatatttcaataccagacacataataatatatataagctattattactctttgttagactatgtctggtagacattacatggttttatcatattcacaaactgaaaaacacagtcaaaagtcatttctcaaatggtttgtcatgagttggagtgacagcatatcaagatcataatcagtaaatttcagtttataattttttcttgattctcttactgaattgaaaagtcagttataattgctacatttctattctttttcctgttcttacattgtgaaacaataatatgtgcttgcttctgttagagttaataaataggaaagtatttatggttcttggcccagatacccattcgctgttggttactgccctttttttcactgtctcagttcttgagatgagtatttcccaactttcagaccactgtaggttttgatttacagcagcagcctctctcgttctgtcactctaccttctgagtagccttgaagtagggcatcattatagagaatcagcaatcatcacagcacacacattctaacaaagaaactcacctagaaacttgcaggaacgttgcattccagataagggtttatggtcacaaggcaactattgactgtctttatatcacttctctaaagctgataatttgggggacccactgtattgatttacgtggaaaatatgaatgagaatcctaaagtgcaagaggaatagaagtgttggataataagcattatttgaaaaagaggtgtggagcaagtcatttaagaaaaagtggaattgatctctcctggatttggtttatcagaatgaaagactaacttagagcgatttatctgagaagggaaacaacaaacaacaaaatgcctcctatgcatggtttcttcttgtatttatttagagtctagttctttaaatctgccgggtttatggcacaattcaataccaaaataactatatgaatattgacatcaatgttttaatctgtgagtcacaggaactcatgtacaaatttattaaatgttttctattctgtttatatttgttgacaacaaagcggctctacggcttctggtgtgatttgtgcacatgtagtgagctggatatcttcatattttgtttcatttatcaccaaatctgttagctatttctaaataaagaggctgtattgagaaaggatgaaaagcagttgggaaatggagtaggaagaaaaaaatgagaagctcagtgttttataaactgtattgcaaaaaaagctgactttcatttcaaatcattgtggtctgtgctttgctttggtgaattatgcccacacatatctagtcaacacaggagagcacagatcattggaggaatgaatagctttaccacatgcatcgtgagagatgtacaagtttattttccccatcaaccatacctttttccaatatcatgcatgttgcccagcaagacagtgtcattaaccactggtatagaaggactcatttaatttagttaactaaatcctgttttttttttttttttttttttatgagtggtgggagaactgtttaaaaaagacctgtttggttaacaaatgtgcgctgctctgcagtgagggacattttgaatgattttcccatttctagtctttgccccatccagttagaaagtagcccgtagtgcttcaagaacatttacatttacatctttattgtaggttccattgtagcaagaatacatgtaaatggactcgctctatttcaataattattttgcagagtattttggctatcatcctggtgtttatagtcaatgcatttttacaccatctacattttggacagcaagcataaaacgctgctggtttatctcacagagagagcagattgtcccccaaaagatagccatttataatatgtgcacttttgaataattaaatgaactactgaagaggaaatggattctaatcagctttcaaactgtgattgtgccatgcactgaatcattcctttatgaatacatttctcttggagcatgaataattacaaaacttttttttctatctcggtaggaactgggaagtaacagccctccacagagaaactggaagggaattgctattgctctgctggtgattttagttgtatgctcactcatcactatgtcagtcatcctcttaaccccaggtaatctgtctttattcctctcttatgatggatggtattgtggatgataatttcgcattcaaatgccttaagagggtagcaatatgtggtatcttagggcacattagcatgggttggaatttggaaaaaaagcataatcagacattttgcaaatggcacagtaattctgcagttcaaatatcatgcaggatattttggggaagctgaaaatgtaaaatatgtaagttgagaatgccaaggagatttttggtctccattgccacttacagacttactatgtgttagtttgataaatgcagaagacatttgacttttattgtgggttgaagatgagggagtggcatctggaagtttctatatatagatgataacccaactgtatggaaatggaaagacaggatttgatggaaaaagatcagatcgaaagagagtgatctaagcctctaaatttggacacctatttcttgtgtcttcttttcctttctttcctaaagtttttacattctaagtttctaccctatctaaagaaactttgcaaattgcccctgcaatgatttttggactgtgttcttcagattaaagagtttaatactaatatggaaattatcattgtgcttctttctggggactatttcaatacccaggagattcattactctttagtaggtactaataaggaaggcagagataaagggatcacttttaaactccttcagttgtcttccagatacatttagcagttgctgcaacccacccacccaactgtttttctcaaagaccaaacacccacatatgacacagtgttatgaaaaatagtcatttctgggataggattgaatgaatccaaaaatcaactgatatttttaaattatagcctgttgttgaatgctatttatttccacttcaggtttgtcttagttttgttattttatgagccccttaaacacattgaacttatttcctgatgtacaaaatatgattaacaataactgtttttcagagtcatttagtcaaataattttggtgactaattatacaaatggcagtatcaattgttccagtgagacacttcgtgagatataccatctttgaaaaatactgacattgaaataaataaactgccaaaaatgcagtttttagatgttagttaacatgtggagaggttgagaaagaaattaagggagctactagggaggaaggaggagagaaaggtaattggaaaggaagaaagaaaaaattccctggtaaaagttggcttatccggcattctccccaggaaccttttcttaactgcctcatttgtacatctgcagtacaatgtcattgagcaatgtgatggctctaagttgctgcataatgccaagaatcattgttacaggaagatgagtttcagcatggtgtttcacttaaacacaagaagtttaacataattataaaaaaagaatgagtcgacattgctgccttctattgatggctattagccagatggaggtattcatgtcataatccctgtgtatttctcttgaactctttttctttcatcctggttctagcatccttggcccagtgattcactttctcaggttttcttgttactcattgaggccatagtgatattttggtgtccttgagagtttgatacaacaaagaccacatagagtgaggcactcactaagttaaacttctgctcaacccttttcaatttttcccagtataaaaccacagtgatgaaccataattgagttcattttgtcctgcacttattcatttgttaaagcaagaacaagcgtgacatacctgagtttgagttctgcctctgtaatacagtagttttgtgcaatttggcaagttatttaaccttctctctcactttactcatctgcatgatgggtataatatttagttccaacattgcagtgttattatggaggtaaaatgagataatgtagttcaagagtttatttagcatgctgcctagcactgctgctgctattcctttgatgattgctattattcagtacttattgaccaccagaaaccatgacaagcagtgttatataaagaatgttccccagaaaaggtataaaacctctcaggaatatacatcttctgtgacttcaattttagttatgacaaacggaaagggacaaaatatttaacctgaagttagtctcctggggtcaaattattcatgcattcattcatcccataggtaattgtggagttctcaccacattctaggtgctgttgtagttggccctgcactttcgctattttataactttcacctccaatcccgttacacaaatacaaacatttagaaaatacacatatttagaacaccacagccccccaactcagacttaatttcatatgatattaatcatataaatagaagtggcatttatttatttatttatgttttgttttaagatggggtctcgctctgttgctcaggctggactgcagtggtgcaatcatggctcactgcagtcttgaacttccgggctcaagcgatcctcccacctcagcctcctgagtagctgggaccaccatgcctggttatgttttattcttattgttatagagatagggtctctctgtgttgtccaggctggtctcgaactcctggtctcaagcagttctcttgcctaggcctcccaaagtgctgggattacaatcataagccaccacacccagcccacaattattatttagatttacagtttaccaagtgcatttcacatactacatgttcaaatgtctttggatttcactattattattggtagggacattataaaataaaaaagaaaataataatgctggagtggaaaaggtattgctgtaggaagcagacaccctactttatacagagagtgttctatactttctgcaaactcaatgccctcaagtgcctagaagattatgtaaattgatcaagtgggcaagtataacaactagtggttagaaatttgagttgtgacccagcaaaatggcagtgtagtcgcatggcctttacggtgggctcaacccaaacatgtcagagtaatacataaggccagaagactaatagtttgcagctcaagacttgagtcttcagcctggaagaacttttagaaatgatctagtcttgcctctctcatcagacaggaagaatatctgagtttgtttaacttttggggtgagaacaagaatatccatcaaggccatgtacactcttgattttgcgtgtgtctggctgtgtacgtctgtggtcagcctgcagtgctccaactgcaccaagcctttctcttctaaccctcaggcttgagttctctcagctgtgctaaaacagagccataaagaaaacctccagctggaaattaaacatgcagcatcatccctctgatcttccctctgtccaccaatatgttctcaaggcctagctttctaagtaaaaccagtcaagcaggtggaaactttcaaccaagtagaggaatctatgtcaggaggggaagcttctgactgtggaaattcagcaagacactgggccttttaggacaaggcctgcctctagaacaactcttccaataagagtggcagtcaggccggacgcgatggctcacacctataatcccagcactttgggaggccgaggtgggaggatcacgaggtctggagttcgagaccatcctggccaacatggtgaaaccccatatctactaaaaatacaaaaaatgagccgggcatggtggcatgcacctgtagtcccagctactcgggaggctgaggcaggagaattgcttgaacctgggagtcagaggttgcagtgagcccagatcgcaccactgcacttcagcctggtgacagaacgagactctgtctcaaaaaataaaaaagagtggcagtcataaattcatatagcttttataattatacaaccctgggctagtcactaacttctatggcttcagtgtttcattgaagaaaaggacatctttggtttgctaaaatgtgaggtgatctcttgaagtgtattataactctaatgtctattatctaatatattaataacagctaccaatgataataatgccttgtttagtgacaaatatagcaacagatgaaatatggtgggctctttcactaagatttttctaccatgaaaatatatttagtgggttggttttgaagatgaaagcatacaaaaagttatttagtcaaagaaatgttttagaaactgttttactcaaaatagcacacaatttgcaggtaagtctaaggaatgcaagcctataaccagagaaacacatgttcactgtaatttcggtttgattgcaaattttattacagaagtagtttgacacatgtgccttaatttctaaaattatcagactcttccttgccttgtgaagagaagtcctaactatttttgaagaataggctattcaagcatttcattttataagtatttctgaaaggaacaaattattcattccatttttttaattacagggtggacttattcagatgcattgatgaagcctacattattttttctattgagtttgtttaaagagaaggagtttacccacgtttattttgagaatatgttaactataagatcaataattatactctacaaatatatgagtgtacattaatgcttaaagttgtagaaatcagtctagtaaaggtatgcatctactttgcaatcttgtttttacatttaatatgtagaatgagaaggaatatacttgggagaacattttgtgcagaatagaattaccaattttggcctgttttaagaacaaaggtgcatattttatgagtcagaatgcagttgatacaggatagtcatcaggctctttaatccatctgccatactgaaatagccacctgcgaactgtgtatactccacagttcttcagcaacaatggcctgttgccctttgactgtgtctgtaatcggtcaatgccgagacagagtcatcacactgattatctgtcatgctgactaagggtaaaacgggaaagcaccaaaatgtggtcttcattgttagctctagctcctgtttcttttggaaacttcccaattaccctctgttacaatagtgggattcattcctttagtacactttttaggtgtgcacagtagatggtctttgcaggtttatcagaatataaacataaccaagcattgatgtgggaatcatgagagctctgcttgatctcagttaaacaagaatttaatggtaatttttcagttccgcaatagagatgtctttattttcacttctagaagtgtctctaagattaagaattttaaactaatttcataggccatgttgggtaataacttacccaggtcgatactgccacagtgatgttgatgattagataagtctttaatatcagatatgtgttacatccatgaagctatgctcaattagttcatttgagtcaaaacagagaattaagcaagtgaaggaaactagagaaacataggcagccctattcagaaaaatcaacaaaagaaaccaaaaactagaagacagcatttaaggtattatgccttttttacatcaacctaaatgtacagtgcacacaatcaactcatttaaccctcataacacaccagtttaaaggaagtagagcagttttctacataacacagctagggccaatagatttggatgacttcagcagctagtttgtggagaaagtatagtagatagagtgactaaattgaccttggtattcgactgacttggattcatctcctagccttactatgtgcccacaaatatgatgttgaggtaaagaatcctctctgttcctattgttaagacaacagattaaaaaaaaaagatttgaccctttgaaagagggctttaaaaatattcatatgcctgcacacacacacatgcacacacacacatacacacacacacacacacatacatctatatgtaaaactcatttcctagaaagcatttaataaaattaaggactttattggactgatgacagctgatctgttattgttatgcaaaaactcaaagtgaattcattctagttactattttgctctaacaaaatgacagctcctggttatagttagttaaaatgttatgttgtactatattgcagacaatatcttggcatctgtaatttattaggtgtcatttaagcacctgacctgtgttttaaaatgtcaaagcaatgattaaactatccccattatgcattatgaggggaaaataatgttttaccagatttttagatttgtactacttgtaaacatcggcatcaatcaagatgcaaattgtttattttgttgaattaaagcaggagatgtgctgtattgataggcatagtctaatgtgtctctgcttgtttttttcaacaacagcacagattgaacatggatttccatgtagcattacccaggcataatcaggctgcagagaaaacaatgacagattctaacagtttccccctggataatatggattgttgttgcttttttaaatagatttatctctgatgttgaataaaaaataatttcctctggcattaacggaataaaaacagttacttttttgtctttcctttatagtttcatttctatatttaagccatatgtgattcccttagttactctcataatgttagagtgtccagtcagataaatgatgaatttggtttacattataatgtgtttagttttacaagagtcagaagagaacctataaacatttatgtatatctttttcttgccagatgttgtactaagtgctttacatgtactattttttctcacatcactaatattgcatagatactattcatttatttacattctagagtattcatctgagtcttacaagttgaagtaaattgactaatttcacacaactagaaggcagagatgctcgatcactctctcaggcacttttagctttgacatgtgtcataatccttgtaatataagttaagacatattcttgtgcccatggatgataggggcaaaaaaatattttagaaaaataaatttcccctttattctttcctatgatttttgtaattagtaaactaattctatgtatttctaaaagggaaggcatagcagagaaagaattcagctgaggattgaggtgtaaaaatttggacaaggggcagaaagggaggcagtgacagaagtgggaagttgaaaatcgtaagtgtaaattctgtatgtatttttatttctggtttcataatttttcagaacttcaaatacccatgataaaatataagttcatattttccatcctaaaccacattatataaaattgtgtgtcattatacaactttaatagtttgtcatatattttatttcttcttcctaatagaaatttgatttagaaatgtgatattctggcctctaatgtatgattagatagtctggtctctgagaagtcaggtttccataaaagcgagagttatggtggggtttggtggctcatgcctgtaatcccagcacttgaggaggccaaggcaggaggatcacttgagcctaggaattcaaaaccatcctgggccacatagtgagaccccatcgcaactaaaagttttttaaaacaattagccaggtttgttggcacatgctactcaggaggcaggaggattgcttgagacggagaagttgaggctgtagtgagccatgatcatgccactgcactccaagctgggcaagagagcatgactctgtccaaaacagtcttccatctagttccaaaacatattcatcaccccaaaaggaaactctacccattaagcagttgctcctcatatcccacctcagttgctcctcatatcccacctccctcatcccctggcaatcaccaatctacttctgttctctgaagatctactttttctagatatttcacataaatggaatcaaataacatgtgacctttagtgtctaacatctttcactttgcatgttttagaagttcatccaccaagtcacttgtaacagtgcttcatccctttttatggctcatagcaatccattgtatgcatattccagagattgtgctactgtgaacctgtgtgtatttgtttgagtccatgtttttagtgtttggggttatatacctaggaatggaattgctagatcctatggtaatttctgtgtttaaatgtctgaagaactatttgccacagcagctgaaccatcttacattcccaacagaaatattcatgtgttccagtttctccaaattcttagaaacacttgttcttttcttttttttttttttcaattatgggcattcaagagatatgaagtagtatctcatttggttttaatttgcatttccctaataattaactatgttgactgagtatcttcttatgtgtctattggccatttatatatcttctttaaagatagatctatttaagcctgttgcccattttaagggacttgctggttttactgatagtgagttgtaggagttctttattccggatattaatctcttgtcagaaacatattttcatatactttcttctataatgtaggttgtctctttactttcataatagtttcatttggtgcacaaagttcttcattcacctgttctttcattgcttgtgcttctgatgtcttatttaagaatacactgctgaatccaaggtcacaaagatctgtcttttgttttttttaaatgagtttatggttttagtttatctacatgggtcattgattcattttgagttaattttttttatggtgtgagttagggagtctagctttaatttttgcatgtgaataaccatttcacccagcaccatttattgaagagaccattctttcccaattattattgtgtgaaccttccttggttatagatatatgagttatttctgggcttataattttacttcattcatctctatatctgtcctcatgctggtactgcattgtttggattactgcacctttgtggaatgtttgaaatctggaagtgtgactattacactttaaaaatatatatattgctttgctatgaagagcccatcacagttccatataaatttgagaattagcttttttatttctgcaagaaagccagttgggattttaatagtaattgcattgagtctgtatttgctttaggtaatattaccatcttagaaatattagtgttccaactcataaatatggaatgtcttttcattctggaaataatttaaataaaacaaaaatcaacattttgtagtttatagtgtaaaagtttttcatacttggttaaattcatttctatttagtttattcttctttatgatactgtaaatagaaccttaatattcttttctgattaatcattgttggtatacagaaacatgactgattgtttagtgttgaccttgtactcttcaactttgttgaaatcatctattagctttagtagcttattgtagattatctgagattttctatgtatgaggatcatgtcatgtgtgaacagagatagttttacttcttcatgtccaaattgaccatcttttagttctttttcttgtctagttactctggctagaatttccagtacaatgctggataacaatggtaaaagtggatattctcgtcttattccatcataggtggaaagctttcagtctttattcattgagtagtcttagcttgtttagataaagattctttacattgttgagggagattctttttatttctagctcttaaaatatttttataaggagtgttggatattgtcaaatagattttatcaataaattgagatgatcatttgttttcctcccttttctactatatgttgtattacattgattttcttttgctgagccactcttatattcctggaataaaacccacttgttcatgatgtataagcctcttcatatgctgaagaactcagttttctaatatacctgaaggatttttacatctgtatttataagagatattgatctgttggtttcttttcttgtgctatctttgtctaggtttcatatcaaaataatttttaacctcacagaatgagatagtaatcttttcttgtacagttttgggaggagtttgagaaagatgagtgttaattcttctaaatgttagaattcacaagtgaagtcatctggttctagcctttctattgttaggaaggtttttgattaatgattttgtaacttactcattataggtctgttcaggcattttatttcttcttgaataagtttggtagtttgcgtttttctagaaacttgtttacatcatataatgtcttagttcatttgtgctgctatagcaaaataccacagactgggtaatataaacaatagtaaattatttctcacagttctgcaagctggagaaagtccaagatcaaggttctagcaggactggtgtctggagagggctgctctctgcttccaagatgatacctttttgctgcactctccagagggaaggaacactgcattctcacatggcagaaggaacagaaggaaaagacagccttcccttcaatcctaagctcttttataagggtattaatttcattcgtaatggtagggccctaataattacctctcaaagttcacacttctcagtattattgctttggggattaaatttcaatatgaatttggaaggggaatataatcattcaaaccatagcatataatttgtatctgtattgtttgatacatatatgtttattattttgtctctttaatgaccatttttcaatatatagtatcacttcttctcataacaatttttgacttaaagtctaatttttctgatatgaggataacaaattctgctctttcttgattacagtttgcaaagaatatatttttccatcatttaccctcaatgcattgcatctttagaaagcaagtaagtgaattttaaaaatccattctgccattttcagccttttgaatggagaattacatttatttacatttaatttcttaaaatgaagtaattgtttcattgttccatttgttttctgtttgtccttttacgtgttttttttctttaagtccttcaatgctgctttcttttgtgtttatttttataatgcccttctttgatctcttctcatttcctctcgaattttttttcttatggttatgttggtcatcataattcatattttaaatttagaacaatttagtttgaactaattttatcttatgttcaatcacatacacaaactgtttttatacagcttcacccttacaatattgtttttgtcacaaattacatctatatatattgtgtgaccattaatctagatttataattattattatacatttttcttttaaatcatgttaatataagaaatataaagatgagtcacaagccaaatatacaataagactgccttttctatctacctagggagttatcattactagagttttttgtttcttcatatagcttcaaattattgcctatatttttccacttcatgctgaagcctccctttgacatttttggagggcagttctacttattgcaaactccctcagctttcctcagcttttgtttatcagggaatatcttggtttctccttcatttgagtgacgattttgctatatatagaatttttggttgaaagctctgttcttggctgggagcagtggttcacacctgtaatcccagcactttgggaggctgaggtgggaggatcacctgaggccaggagtttgagaccagcctggccaacatggcaaaaccctgtctctgctaaaaatacaaaaaattagctgggtctggtggtgggagcctgtaatccccgctccttgggagcctgaggcaggagaatcacttgaacccaggaggcagaggctgcagtgagctaaggtggcgccattgcactccagcctgggcaacaagagtgaaaccccatctcaaaagaaagaaagaaaggaagctcttttctttaaaaatgttgttccaccttcttcttgtctctatatttattgctgagaaatctcctgttaaacttattgagaatcccttatatatatcaagagggttttctttcgctgcttgcaggatcctatctttgttcttatcttctgcgtattttattataatgtgtctcagaatgcatttttttagtgttttttttttttttttgagtttgttgaacttcttgaacatatagttctatgtcctttgccaaatttggcaagttgttggccgtcatttgtttaaatactctttctgcccttttcctctctctcctcttgtgatttccattattttatgttgctatgtttgatgatgttttaaatgtgtcttaggctttgctcattttccttcactcttttttctttctgctttctgtaccagtaattttaattgatctattattattttcactggttctttcttctgcctgctcaaatctgctgttttattcttctactgagtttgtatgtaagttcttagacttttaagctccagaatttctgtgcatgtatgtgtttaatactttttatctctttattgatattttctacttttttcatacattgttattctggtttcctttagctctttattcatgatttccttcagctctgtgagcatatttaacacaattgatttaaagtcattctctattgagtaaaatgtctgtgcctccccagcagcagtttctattaacatctgtgaatggacttcactttcttatttctttggatgctttacaatttctgattgaaaagtgtacatcttgaatattacagtttggaactcttataatcaaatttttcttccttttctgggtgggcttttgtttcttgctgtaggctgtagctatttgtgttttctttggtagaatattttaaactatttttgaaaaatcactattattcaccatgtatgttctctgaagtctctgttctttaggttgtggttagctagggttttctgtttgattattctgttttccttaatattttggtttagaaatgttttcttgaatattaggaggcaaatgtggctatggtggggtgtggaggctaggagaaataaaaaacagagagggtaaaataccttttcaggttagctctgtgtttcacacttaaacacttagccagcccatttacaactctaccttaatctttacttcctgcctctcttattgtgataaacctggattccttattatagttgaagcccagcataaggtttatatctttaccacctacactgctttctactttattatatgattcataatagtttctattacaaactaagttctcaataaatgcaggcatgcattgtaatattgcaggtttagtttcagaacactgcagttaaacaactattccaataaagcaaatcatacaatttttttttggtttcccactgcatgtaaaagttatgtttatcgtatttgtagtttattaagtgtgcaatcgcattatgtattataaaaatgaacagaccttaaataaaaactgctttattgttaaaaaaattctatttgatgatctgagccttctgcaaatcataatctttttgtcagtagagggtctttccttgatgttgatgactgctaactgaacaagctagtggttgctgaaggtgggtgtggctgtgacagtttcttaaaataagagagaaataaagtttgccacattaactggcaattcctttcacaaaattttatccatagcatgcactgctgtttgagagcattttctccacaatagaccttctttcaaaatgggagtttcttctctcaaatcctacttctttatcaactaagtttatgtaatattcgaaatcctttgttgtcacgtcaacagtgtttacagcatgttagctaggagtagattccatgtcaagaaactgctcctttcacttcatccataagaaaaaactcctcgttcattcaagatttattttgagattgcagcagttcagtttcatcttcatgttccacttttaattcaaattctcttgctgcccctaccacatctgcagttatttcctgcactgaagtcttgaacctctcaaagttatcagtactgattggaatcagcttcttccaaactcctgttaatgttgatattttgaccttttcacataaatcacaaatgttcttaatggcatctagaaatgtgaattatttccagaagatttttaattcactttgcccagacccttcagaagaatcagtatctatggcagccttatcaaatgtaattcttaattaccaacattggaaaatcaaaattactccttgatccgtaggctgcagaatggatgttgtgttagcaggcatgaaaacaaccattaatattgatgtacatcttcatcagggctcttgggtaaccaggtgtattgtcaatgagcagtgatattttaaaaggaatatttttatgagtagtaagtctcagtagtggatttaaaatatttagtaaaccatgctgtatccaagtgttgtcagccaggctttgttgtttcatttataaagcacaagctgagtagctttagcatgattcttaagggccctagggttctgaggatagtaaatgagccttggcttccacagaatgtcaccagctgcattagcccctaataggagagtcagcctctcctttgaagctttgaaaccaggcattgacttttcctctctagctatgaaagtcctagatagatcaagaccatgctggctaacacgatgagaatccatctctactaaaaatacaaaaattaggcaggcagggtgtcacgtgcctatagtcccagctactcgggaggctgaggcaggagaatcacttgaacccaggaggtggaggttgcagtgagctgagatcgcaccattacactccagcctgggtgacagagcgacactccgtctcaaaaaaaggaaagttctagatagtatcttcttacaataaaaagctgttttgtctacattgaaaatctctcgtttagcatagccaccttcatcaacgatcctagctacatcttcttgataactggctgtagtttctacatgagcacttgctgcttcaccttgcactttgatattatggaaatagggtctttccttaaacctcatgaaccaatctctcttagtttcaaagttttcttctgtagccttctcatctctctcagccttcacagaattgaagagagttaggaccttactctagattaggctttggcttaagggaaaggtgtggctagtttgatcttctatccagaacacaaaaactttctttatatcaacaataagcctgttttgtttttctatcatttgtatgttcaatagattagcacttttaatttcccataagaactttttgtggctaactgttgggagcaagaggcttagctttcagcctacctaagcttttgatgtgccttcttcactaagcttaattgtttttagttttggatttaaagtgacagacatttgactcttcctttcgctggaatacttagaggctactgttgccctaatttcaatattgttatgtcttagggaataagggggcctgaagagagagagagagacaggggatcaattggttgatgtcacggttagaacacgcacaacattatgctcttatgtggtcatggttcatggctccccaagacaactacaatagtggcatcaaagatccctgatcacagatcaccgtaacagatataataataataaagtatgaaaaattgtgagaattaccgaagtttgacacagagacatgaagtgactgcatgctatcagaaaaatggtgtcaataggcttgcttgacaacaggctaccacaacccttcaagttgtaaaaaacaatgtctgcaaagtgtaattgagcaaagcacaataaaatgagtatgcttgtattgaccagtgacaaatttatctggttatccactcttgcaataaaaatgtcagagaattgtttagtgaaagttcttgataatgaagtaataaataataatacaatagaataaggttattaaagctgatgatattaccaaatagaaaagaaagtcaacatcttttgagacttgaataatatttattataaccctggcagtttgaaatgtggaaaaacataaacttgtaaaatacacaataaagtacgttcagtagaacttagtgtagtgtactctaacaaagtattgaggacccaaaaatgctttggggcatttgaattgcatatatcaccatttgtaaaattagacattgcaaataaattctgagatttcaaataaaatgtgtattaatttatttaagatgacaataataaaacaattacatataaatataaataacaaaatgaaaagttatgtttttcaaaacaaaaaaagcaaaataaatggtattgtttcacatttttacaaatgtatttaatgtctaactcagaggaagatggcagaattctcatatgtgctcctctgttaattcttttgcaatacattgttttggttgagatatatgcagaaattctgacctgataaagacacatagtcagaaatagaatatgtatgttaatagctatttcagatcattgtagaggttttttgctgttacttcctgaaaactagataagtgctagatgcttgaaggttaattgcagtgtaaaatctgaataatattttaatactctgctacattaaagtccattggtccatcttacatgttgaaagactcttacccacgtctacttctgtaatatgaattggtcatttgtaaaatattagttcattgagttatgcaggtcttccaaatgtcagtggagtttattatacagccatgcacattataatggcttttaggtcaatgacagacttcatatatattggtggtcccatttgattgtaattcagctgtaaagttcttatcccctagtgacacaaccgtagtaaggtcatagtagcatgattcattactctggtgtttttggtgatgctggcataagtaaacctactgtgttgcctgtcctgtaaaattatatcacatagaattacatatggtacataataataatgataatagactactacattactggattatgtatttaatatactacacttttattattttacagtgcattccttctacctattaaaacataagttaactgtataatagcctcacgaatgttcttcaggaggtattccagaagaaggcatggttatcataggagattttagccccatgcaccttatttaccctgaagaccttctagtggaataggatatgaaggtggaagacagtgatattgatgatactgaccctgtgtaggcctaggctaatatgtgtgtgtttatgtctttgttttttaaaaataaaaatattaaaatagacaaaggttatgcaataaggacataaagaaggaaaatatttgtgttcagttgtcaaatgtgtttttaagctaagtgttattagaaaagtgtcaatgatgaaaaacattgataaagtaaagcagttacaggaagctaaggttaatctactactaaagaaagaaaattttttaatgcatttaatgtagactgtgcagtgcttataaagtctacagtagtgtgcagtaatatcttaggcattcatattcactcaccactcacttactgactcactcagagtaacttccaatcctacaagctccattcttgaagtgccctatccaggtgtaccattctttttatcatttataatgttttttaactatatattttctatgtttagatacacaaatagttaccattatgtttcaattgcctgtgattttcagtgcactaacaggcagtacaggtttgcagcctagcagtaataggctgtatcttatagcatagatatgcagtagactttagcatctgggtttgtgtaagtacattctacgatgtctgcacaaccatgaagttgcctaatagcacattcctcagaacatatccctgtcatttagtgacatgtgattgtacagttgttaaaaatcatgatgaatttcactaatgatttcactaggaaaagctcactagagaattattgagaaatgatcaaacttaagatggagaatatcagttttctaaaattcattttcttgcttgaaggggctcgaatttttttgtttgtaacaaatacagccaattgtggattttgtgaagaaaaagtttacttcattttgaagaaaaacacctgtcagacacttaaatctgaataattgtagtttgttactcattccttccagtaaaaataatgttctatgagaaacaatgtggtgagtttagctcataactcaagcaactgaccatatgcttttccatgagataaccatcatatttcgtatgcactggtgttattttattttttgacatactgcaccacacagatattcaaaagatgttgagagtcaagatgtagtacaattaatattttttactacttctgaactgaaactgggtttatttttaaattgaggctatatggccataaagaatataatgacaattgtttgatgtcacagtgtcgacttatgaaagggtgcctggagttttatcaaccattgcttttgtatcacaagtgaaaatttcaacccattgacaaggacaataatgtcttcgtgttattatgaatacagttttgatttctgtgacccctgtcttcctgaagtccacaaccatacaccagaaacctctggtgtaggctaataaagacatgcaataaaaatttggtcatggtaatgtgatagaatcaagcaacatatgtgaaggaggaacttaaatatgactttatagagccataacactttagggtaaaaggaggacatcatttcagggtgtatgtgtgtacacatgtgtatgtatcacagtgtgtaaatgctcttctccaaatgtggaaagcttacatacatttctcatatttagattctttactcatattcaggagatgttaatttgaaaaaggtctcagaaagaggtttgagaatcattagcattttgaatgattgactaatttggctaattagaactatgagtaaatcctaaagctcttgacttatgtaatcaatggatgataagtttgaggtaaaatttaataatagtccttcagaacctaaaggtacatttcttatttgatgagcactttgagtcactgccaaaaatgaaagagcctagtataagatataccagaaatttgagaatcctaagagatgcaagctagtttgcagctcatcatgtgtgtttgtatgggttttgtgtgtgtgcaagcatgtatgtgtagagcttcaaataaaattctatacaaagaatcaaacatgccaaagcagcatttttctggttgaagaggtctaatcacataacctctgtccttccctcatctcttctctatcctgaaagagttcactagagtccttagaacactgctggatatagtgtgatttagtccaactcttggtctttgcaaatgcaaaaaatgatgcataaataaatggagtgatctaaccaaagagatacctgctagtgaagggttgaattaggactaaaatatgaccttctaactctgatcactgtttgtgaagcatcattgcccatccccttttgagaacagagaagcagaggttagatttattacagtatgctgggcactgcagggaaggtgaaggcattgtaggtggtaaacttcttgcagattatgcttttgttttatgtactcagtatgaatatcctaaatattatttctatatttgttgaaaaaagagcagagttttgtgagaaaacagaaagaagcagataataaattatatttcatttgtcagctgtcctcctcattctatttaatacaggcacagtttggtcttaatttagttacttaccctatgttgagttttaaaaatgtatttataattaaaatatggctttctgtatgaaagtcccattttggaaatatactcagataggaaagaacattcattggatgattgtctgacccaggaaacaaattaaattaaggagtatgtattattaggctttgtaagatacagggataatctgagtcaaaagtagttcttgctttctttattttttattttatttaagttctagggtacatgtgcaaaacgtgcgggtttgttacatatgtatacatgtgccatgttggtgtgctgcacccattaactcatcatttacattaggtatatctcctaatgctatccctccccgctccccctacccaatgacaggccctggtgtgtgatgttccccttcctgtgtccaagcgttttcattgttcaattcccacctatgagtgagaacatgaggtgtttggttttttgtctttgcgacagtttgctgagaatgatggtttccagcttcttccatgtccctacaaaggatatgaactcatccttttttatggctgcatagtattccatggtgtatatgtaccacattttcttaatccagtctatcattgatggacatttgggttggttccaagtctttgctattgtgaatagtgctgcagtaaacatatgtgtgcattgtgtctttatagcagcatgatttataatcctttgggtatgtacccagtaatgggatcactgggtcaaatggtatttctagttctagatccttgaggaatcgccacactgtctgccataatggttgaactagtttgcagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcttttgcccactttttgttgggtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattgtggcttttgttgccattgcttttggtgttttagacatgaagtccttgcccatgcctatgtactgaatggtattgcctaggttttcttctagggtttttatggttttaactctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtactatttctgttctgttccattggtctatatctctgttttggtacgagtaccatgctgttttggttactgtagccttgtagtatagtttgaagtctggtagcatgatgcctccagctttgttcttttggcttaggattgtcttggcaatgtgggctcttttttggttccatatgaactttaaggtagttttttccaattctgtgaagaaagtcattggtaacttgatggggatggcattgaatctataaattaccttgggcagtatggccattttcacgatattgattcttcctatccatgggcatggaacgttcttccatttttttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttatttgtgtataagaatgcttgtgatttttgcacactgattttatatcctgagattttgctgaagttgcttatcagcttaaggagattttgggctgagacgatggggttttctaaatatacaatgatgtcatctgcaaacaaggacaatttgacttcctcttttcctaactgaataccctttatttcttcctcctgcctgattgccctggccagaacttccagcactatgttgaataggagtggtgaaagggggcatccccgtcttgtgccagttttcaaagggaatgctcccagtttttgcccattcagtatgatattggctgtgggtttgtcatagatagctcttattattttgagatatgtcccatcaataccgaatttattgagagtttttagcctgaagtgctgttgaattttgtcaaaggccttttctgcatctattgagataatcatatggtttttgtctttggttctatttatatgatggattatgtttgttgatttgcatatgttgaaccagtcttgcatcctagggatgaagcccacttgatcatggtggataagctttttgatgtgctgctggattcggtttgccagtattttattgaggatttttgcatcaatgttcatcagggatattggtctaaaattctcttttttttgttgtgtctctgccaggctttggtatcaggatgatgctggcctcataaagtgagttagggaggattctctctttttctgttgattggaatagtttcagagggaatggtaccagcttctccttgtacgtctggtagaattcagctgtgaatccatctggtcctggactttttttggttggtaagctattgattattgcctcaatttcagagcctcttattggtctattcagagattcaacttcttcctggtttagtcttgggagggtgtgtgtgtccaggaatttatccatttcttctagattttctagtttatttgcatagaggtgtttatagtattctctgatggtagtttgtatttctgtgggatcagtggtaatatcccctttatcattttttattgtgcgtattttattcttctctctttacttctttattagttttgctagtggtctatcaattttgttgatcttttcgaaaaaccagctcctggattcattgactttttgaagggttttttatatctctgtctccttcagttctgctctgatcttagttatttcttgccgtctgctagcttttgaatgtgtttgcttttgcttctctagttcttttaattgtgttgttagggtgtctattttagatctttccttctttctcttgtgggcatttagtgctatgaatttcccgctacacactgctttaaatgtgtcccagagattctggtatgttgtgtgtttgttctcattggtttcaaagaacatctttatttctgccttcattttgttatgtacccagtagtcattcaggagcaggttgttcagtttccatgtagttgagcagttttgagtgagtttcttaatcctgagttccagtttgattgcgctgtggtctgagagacagttttttataatttctgttcttttacatttgctgaggagagcattccttccaagtatgtggtcaattttggaatcggtgtggtgtggtgctgaaaaaatgtatattctgttgatttgggtggagagttctgtagatgtctattaggtccacttggtgcagtgctgcgttcaattcctggatgtcctttttaactttctgtctcgttgatctgcctaatgttgacagtggggtgttaaagtttcccattaatattgtgtgggagtctaagtctctttgtagatctctaaggacttgctttatgaatctgggtgctcgtgtattgggtgcatatatatttaggattgttagcttttcttgttgaattgatccctttaccattacgtaatggccttctttgtctcttttgatctttgttggtttaaagtctgttttatcagacactaggattacaacccctgcctgtttttgttttccatttgcttggtagatcttcctccatcccttcattttgagcctatgtgtgtctctgcatgtgagatgcgtctcctgaatacagtacactgatgtgtcttgtctctttatccaatttgccagtctgtgtcttttaattggagcatttggcccatttacatttaaggttaatattgttatgtgtgaatttgatcctgtcagtatgatgttagctggttattttgctcgttagttgatgcagtgtcttcctagcatcaatggtctttacaatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttggtttggctggatataaaattctgggttgaaaattcttttctttaggaatgttgaatattggcccccactctcttctggcttatagggtttctgccgagagatccgctgttagtctgatgggcttccctttgtggataacccgacctttctctctggctgcccttaacattttttccttcacttcaactttggtgtatctgacaattatgtgtcttagagttgctcttctcaaggtgagaagagaagtttagggaaaaaaagagtaaaaagaaacaaagaaagcctccaagaaatatgggactatgtgaaaagatcaaatctacctctgattggtgtacttgaaagtgacggggcgaatggaaccaagttggaaaacactctgcaggatattatccgggagaacttccccaacctagcaaggcaggctaacattcaaattcaggaaatacagagaatgccacacagatactcctcaggaagagcaactccaaaagtaattctaattagtagaatttatcaggaatggaccagagcagactctgttttttttttttttttaagaaacctagctatttctgcaacaagagattagaaagagtaagaaaaggcaaaagaaagatatatagaaggaaatccctagtatgccaagaagagcaaaggtgattccctggaactgtaaaacagatgtagtgtatttgacttttcctttttggcttttgcttgaatggatgaattaggcttcacaatactaagtgacaagctattaggttttcttcattaaagagcttgaactatagattattatttttccaatttatattttggaacttataaagtcaacatagttaaatacacttctgaaaagagacttttctgtgaattttacattttactatatttttccaataactataaagaagcaacttcatattgtgtttctaaaagtaaatctgagaatacacgtagaaacatttcggttgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaaaataagaatagaatttatatttcatatgttaagtactaaaacaaaatcttaggatctgctgacaagttagagaatgcacaaagcaatggcagatattttgaaaaatctagaatttaatcttgactattgtgatttgcattctgtagtttcatctagctgtgcaaggaggggtagaagtgatgttatttcaatcagctagtcaataatatttaaaatggaaatgcattagaagactatcccatatgacactaaccatggaaaatgaagaatacgattaagagtaaatatttaaactacagccctgggaatggagatggtggtactgggaaaacccagctaagggagaatcacgtgagtagaaaggaaaatagcttgttcttcttgtgggaaattttaaataactacttgattagatttttctttctatttctgttttaataggaaattattttgaataggatttaaattaaggaaatatttctaaacctctgatatcaagaataaactagataaaactaacacaattattttcagcaaagaggaaccaagaacttaaagtcataaattagcttttcttcagttgaatgctgaagaactttctttttttttcatctaagattatgcagccaactcatttcaaaggccatttaaaagcaagattggatttttggaagaaagaacagaaatacccatagcagtctatgatcttaaaggaccaaatagagcacagaaaagaacatggcgtgaattattcaatttcagttctgttgccacattcatattgtcaaagctgaactttttacttaagattctacaataccttgtaactatttaaccaataaggattctgtttccaggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggagaacaacctatgagaggtgaatattaaattttagcaatattttctttacattagggactaagtattgattttagaatttctttctctaaagattaataaaaattaataatattttgaaagagtgtctcaaaatgatttacaatctaatatttttttctgagccaccttctcgttgttcagtgtgagtgattgagatgaatgattgatatccaggtttctctgtttgctaggtaaaaataaagagaaaattatttaaatgtatcaaatagtaagatttctctaggtgattctccctgggtctgattctaacataaattaagttcctgctaaattacgttgcaatgtgagtaataaatgtttgttgatgactgagttccgttgtaactataaattgcctgtaacaatgagcagagggtaagcttggaatttaagacatattgtagacaagtgtcttgaagaaagcaaaaaaaaaaaaaaaattcctacattttagtgaatgctgtgacatttctctctttgagaaaagaggatatgctattatcttcctgggcaagttgaggcagaatgggatgctaataagctccagaggggcttacactaaggagttggatttcagttggaagaagggttctagtggctaaaaggcaataagaatattcctaaaatatttttgtaagattgtatattgtcttgtgaaaagatgctattaatacattattaaagagaaaaggaaagaaaacttatttttgggagatagtatagcttaatgaagaaaacctaaagtcagagagatgcaggttcaagtttcagctctgccaattactagttacgtggtctttgtcaacattgccgagcctgtttctctgtgaaatgaggatactaatacccagtagggtttgggggacattcagaaaagagaggattggttgcaaggaatgaacatcccgaaggattacaatgagacagggggaggctgctcataaaaaaaaaaaaaaaaaaaaaaaaaagatagaggatagaagttagccttggaggctattaaaagagaagcttaattattcattatgtgtataaggaaggagtctttattctaggaatgaaaaattcaagagacctcagggtaggcagctaaggaaaatttaaggaaaggaacaaagaaagcaacacagaagaagaaaaaaacaaagaaatgaatgaagtatatagttttctcagtattgaataaagccaaatacattaattattaaattacataatatctccttctcattattgtttaaacagaagatttatttatagttatttgaattgctttgaagggttggttttagaataagttccaggggcaattggagttaaaaaatattattaaaattattaaactattccagagcacagaaaataaacacaacttcaaaaatattgaataaatgtattaatgtgccaagtgatcaatataatacagaatggaaaacaaaggactgtgtaactttgtctgttaacctagatgtaaacatttaaataaaagtttaacatattaatctaatagtataaaaataagaattcaacgtgcttggttggattttgttacagacatatcgggtggttgtaaacaggagattgtatttatgtaatttttatatcaatgtgttaaaggagaaaaatatgtttatataaaagagtctggaaagaaataatgattatttcataatggaaaaaaagcaatgtcactgacactatgatcattcaacatttttttaaaataaattaattttttttagttttagggattaggcctcactctcttgcccaggctggagtgaagtggcgcagtggcacagtcatagctcactctaaccttgaactaactcctcaactcaaatgatcctcctgcctcagcctcccaagcagctgggattatagacatgagccaccttgcccagctcagtatcatttttcacattcaagctaatgaaataattcaatagaattaaacaaatgcttttcaaaaatgaagttggaacaattagtcatccatagacacaaaacaaaataaaccagcagacaaacaaaacttcatattaagcctcatgccatgtgtgaagatatacaaaaagtaactcaaaatagagcagggaggaatatgtgaaataaaactataacattttttaggaaaaagccataggagaaagtttcaagaccaagaaataggtgaaacattgttagacttgacagcaaaagcacgattcataaaaggaaaaattgattacctggatctcataaatattgatacctttttctccacaaaacattttctaaagagggtgaaaagacaacttacagactggagggaaatatttgaaattcacgtatctgacaaagcatttgtatttagaatagacgaagaactcatcaaatgcagcattaaacaaacacaccaacgaaataattcagttagaaagtgggcgaatgacatgaacagatatttcactgaagactatatgggaatcataaataagcacattaaatgatgttcaacctcattagctactagagaaatgcaaattaaaccacaaggggatatcactacacgtatataagaatagccatttttttttaatgacatcaaatgctgccgaagatgcagagaaactggatcatttatacattgctggtgagaatgtaaaatggtaaaactactgtaaaaaagcatatggaatttttaaataaaactgtaatgtgtttacatttgacccagcaactgcatatttgggcatttatcttggagaaaagaaaatgtatgtttgtacaaaaatctataaaaaaatgtttatagtaactttatttttaatatccccaaaccagaaataacaataactcaaatgttcttcaatgagtgaagagttaaagaatggtctctcaataccctggaatattactcagccatcaaaagtgatagattatttatacattcaacaacttgaatggatctcaagggaattattctgagtgataaaagccagtccaaaagcttaggtatggtatgattgtgattatatagcattcttaaaattacaaaattttaaaaatggagaacagagtagtggttggttgccaagggattgggtgggggactgttaatgaaagagtggcagaagagatcctagtgatggaactgttcttgactgtggtgctggtcacctgtgatgcagttgcgtagaactaaacacgcaagaatgcacgtgaataaatgaatacatgtaaaactgcagaaatctgagtaaggttgatggagtatatcaatgtcagtttcttttcgtgatattattatgcaggatgttacttgtcattgagagaaactgaatgaagagtacacagactttctctgtaatatttcttgcaacttcatatgaatcttcaattacctgggaagcaaatgcatacatagtataattagttgcttaaaatttggaaaagaaagaaaaaagtaatatgtttacagatgctataatttaatatgtagaaaataaaaactcataattgaaatgtttaagaaaatgtgatatggtgtaatcattaatcttataggtataaaaataatttagaatgggaatgggaaatattctgttcacaataccaaactatatatactttgcactaaattcaattggaagggcaaaggacttatataaaaaatcaaagataaaatagtattaatgtacataaaatgaggatggaatatttctgaatgaaaagccttaatattgtgaaatgtttaaaattttccagttttcactgttgtgtgtatgtatattatatatagtgttattttaataaaatttctatttgagttgtaatatgattttaaagctcacatgaaagataccatgtttgaaaattaccaaattattattttaaaatttatttgaaaataagattatttggtgtggtggacttacagccttttttttaagttaacatcttcctaaaaaatgtaaatgaaatatgtggaactcattaggaacaaactaaatgtttttggaagacaaacagatgcatgcatataaaagaaatttatatatataatacagttaattttttaaatttaatagataaggatcatttaagtttgttagcataatttctctcactgaaataagtacatgcctacctcccacctttacctatgtaaatttattgtatcaaataagtcaatgtttatcaaatatagatgataaaatataattctctaaaaattgaagggatctgattagacaaaataatggtaaatttacgtgatagggaaatttaaaaattttgaaacttatctatatcaaacttttgttttattgagatacctcatagaataaatatatttctgaaaccctaataaaattagctcatctgattaaaatcccatacttttatgatggaagctgaattctggaattaagatattttttcgcttgtgaaacaaaaagcacttatccttttatcgcaaatgttcttcctccttctcctgcccctagtattcccttcctctgccttttgaaacatgtaatacccagggtttttttaatagtttttttttataatagattatttttcagagaaattttatattcacagcaaaattgagtgaaaggtacaggaatttcccatattctcttccccctgacccccctgtgcctgatacagaccatgcatagcttccccaattatcaacatcccgcaccagagtggcacaattgctatcactcatgaacctatattgacacatcattgtcacccaaggtctgtttggattcactttccagtggattgtgttgtatgggtttggacaagtaaataaagacatgtatccaccattgtagaatcatatggaataacttcaccaccctacaaattctctatgttcacctgctcattccttccctcgcaattcctagcaaccactgctatttttactgtctctatagttttgctttttcaaaatgtcatgtagttgagattatatactatgtagccttttcttactggcttctttcacttcataatatgcatttaagtttcctccatatcttttcatggcttgatagctcattttttttagcacagaataataactcattaaaaaaatgtatctatttagccattcacctattgaaggacatcttggttgcttccaaattttggcaattattaataaagctgctataaatgtttgtgtgtaggtttttctgtgttaatatgttttcacctccttttgggtaaatacaaaggagcctgattactggattgtatgataataatttgtttagttttataagaaaatgccagattattttccaaagtgactgtaccattttgcattcttacccaggaattagtgagagttggtcattttatgtttaagtgaggccttctctgattttttctgtgagacatttcctttcttcaaactcattaagcactctctatccttatactgacatctattatgtatgtatgtgtgtgtgtgtgtaatttgttttttgagacaaggtctcaccctgtcacccaggctggagtatagtggtgcagtggtgcgatctcagctcactgcagcctccgcctcctgtgttcaagcagttctcccacctcagcctcgcaagtagctgggacctcagacatgcaccaccactctaggctcattttttgttttatatattttggttgacacggagtttcaccatgttggctaggctggcctggagctcctgtcctcaagtgatccacccgccttggcctcgcaaagtgctgggattacaggcatgccccactgcgcctggcctgacatctattatatgttttgttaagcatgtgcaaacccctcagggcaggacagagatatgtctcctatcctttacagtactgcacttgttgccttgaaattttttaatgaaactagaaaatttgtgaatgaattaagaaattctggtgtgtcagactgccaggcaaatgatcaaatatatatcatcacctaacagcatttcgttttgcaaagctctatacaattacaatgtcttatgctaaaattataatcaaacaatactcactatttttactataattttttttccattttttcttggcagttattttatgggttaaatgcatgattgatttatgtgaaagggaattgcatttgacgttattgactctttgccccagccttttcagctagaaaaaagcaaagctcttgctgtaacaagtgctgaaccttttcagaataaaatctaatgaggttagtatatatccttgacattttattttcaaccgaagtgaaggtcatagctgaaaggtcacaaagatgaatttatacagcaaataaacaatgttattattttgcaaagaaaatgcaatattcctgtctttagcctcttgcatgtaaaagggtgtttgtaatgctgattttagtattcaagtcctgttatcttttcatttcttatattttggaatgtagaaagaggaatacacctagcttatctataaaagactagtatgaaatgtgtgtattatcattaatattctagtattttattatttgaactttacatttaagtcaaatctactttgtatttgttgggtactaatttttttggtggaagtaggtaattactctatttccttggtaaacttctttctgacttgagagtttagtcatacataagtccctcaagtctaccatctttggtttttaacaacaaaactgtacatttccaatgaaagaatatatcaacataagtttggaaaataaggggctgaattatagttaaatggtagaaaatctgcctttttgggcacaatgtacaacaggaattcttaactgctttcatattatattactaatacgtaacatgggattgctctattaaatttgtaccagatcaagacaattttaatagtaaaaatagtttcatttatttaaaaagtcattaaacaaagttcaaatgccaaaaaccatgtcaaaatggtcactttatattgttatgtagttaatatattttagagcaaatattccaaattttgtaatttgctccttttaaaaaacaagcataagataggcatctaacctagaatttcctttattttagatgaactcacaaattcgtcagaaaccagattgtctttggaagacctctttaggaaagactttgtgcttcacgatccagaggctcggtggatcaatggtaagtgtatacctttttaaacattgtattcattttgagttctgtataattaaaattttaaaaaatgagatgtgtaagctgggcgcaatggcttatgcctgtcatcccagcaccttgggaggccaaggcaggagaatcgcttgaacctgggaggcggacgtcgcagtgagccgagatcgcaccactgcactccaacctgggtgacagagcgagactccatctcaaaaaaaaaaaaaaaaaaaaaagatatgtgtagttaatatttaattgaaagtgtacttcaaagattacatgggtattatttaaattaaaaccttggttcttgtgagagaaaatcaattcctaagatagggcgtcaataaattatttggcaaacattgggttgacagttttgtatctgctgctctctcatgatcattagttacatgactttaaggatgtattacatctctagcacatcactagataatttttcttagtttggcagtgtacattttgggagctagtacgtagaaatgttaagtgcttcagatttgacaatatgattggtttttgttattctctgtggcttttctttttaagcttaagtgttacaagctagtgagactctatgcaaaattgaaatgacttggaaatatatggcactttgttgtttttttttctggcctggcaaataggactccttaggttctcttaagtcaatctctgacataaaaataagaaaataaaaccactgagtggcttcataggttttgctttgtctttatggaagatcataagggcataatgtgttggtgaaaaggaaatcagttttttaatcctttgaatgttctaatttgaccaaccatacgaatcattatggttggatagctgttaatctttacccttcactttatttgggcataatatctttgctaattttcaaggcatagagtgtattatttgtataatagatgaaaggagctttgccttttcatataataaagatcatcatacttacagtccattccttcctctctcttactctacttaagtgtatttatgctggtgaattaaactttaatttatggaagctatataaagagaatgtaatttaacccatgagggcaaaggccaaatcacgtgtgtttacttgacactgatatgtctcctggagatctgcaggcactcgagattggttttttgaataaatgaatgaatgattttaattgatgtgcagtctcattttcacataaacttaaattttaattgaaatcaattggaagataagtgtgtattgtgatgatattacggataaagaacacaaggtagcgtttttcttaatgaatctgtatatttttattttgaattgtttataaatttgaggctagtcatatttttgcctttgtactgtgattatttcacatatacactataatgagtgctatgactaaagaaggctaataaaaaagatatattatcacaaaaaattgtccaaatacacaaatctctcataaataattcttctaatgtgtgattataattatgacaatcacctgtttactctttagcaaatattttctattgagagaaatgacaaaatgaaagttgctaggtttttttaaacagtagtattatgagttgttagatttgaaatgctgaataatcttgttttattcaccatgtttttggacaaattatagacattttgtagtctttgactttggaaaacatgaaaaattatgggtctcatctcccttctcaggttagcttggactatttagaggcatttactcctgtgtataactgactctgtgatattgaagctccgaaggacaggacagatatttaagtagtgaactgcatgctaaattaaaacatatttcaatatgtaggacacagattctactcttatacttcataggttaccaaaataatatatttggagtttatcatttttcaagtaatttctttattaatcattggttaaatttgatcctaagaaggcatctgggacaaagctgcagtgttattataatgttctaagtaatacctaaatatataatttttataaagaatttgacataaagacaactctttaaattggaataaacagaacctaagctctgaaagaatgcagtctttataaataccattgaaggaactgtctcaatgcctgtaaattgtgtgcactgagttactttttaagtatagaaatggatttgtgcttttatccaacccagatctttctggcaagtgctagatacttggcctatttacgtattcctcacatagcctggaaattcaatgggaaatatatgagtaggatgtgtaaccttggcctcattatcaacagttatatctaaatgtaacctgtgagctttttctttattctcaagtgatatctcaacaggttttctttgtacataagtcacttgaaggagttcgagctcagcttatttggaagcatcatttaattcttggaggtcatcatagaagtgcttaatgcattattggtcaaggggaaggagggagtctagacggccctgacatgtgtaggttatagtgaggcgatgccattcattatgcttggtctcaaaaaatatgtctgagaatatcattgcagtcttggatgggtgcccctgttcatggttagcttaacaacggccttaccccaagtctgctcatatctttgaaatctacatttttatagcatcttcattctagcaatgtcaccttgaaatttgaaaacccatcttatttaaaattattcattctatccacacacatttgataatcaattaatcaccaaagaaagatctaacattgagtgccttctattgagactctgtgatcgatgctttatgtacatatttcacaggactgcatatgacattaaagttaaccccagaaaactgaggcttaactcagaaacttatccgaacacacacctaataaaaggcagaggctgctttactcattatgcttaagtataaaacttgacctctttcattgtttgactctgatgtgtcatcctcatatctaacatatttatcaagcacctcactgacaatctcattttaacagacctcattgctgtcgtagggtggaaaggtatgaaagccttcctcacccatcataaaggtcacagccaacactgctgtaacaaaagaccagttaaaaagagaaaagcataacaaatttatttaatgaaagttttatgtcacttggaagactttagaaatgaagaatcaaaggcctagggaaaactgtccatttgtatgcttaggttaaataaagtacggacagtgtattgaagtgtgactggacaaaaagggtatactctaatgataataaaatgagggagaaacccagcaaagcttacctgttcagatccttcttggcctccctgtgtagcatttcatcctgccagatataaggcagaactcccccggaaatagggtcttatgatctattatctgaaaggtaggtcagtgcatttccttgtgacagctcctacacagaaaagcagaggaaggttaaaatatttttaaatcttatggtttgcttggaaagagggatgctagtttcttttattattgttattatactttaagttctagggtacaagtgcagaacatgcaggtttgttacataggtatacatgtgccatggtggtttgctgcacccatcgtcccatcatctacattaggcatttcccctaatgctatccctcccctagtcccctaccccctgacaggccctggtgtgtgatattcccctccctgtgtctatgtgttctcattgtgcaactcccacttatgagtgagaacgtgctttgtttgtttttctgtccttgcgatagtttgctgagaatgatggtttccagcatcatccatgtccctgcaaaggacatgaactcatccttttttgtggctgcatagtattccatggtatatatgtgccacattttctttatccagtctactattgatgggcatttgggttggttccaagtctttgctattgtgagtagtgctgcaataaatatacatatgcatgtgtctttatagtaaaatgatttgggagtaatgggatttcaagtttttgtaacctttcctggggtagaggaatctggtttctattacttgcttcagggatggcagagaggtaggagacaggaaggcagaaggaggtcagatacagactttgcttctgagactgctcagaggccttccaatatcttagtcagttcaacgtactcagcatgccaccatgccatacttggaggtatcattttctgagtcccaacactattaattttttcatgttgaatactacaataatatgtttatttccccaggtacattcatgtagtggtaacttatacagtcactaaaactagagtttatacacatgtttattgacttgatcatgatctagaaaagtgaacaaagtaacttcaaaacagcattgatagtatgtgatatcacattgtctattgtgtaacagtgattgtctccagattatccctttctttttacttattttgttttttctcgatttttttcaataaatgcatgtgtttacatagtttttttttataattttaactttttattttagatttagggagtgcatgtgcaggtttgttacatgggtatcctgcaacgttagcactctcaggatattcattttgagctattagataaaatcaatcaagtgctattttatttttaaactttgttttccactgtgtcagaagacaattccaaaatttatctgatggagtataaacaattaaaattatcatttgataaaaaaaagttgtaaattttaaatacatttgggttccagtggacaaacataccatcatgtaatgagattttaccgtgcagctagtgtgtcctttactcaccccatgagtttgacaacacctgctcagtgatattggtccacttaccatttgttatgaacctgcagcaatatcaaattgctatgaaaatttttaaatgtgtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaaaaaaagaaaagaaaaaaactataaatgaaaagtcaaggtctgtagccttgtggatcttcaaatggtagcgattcatagaactgatgttagagatgctctgaacacctgacatttgttaataaatgcgctgggaggtctcattctcataatatatgcaggatattgaagaggcagtgaaaagtcactattgtagcctgtatgaaaaacaagaaacattattgtaatatatcaataatatttacagtaattaggggaactgtaaataggaaaactaaacaaatacatctttgttgtttcttgcttgtttgtttgacactaatttgtcatactagaattattgtccatcaacttcacttggtagagctgcagaagttgttgtgtttctcagtgcacagggagctacttctaactccaaagacatcattaccctccctttagcctatattcagcccccagtcaaaattatcttatgtttatcttattttgtatcttcgtgaccaaagtgttattttttataatcatcaaccaaactgatagttaaataaaatagagttgaatttatattcatgaggctcttgaagataacacgtatttttcttgcaacataatttataaagataaaaccttgcatagattctagatgcacacaattaggtatatggtcaaataaatcaatttgcatctttttaatggaaaactaaacagctgtaaaaattaatatttaaaatattagtgacattgaaatatgtgcagataatatattaattgaaaatagcacaatatggaattatatatatagtgtattcacaattgcattacttgcatatacacacaagtatatgcaaagaaaataatacctgaattcaatatgccaaaatattaaataattttctgttagagtgattgagttgtttttattttttccctttctgtctatattttccaaattttcaacaggcattctgctgtttcctactatggcaattttatgtactaactacggatattcaaacttttgtttgaaattcaaacctaacaagtaaatggttactaaaattctcattatggtagatgcattcagctagacaaatattaattttgttattctgcctgtgccttttttctcagagatctgtatgaaaaggaggtacagagaggagcgtgaggttactgaacctgggagaatgagaatgttcttagcacagcaatgactattagacttaagaggcatggattcttataacagcagtttcacttccttctttcccaatagattgagacataatatttcctgtagtttattatgttcttttttcttccactaatccaaacctctgcaacatgcaatttatctatattacaaacctaaatagtaccctagcccccaaagggtttttttaaaaagtcaaaaataacaaatgttgatgaggctgtggagaaaagagaatgcctatatggtgttgctggaaatgtaaattagttcagccactatggaaggcagtttgaagatttctcaaagaacttacagcagaactagcattggactagcaatcttattaatgggtatatacccaaaggaaaataaactttctaccaaaaagacccatacatttgcatgttctttgcagcactattcataatagcaaagacctgaaatcaacctaggtgccccaaaatgtaggagcggataaagaaaatgtggtacatatacaccatggaatactgtgcagccataaaaatgaacaaaagcatgtattttgcagcaacatggatgcagcaggaagccattatcctgagtgaattaatgcagaaacagaaagctaaatatcacacattctcacttataagtgggagctaaatcttgaggatgggcagacgtaacgataggaacaacaggcattagtgactccaaaggtggggagcggaggaggggaacaaagcctgaaaaacttccttttgggtactacgttcactatctgggtaactgggatcaatgaagtccaaatctcagtatcatacactataccttgtaacaaatccacacatatacccccaaatctaaaataaagattaaaattttaaaaatcaaataaaaagtaaaaacacataggaggctattgaaataatgacatacctagttcctgattcacagaccagagacttgtaaatgaaatttggaatgtaaatcatggttatcaaggctgacttttcttttcagagttatatatgacaaagtatcttcctatcaagagtagataatttcctactaaaactaaacaaatgcttaaaaagcataccatgaagcatatttacttctctccaaatgaccaaaaatgttttatttattgctatgttgtttgtaaaattgtgcttttaccaaagtttagattaaatttcatctgtattaaaactgtttgaaatcaataaaatggaaatatctactataaaaaatcatactgtggcaatcttacatactaactacgatattcaaacttttgtttggaatttaaatctaaatagttttcttcaagaaaatatttttaagatttcagtttgtctaaaaatgacaatacttaaactaaacaccaagagagagaaaagggatttactgataaaattcagtgttaacatttaggaacaaaaaagtatgtaagaaaaaaatatatttctatcacctaggtatgcaatgatcaaagtatttaaagagaatttgaaacacaaactaaactttagaataaagaagctaaatatttatgttaccacttatttcttgaaatataaaactatattttgatttttaaaataagaaaaaaaagcttggggaaatgggatgaaagttatgttcagagttcatcaacaagcatttattgagcttcatatatgtgctctgcacagagcttcatatattccagatggaatctgtttacatttgaaaagtttgtagtaaaatatctggtgtcctcatagtcctttgatattctatacaattgttggtcttggccttgatggcccaggaaatctgtttgtcaatacaaatatagaataatagatacattgacattgacatctatctttccatctatatatccatctatccttttatctatccaacatgtattgaaaagattgaagcacagccaaacatttttctagatacaaagatataaaggtgaataaacacagtccctttgatcaacgacattatgaatataaagggtttttttcctcattgagcacaaatctttccagttgtctcaggcttaaaagtaaaattgtaatcaaaaggctgtgaatgggacagaaagtagacataactgaagagttgcaagaaatactcagtccaattacgatgaagttttattaaccttctccaaaatcaaaaacacatcttcacatcctacatctctctctttactatgatgcagggtacacatggcacattttatttttttgagctgctgtgtacgccctgcctctctttttatttgatacagtcttcacttacatatggtaatgatcatgactaatatatacatgtaccactgacatgttcaaaaaaaaaatataattatggtacccagagactatagaaactagatcaaaataataggcctaaaacaattaggtgaacaataattaggtgatccatttctgggtaattattttttaaaaacagatgttgcaactaggagaaatcggtttgagttaagaacggttggagtcgtctttatggaaaagataaaattcagtcgcagtctagagggcagatgagcccaggggatgaatgaagatattgttgggagaacaaggatgtgttatgacaaaatcacagaaattagcatggtgtgtaagtttaacggtaaggaaaatgctgtgtatgtgtgttcggggcctctctatgtataaaagtaatggaaaataaagttgagtaactcagtattggcatatgattagaatatgtatatttgatcattttactgtaattgttatactttgatctcctttagcagattaaccctttattagctcttaatttgaaacagaagaatttaaaattgctctgataaatgtcagctattttgtgggaatgggagttgttagtagtaggaattgaagtgggagatattagtaataggaatttacctaatacgtgttcagtaagtcaaaatttgcatgtatgtttctacttttctaggacacttctacatatgctatttatttgcatttttttgaaaacccttcttagggaggcaggatgggcattatttttgttttatacatgagtaacttgagaagcaggttttttccacttctctcagattcactcagtaataagttctggctagaagccacatctttcatgtttaatgtttggtggaaactagagtagagaaaacgtttcaagtgaattttttttattatcatgaaactaacatttgacagtgtttataaattaatttttaaaacacatagatttaaggaaaacaatattaaaggaaaagtagataagaataaggaaagattttctttgtaattgtatatgaatgtttccattttattggaatgtttagatatttttagaaaatgtaattgttcttatatgattgattttacatgtaaaaaaagaagtcattgcagataatcataataagaaactgaaacttaggacatattttcattttttaaaaaaatgtattctttcttgtcaacttttattttagattcaggggtacatgttgttacctgggtataccaggttgttacctgggtgtgttgtatgatgctgaattttgctgtatgattgaatatgtcacccaggtaatgagcatagtacccaacagatagtttttcaaagtttgtctcccacattccctccctaccccctcttattttcaccagtgtctaacattcccatctttatgtctatgggtacccaatgtttagttcccactttgcttgtggtatttggttttttgttttggtttttagttttagtttttttgtttctgcattaattagcataggataatgtctcaaaatgcatctatgttgttgtaaaatgacataatttggcctttttatggctgcatagtattccatggtatgtatgtaccacattttctttatttcttttttttttcctttaagttcatgtgcagaacgtgcaggtttgttacataggtatacatgtgccatggtggtttaccgcacctactgatttgtcctctaagttccctcccctcgccccccacccaacaataggccctggtgtgtgttgttcccctccctgtgtccatatgttctcattgttcaactcccacttatgagtgagaacatgtggtgtttggttttctgttcctgtgttagtttgctgaggatgatggcttccagcttcatccatgtccctgcaaagcacataatctcattcctttttatggttgcgtagcattccgtggtatatatgtaccacattttcttcatccagtctatcactgttgggcattgaggttggttccatgactttgctgttgtaaatagtgctgcaataaacatacgcttgcatgtgtctttatagtagaatgatttataatcttttgggtatatatccagtaatgggattgctgggtcaaaggttatttctggttctagatccttgaggaattgccatactgtcttccacaatggtggaactaatttacattcccaccaacagtgtaagtaattgtaaaagtgttcctatttctccacagcctcagcagcatctattgtttcttaactttttaataattgccattctgactggcatgggatggtatatcattgtggttttgatttgcatttctctaatgatcagtaatgttgacctttttttcatatgtttgttggccgtgtacatgtcttctttcgagaagtgtctgttcttagcctttgcccatttttgatggggttgtttttttcttgtaaagttgtttaagttccttgtagattctggatattagacctttgtcagatgggtatattgcaaaaattgtctcccattttgaaggttgcctgttcactctgatgatggtttcttttgctgtgcagattctctttagttcaattagatcccatttgtcaattttccttttgttgcaattgcttttggcatttttggtatgaagtctttgcccatgcctatgtcctgaatgatactgcctaggttttcgtctagggtttttagtatgttgggttttatatttaagtcttaaatccatcttgagttaatttttgtttaaggtgtgaggaaggtgcccagtttcagctttctgcatatggctagtcagttttcacagcaacatttattgaataggagatcctttccccattgcttatttttgtcaggtttgtaaaagatcagatggctgtagatgtgtggtgttatttctgaagtttctgttctgttccattggtctatatgtctgtttttgtagcagtaccatgctgttttggtgactgtagccatgtagtgtagtttgaagtcaggtagtgtgatgcctccagctttgttctttttgtttaggattgtcttggctatacagggtcttctttgattccatatgaaatttaaagtcgttttttcttcttctgtgaagaaagtcaatggtagtttgatgggaatagcattgaatctataaattactttgggcaatatggccattttcacaatgttggttcttcctgtccatgagcatggaatgttttccatttgtttgtgtcctctcttatttccttgagcagtggtttgtacttccccttgaggagcaacttcacatccctagttagctatattcctaggtattttattctctatatagaagttgtgaatgggagtttattcatgattttgccctctgcttgtctattgttggtgtaaaggaatgcttgtggtttttgcacattgattttgcatcctcagactttgctgaagttgcttatcagcttaaggagttttgggctgagatgatggagttttctaaatgtagattcatgttgtctgcaaacagacacaatttgacttcctctcttcctatttgaatacccttacttctttctcttgcctgattgccctggccagtacttccaatactatcttgaataggggtagtgagagagggcatccttgtttttaaccagttttcaaagggaatgcttccagattttgcccattcaatatgatattggctaggggtttgtcataaatagctcttattattttgagatatgttgcatcaatagctgttttattgagagtttttctttatccagtccactgttggtaggatccttggttgattccatgtctttgctattgtaaagggtgctacaatgaacatatgggtgtcttcttggtagaatgatttattttcctttgggtatataccaagtaatgggattgctggattaaatggtagttctatttttagttatttgagaactctcctaactgctttctatagtggctgaactaatttacattatcaccaacaatgtttaagtgtttttgaaccattgcccctttcctctctcccatcttttgtattatccagcatctattgttcccatctttatgttcatgtgtactcaatatatatttcccactataagtgtgaaaatgcagtatttgatttgttctttctttattaattctcttaggattatgtcctaatggataatggatagtgacctaatagcctaatggataatggtccaagttcagagtctcatctgagacaagggaaatcccttccacctagtgcctgtaaaaccagaacaagttagttacttccaagatacaatggaggtacaggcattggttaaatatacccattccaaatgagagaaattggtcaagggcctacaggccccatacaagtccgaaattcaataaggcagtcataaaccttaaagttccaaaatgatctcctttgaacccatgtctcacatccaggtaacactgatgcaagaggtgggcttccacagacttgggcagcgccactcctgtggctttgcaggctacaacctccctcctggatgctttcatgggctggtgttgtgtgtgcagcttttccaggtgcacagtacaagccgtcagtggatctaacattctaaggtctggaggatggtgggccccttctcacaactccactaggcagtgccccagtggggccactatgtgggggctcctactccacattttccttctgctctatcctagcagaggttctctatgaggactccacccctgcagcaaacttctgcccggacatctaggcatttccatacatcctctgaaatctaggcaaagtttccaaaactcaatttttgttttctgtgcacccataggaccaacaccatgtggaagcttccaaggctagggatttgtatcctctgaagcaacatcttgagctgtaccttggccccttttagctaggtttgaagaggctgggacacagtaccgaggctatacacagcaggggggccttggacccgacccaggaaaccatttttttctcctagccctctgtgcctgcgatgggaggggctgctgtgaaggtctctgacatgccctggagacattttttccattgtcttggtgattaacattgggccccctgttgcttattcaaatttctgcagcctgcttgaatttctccccagaaaatgggtttttcttttctatcatatcatcaggctacaaattcccaggcttttttgtttgcctcctcttgagcactttgtcacttagaaatttctgctgccagatatgctaaattgtctcactcagattcaaagtttcacatgtctctagggcaggggcaaaatgctgccagtctctttgctaaagcaagagtgacctttactccagttcccaacaagtttcttgtctccatctgaaaccacctcagcctggacttcattttttacatcactatcagcattttggtcaaagccattcaacaaatctttagggagttccaaactttctcacatctgtctgtcttctgagccctccaagtctctgggaagttccaaactttcccacattttcctatcttcttctgagccctccagactgttttaacctgtgcctgttacccagtttcaaagttgcttccacattttgggtatccttatagcagcaccccactctaccagtacaaatttactgtataagtctgttctcacgctgctatgaagagatacctgagactgagtaatttataaagaaaagaggtttaattgcctcctcacagttcagcatgcctgggaaggcctcaggcaacttacaattatggtagaaggggaagcaaacatatccttcacatggcagtaccacggagaagtgctaagcaaaagaagaaaagccccttatagaaccttcaaatctcatgagaactcactcactatcacaagaatagcatggatgtaaccacccccatgattcaattacctcccaccggatccctcccgtggcacatggagattatggaaactacaattcaagatgagatttcactggggatgttgttgcatatgagatgggtttcttgaagatagcagatggttgggtctagcatttcatccaacttgccacactgtagctttcaagtagggtgtttagatcatttgcattcatcgttaatagtgatatgtgagaatttgaccctgtgatcatgttattacctggttgttttgtggactcgattgtgtagttgctttatagagtctgtgaactatgcatgtgtgtatgtttttgtggaggcaggtattgttcatttgcaggtttagaactcccttaaagacctcttgtaagactgttttggtgataataaattcccttagtgtttacttctctggaaaggattttatttctcctttgcttatgaagcttagtttgacagaagatgaaattatctgaaatttttttaatgatatgaaaatagacctacaatctctttttgtttgtaaggcttctgatgacaatcctgctgttattttgatggggttctttttgtaatagacctcacccttttctttagctgcctttaagattttttctttcacactgactttggaaaatctattgaatatgtgccttagagatggtcttcttatatctcataggggctcaacaaatttcttgaatttgtgagttgacctctttcatgagattgggtaaatttttatgaaatgtattctcaaatttgttttccaagttgcttactctctttctctcacaggaatgctattgcataataggcttggtttatttacataaccctgtatttcttggaggttttctttctttaaaattttttttaatttatatttgtcttactgaattggttaaaaggaccagtattttcattctgagattatttcctcagcattgtctattctatttttaatgcttctaattatattttttaatttctctagtaagtttctcaattccagaagttcagttttgttttttcttaaaatgcttgtgttgtctttctactcttggattattttactgctgtctcggattgggtttcagctttctcttgaatcgcattgagcttccttgttaccaagattctgaattctatgtctgtcatttcagccatttcaatttggtaaggatccattgctggagtgctagtgtgattgttttgaggtgaggagatactctgactttttgaattgccaaagtccttgcactgattccttcttatctgagacggttagtgttattttatctttcagaagttgctgtcatttggatgaggcattttgtttttatattctttttctctctggagggtgtgactgtagtgaatgttttgtattgttaattggctttgtttctgggtgctttcagagggttaagcctctgtacaggttatttaattatagctagatctctacattgtatttcacaggcagtgtgtggaaggcatttttgtttggtggtgtaattcagactgcgttccattagatggcatttaagaataagagtcagcaggtatgttcttattcaactgtgtgccttttttgtatttcagtgcatttgtgtagtgttccaggttggaggagttggggggaatcaggggatgactctctcaccaagttttcattcctgggacttgggggagctccctgtagtctctggtgctgtgcccacatttctttagctccaagggaggcctaggctggcagtgctgtttcctcccatggagtggcctgagccaaaggttaggttggcaggagacccgtagtcccctaggggcctgctatacctctgtacttgacagagtcagagagggttgtggggtatgtctgctggtggtctgttgattcagtcggtcagaggtggaggatcccaggaagggcagtgttgctgtgggtgtgcagctggtgtggtacccagggcctagagttttttgcccagagattgctgtctggacttcccagcttgtgcttgactgatcaggtctccttccagtgtctgtcccagtactgagcttgcccagctagttttgtcccaagccttttgttctccgattgcttgtctgttaggtgctgcagggcatggagctccctcaggcagaggctgaggatggcagataggccacacccttcctagattggtcttccagagcatggtatacccagctgctgtgccatcccatgatcccacacctcagtcttctctgtggtctgagagtgagggctcctctcctgcttgagctcaagatctcagctcaatacccctgagccgtgtgttcaaattctagggagttgagaccaggcatgcagctttgtccttctgcccatctgggtcagatactacctgttctgcgggagggcaaagcaattccagactaatggcgagacactcaggtggggcagtagaggttgcattgtcggcatgctcttgatggagtggtcaggcaggggctttgagggtggtcaatggacaaggggatgtgcagaccagacatgcccctttcccatgggaaaaacagccctgtttcctgcaccccctcatgcaaaatcttctgagttcttctcagatttgagctctgcctctgcttactctccaagcagttcccctgccgattcaaatgttttttggggtcacaggatctctcatagctaggatctcagaggtctgtggcaggagtgtggtgtcccgcagttcctttattcacttcttccttaggacctgttaagggctgagagccagttctggtgctcagcaactttgtgcagcttcctccctcttcatcctcagtgtttgtgttgcctctctgtggactttcagttttctcccagaggatctgcttgaggtgtgatggttcactggatattttggtttctcttggttggagagttgcttcttggctgcatctagtcagctatgttggccccccaactccaaattttcatattaaccttttaattcaacttgctttgtttttgcatgtatgtttgtgtgtgtatgtttgtgtgtgtatgttttgtgtgtatgtttttgtgtgtatgttttgtgtgtatatttgtgtgtttgtgcatttctttatgaatggctaaatttacttaatcagcttggttatacagtcaattcgaatgagccattgagaactttggataactatcactggtttctattgaataaacaagtattaaacatgtaggtgcattccaaaatgtctttagcaaggaaatttctagagataacattccttatcattaaatggctaagattctatatggtaagttatgttttgtaagtggggcaactaaggccagataccatgctctgcatttttagtttattatatctaatgtttatagttttctaacttaggtagatatatgcttattttataaatgaagagcttgagtttaaagcaaataggtgacttgttcaagaacacagagataaattgaatctatacttttttttaacttatatgtataatagaaaaaatccataacaaaaagctttatataactggcaggtgacgttttccaacttttggttaagctgagtaacaaacagtgagttccccatttctgctaatgttttagagaggttgggtgatcatgtgataaagatatattagtgagattcatatagtggatacgaaattattaaaaaataacctctaagttcaacttcaattctaatattttatcagtttatcgccatgtcaacataaaggtacagttgaagctactgttttaatttttccttgttttaggaaaccagttgatacattgttctagacctttcctagggaatggtgtcagctttcacagaaagttgtctgcttttcatttccagtcaagaaaactctagtgtttgacacatagctctttgctctttgatttgattggccatatggagttgttaaaacatttaaaagctgatctcaattggactttcagttgataacaccttggtatcctcttttgtgcagtcataacccatgccagttttcatgagcttgaacattcattactgggttcatgacccaagccattagcccatcactgccatgcacttgtcaacagcatctgaaagcatgaagcttaaacctatctggtctctggtgttattcaatttgtgagtgaaaaaatcacacactacctagttaatgtgtgtatatatttttcccttctcctttgaatttgaatgttctctgggttttctaccattaccagtaatgctaattatttaatttgtctctgtcacccacatctgtgataaaatagtttgtttgcacattgtactccttagcttttaatttctccaagatcctattatatttaaaagatttaaaaatgtgaaatctcttaagtagagaagtcactaagtccttgtagaccataaggattgcctgctctcctcagactcatggttaagtggcatcagtggtctgaaccattcagctgtgttgttctctaaggcccaaccaaccaccaaggtagagaaggaacatatctgtgaatcagtgtacagtacctgaaatgggaaggttagttctgtgtctaggagacatggtgcgcaagttacttgacttctgtcagtggccatatcttcttcacctataggactgagaggataattcctcttatgcctttcttctaaaggcattgtgagcatcacaggcctatgctttctaaacattataaaccacttaaaacattcttgactccatctcttattgaataaaatttatttttcatttctctagactctatgactttgggcaagtcaaccagtatttctgggcattagttttgtcaaagcacctgagtgataaccacagttatttattgggagttgagtatgtgcccatcatcgggccaataaggtttggttaactgtatttattcctcatgaattattttcattgccttcacttgatggctcaggaaatggagcagagagagctcggtaacttccctaggctcacatagctagttagtagcaaaggtggaggtagatgcttcaggtcattaaataaggtagcaaaggtggaggtagatgcttcaggtcattaaataaggagggattaaaatatttcatggaattatcctaggtggcgtctaggttcaaagaatgtaaaatgcagagaataaaagatctgctttttttttctttgttttggccaacttttttcaccagcctgtatttcctctcctttctttcttatctgttttgaaattccaattgctgccttcactttggcagggtagatgggggtggttagagttgccttccctactgtgcttaagttcttattgtgtaaagatcctgtaactcgctaaattagcttaaaaagctctggttttgttttcgtgccagcatattacctcaccacactatcactttttaccctccaagacttgccataccaagtggcagtgctcaaatcacataaagaggagccgttgttgcttgttcgctagtacgtgggtttgtatccccaaaccatgtcttttttacatgatactaattttgtctggaatattcttatttttccatacaaaaagcaaattcctgcttttccttatgaaacatcagtcagttcttctgtatactcaaccatgactttcccagacatcttttttttttttttttcctttaagttgccagcatgacttttatgcttagcaatgtttggattccatgttcctaaaccgaattttctcagagcagggatgctggtttttgctttctgcattttcagcatcaaacacagtatctagcacgtagttacgctgttgtttcagcaaatgaattactactttggtacaacagaccctaattttaatttgaagattgacacaattgtgaaggtatactaaaaagttttcttgaaattttagatgaaatataagtagtagaggatattttttctccttccaaaaattaaagagaagaaaatcactcagcttaattttcgtttaacaaaaaagaaccaaagtgttatgactaacactgtcacagagtatggtgtgattactgatgatcaaacttctgtagcaagttacatgtatatataaagactaatactgttcttccaattactaaggtaagttcttagaagtaaaaatatttatgtttagattcctgaaatagtcactaatcatgaaactgtattgaagcaaaccaaattcctggaactagacagactgtgatagaatccagtaggctgatggaggtactctgcatgacagcggggcagatggatttgctgaaatccagtgttgcccaactacaaatctgccataaaagaaaaatgcaaacatggagacttttaaaataggaataatttggactctcacagaggaacattttcaagttatggtttaggtgggcttcttagagccatcctagattccaagaactaaaagtaactgcagacatcaggcagagatggtccaagttgtcaagcagaaaataaatgcattactcaaaacatgccatctcttcataagcactcttagaatttccatgtttaagaatttatttttttttctaagactgggattctttatatgaaagtatttttttttctccttggttttttaaacatctcaatacaatggcaattaattctggaaagtcaaaaccagaaagcgttttagagagtcttccttactttgccataaggtatttaagatggaagtctgttttagtttttcatagatcttacaaggcccagtccagtgcttaaaacattttaatgttcaattaattttatttgagctaaattggattcatatctactgctcaccaccatccacaagcatcatttcaaacctgtttgggaattaaaataaatgaatcctgggatgactatggtttgtctcaaggtcaaaagctgtgacagagctagatttaacatcaacagattccttcttatttatgttactaatgagtattaatatatattactgaactttttgaccttctgtaatgaaaatttctgattatagatttattttgttatgctaaaatatatgcaattttaaagaaaaaggacaccatcagtggttggcagtcagagccagggattttcttgagagctgatactgaagtattattgaaatgatataataatatattattgaaataatattttttttccattttcttcccaaaggatgcctataatgctctggatgactctccactctcagccttttatatctagcacctcattcctgaaaactttcatctcttttcactattccatgtattctgacagcatccgaaatttaccttacattacttatatcattttcttgtgtataggaacaattctactcattaataccaccactgctgctattgaaattttggttctatgaatatctcaattatattccttcttctttactttattatatagcctttttgtcctggtttattccttagagttttatgctttgcttatatacaatgtacattgctatgtatgtctttaagttagtgtacagatttttaactgtcttaattgttttagaaaaatatctagtcttccaaaagtagatcaatatcagttaattggcttatctaccgagtccttaggatgatgttgtatttgtcttcataatcattgatttatttgttcctgtttgtctttgaaggaaggtctgtctatctagactcagtgtttatttctcttgactttgctgggtcttccaaggtccacacatccacaggtgcagttgcctagctcccagctcacttctcagtgtctaatcaaattccaactgttgcattcctgtaataattgatattgtgtctttacttatcgctccaattcttaccccttcagcactgaaaacagatagtgtacatgaaaaatcacattgcacccccagcagtatctttttaggaagatcggtgttggtcatgcccaagacaaaactccttagttgtagggaccttatatcccgcaatatgtggaatccatcactatcttcttaacccatcctatatacgaagatattttctgcaatttgacgtccctaatagatattgtaagagagacactatagggaggagagggttggaaagtaaaggtcacatactttaagtagtacctaagcagcagacagaccgcccataattatctgataaatgcagccatttgaattttagatgtaatggacagacagtcagacaatagtaccatggcatagagttttttttattttggttttgattatgtttgtttgtgtgtgcgtgtgtgtgttgtttttaaactactttttggcaacatagcctggtggtccaaatgttgggatttttagttaaattctagaaaatatataggtcacggatgttcttcccagtgtcttaaaggttgacggttctagttttcagtgtaatatgatgtctactatatacaactatatatgtctttattaacaatctaatagagcttttggagagcatgtgacaaatacagctaaccaggcacaattttaatattaactatcatatgactttttacttttttacgttttaaagccaactttttctactttctttatacttttctaagtgtttcaaattattaaaatatgtcttataatttttaaagatcctaggattaataaatcactgaaactttaacgaggtgcaatatcaaggcagtcttttgtttcagaaaatgattacaattattaatgaataacaagcactaatacaactttgtacatctttttgttatgtgtatgactgacatttatttatttgaggttatggtaaaattaaaattctatactatatctaataaaactagttttagtatttgtgcaaacagaagttgacatttgatggagatgcaaaaggaaaaaaatactcattattctaggttttagattggaatctaaacatttctaattgaaaacagtttaggaattaaagaaaccttgtcctagttctgccttcctctggtgtgtgtttaggttcatgtcccttaatctaagggaaattagatagctaaaagtcatcagtgaattcagcacacctttattttagcctttgctgtaaattaaggtctgtgaccattattgaaggtttacctgaactccttacaatattagttttccatttcttcttgtcctgagtttgtgctaacaaaatcatacgaagaaaaagagaagaaaggccgaaattatgacagagagagaaatataggatagcttctctgaataaagcctaagcctggggacaggaagtctacagtgtgccatatttctctcctttccttctggtagcccctgggggccattgtgaaatctccagggagtccaggagcacaggatagaaaccatgacatgggaggttattgtgagattaaaggatgtaatatatgtgaactagtaatatgcaaactttacaaatgtaagattcagtattattttactttctatcaatttaatgtattttaaagtagtcatcatcttttcccaatgtattatttattccacatatttgaagcaccatatcatatcacacttatccttaattgtcttcaggtttgcagtatttaaattaaatcactaattcaaattgaaaaatgagaggaactattagtttgtagaaatgtacttattactagattaaagtgtggcaattccagttttttcacgatcaagtgactatgtggtataatatgttttcatcaaaaggctgcatgttattatgaatttttaaaagagtgtgatagtcggctccttttttaaatttaattttaattgaaattaattttaattttaattttaatttaatttaatttaattccaaaatattttctttaaataaaatttgacatcatcatagaaaattatatgatatcaacaaacttcttttctatggtaatattactgtatggtaagtttatatctcattatttctgtgattgctatctgcgctttattttattttctcaagaaaattgaccattttcactaataatataatttactttaagtaaaggataggctctgcatatattaacagagttgtttgagttccagctttcattgaaatgatttcctgagaattgattgcatgccggatgctaatctttactacaatagctgaaaattcacatttcaatatatctaacagcaaatgatcagactgctacccagacagtgtgattcatctatagccatgttaggctgaaagtataaataaatcaataacacacactggtgataaggaaatgttctcaaaagtacatgaaagaaaacaagattatttcataaacaagtctatatattcacaacaaaggagaaagtagaagtttagattattataataaaaaaggcatctgctttatgtataattaaatagtttttctatgagtctgtaaaaacttttacacgaataattgccttatttttcctttgtagttatgattacttaaatatcaatttattaaatgcctgtcctgtgccacacctatattcagtgttagaaagatgaatgagggattataactgaacttaagggtgagataaagctgtgggcaaatatttccagtaaaatgtttgggtgttacgtaatactggaaatctgtttaagacaagaagtataacagcggaaagatggactttctgtggtggaggctttacaaaggaagtagagctttagtagggttttcaagaataaatagaaagtgtgaaatgacaaaggatgggccagagacattccagattgaggcaacaatagtcttcacagtacagatgtggccagagtgctttctgctcggtatttgagaaatgtcttatttctctcttctatgattcaatttattggctgattattctgcccaagccaaaaaatatgtataacttctgtttatgttaatccttgtaaatccatctctaatgcacagagagctgcacgtggaagaaaatgtgttagatcagttttcagatttgactgtacaaaaacttgggttctaaagacatgtctgtggagctgtggaaggaaaagctgcatgaaggctttcctgattccctgcttcaaccagaacagtctcactttaaattggttttaatattgagatttctcatttggaataaacaaaaacattgaattgcaaaaagaaaatatgtttaactgaaatctcctatcaaagacagccttgtggtcgcttttcttgtttaatctcttgtagatgacagaaaaattgagagcttgtttatagacttgggaacacttaggctttgaaatccatatttacttacttgaaggtcagtcatttttgccccctgatgattttagaaaatgtcagggaaacaggcacagtaattgatcatattaggatggagtgaatccatgaagaattgacagcttgatctcgaaagctgtagtgtatgtatgaggatttgtagagaagtagaaaataagtaaaggcctggagaaagcagagtaaacatagagtagaacctgtacagagtcaaggactggtacactggtctcaattctactctttataaacaaaataaacaatggaaagttacggtttaattcctggattacatgatggttaaaatggaaggatagtttttaacaagaaggtacatttaaacaaacaaggactccagggtactcagattcttcatctgcctattttactgtctatttcatctatttctgggaacattatgtacagaaaatataagattaatccaattttagcatgtatcagaatcacctggtggatttgttaaaacatgaactggtaggccttgtccctggaatttctgattcagtaggtttggggtacgcgttaagtattggcatctctcgttaagcgccaggtgatgctgctagtcccagaactaactcagagaatcactgagataaacaaactgtataaataaattcctggaattgagtgtcttcttcaaataaaaacaaaataactcccatttttctgcccaaagagttgtgaaggcctttgttattgaaaacattaaatgaattgttaaaaaattaaaggtttaaacattttgcctaaatgaatattatagtgctggctacatttattttaatgcatttttggggatcgtacaacatctgctactggtatttcccacaaaatttgacctgtgtttcttcaactcttaggtttaccttagtctacaacttttgctttcacccgcccgtcatgtgaattttaaattttacattttgattttcaagttgaactttcatgttgaactgcttatgcttctcaaattgctcctttttctgcaatttaagtataatacaactggatgaaagaaggagtctcttacaaaatgtagctcatagctcataaagatatttgcaaactcaccttttttaagaaacaacaaatgtaggcttttcaataaaatacgtgaacttgagctctttataaaacaccacttgaagatcattgactttgaaacaaactaattttactttattgaatacctttttcccttcttcaaagatttccaatgctgtatattgattgttctgcccttttcaatgtcattttgtttttcttgctgcaaaaccatactctgagttacttaaattgtatttatcattcccagtattatttttttctttagcacaaacccaaacttattaagaatgctgtgatgttaatttcagaagaggatagcactaaaggcagaataattctgatatccaaatatttttataaataacatttgaaaaacagtatatattttggtttagtctactattaatagaggaaagttatagggaaacatattttgttctaataagaaagaatatctaaaaaaacagagcaggaaatcaattaaataatttgctgatactttcataaatgtcttcaaattatgttgtgattaatacttataagaactatttttcaggaggttccagaatagagtgagtgttcatctgagaactcatctgatccccttacagttctaacagggactttatatgctaatttttctcctaatgatggttttctatgtaatgtaacaagtcttaaagttttcttaaatattcatgtattaaagtgtataaaattccttggagtgttttattttagagactttttcattaatagatacaattttgttgattatagtttaaatggaagggatataagtcaaagaaatattattctcaatatgaattatgaaaggagaacaactttaaaaatacttcataatgaagtaagaaaaagagtacatgaaacatcttttgggtttaaagatatgaacaagtgatttctggtgatttttttctttttaattgcaagtctgtttggctatttctttggcttctgagcatctcttaagagagtgaatgaaaaggtaatcattaccctttagaggtaaaaaaagtctctgcaggtttcatagaatctatttgatttcaataagcattaaaatgtgttgtaattttgcagggtatctcattgaatgtagagccaagattgattctgttgagagctcaactagatgaaaaacgtagccagtatgaaacactcttaactggctcacatccttgcagtgggactatcacacacccaggcacccttacttgcggtaactggctactgattcagcaactgaatgagagaaaaagattcttaatgaacctggatcagagaccagattgctgaccagctcctggagttaataatccatcatatgaagtaaacacataaccatcactgaagttagagtaatgtaagcgttgcacctgacagcagtatggtgtagggagaatgagtgcagttattcctggcaggtttgtactggaatcttagcctagatctttactttgactttatgccaattatttaacttgcttttgtcactgaaaatagaaacacaatcaagacataatatctaccttccctcaaggaatttatggaaaacatagtcagttgttgatgctgtcaagttattgatattgtgataaatattatgcacaattacaatagaggtttgtagagctacggtaagaatagtatagtctgcccttggaagccacaggagggttgcctaatgaaagagatcagggaaagtttcctggaggatgggacatcttagctgaacatagtaggaaaagtagaagcaatagctctttagtaaatatgcattcagtgcttgtctcttacatgtcaaacactcagataataacaacataaatgaactgtttagtaggacaattccaatgcaatagaaaatcttactatgcatcttccttcagacgagaacatagatgtttagggaggtcttataagatcattccttgtacagtgccttgaagctgagtggggagtcaaagttaacatttatctaaccctgtgtagtgctctacagaatgttagaatagtagatttgaaagtcttttctattaagattatattgaagctttggaaatgaatgagaatgctaattgatcataggatgaaggggaaagaaatctgagcatatattataccagagggattcccttcccataggaagtaagaatatgaaaaaggagctcaaaaaataagtggaaaaactcgaaaaaggaagaatgttttcaaaagagcatagtcaataggagtagatagtccataagttaaaatggtaataaagttctgatggatttatccttttgcaatttactagttgtattcatccattctcatgttgctacaaataaccacctgagactgggtagttcaggaagaaaagaggtttcattgactcacagtttcacaggcttaacaggaatcatgactgtgaggcttcaggaaacttacaattcgggcagaaaatgaaggggaagcaagcatgtctcaccatagccaagcagaagagagagagagagagagagtgaaatggggcatgccaaacatttttaaaccatcagatcttgtgagaacttactcactatcatgagaaaaacaaggcggatatctgcccccatgttccagtcacctcccaccaggcctctcttgcaacacatggagattacaattcaacatgaaatttgggtggggacacagagccaaaccgtatctttctgccactgggtcctcttaaatctcatgtccttctcacatttcaaaaccaatcatgccttccaaacaatcccccagtgtcttaactcattccaggaataactcaaaagttcaagtccaaggcaaatcccttccacctaggagttacttctaagatacaatggaggtacaggcattgtgcaaatactcccattccaagtgggaggagacatggatctcctttgattccatgtctcacatccaggccacactgatacaagaagtgggctcccaacatcttgggctgctcttcccctgtggctctgcaggatacagccctttggctgctttcataggctggcaatgagtgcctgtggcttttccaggtgcatggtgcgtgctgttggtgggcctagcattctggggtctggaggacagtggtctttttctcacagctccaccaggcagtgccccagtggagactgtatgggtgttccagcctcacatttgccttctgcactgccttaggagaggttttccatgagggctccgcacatgcagcatacttctgcctggacatccaggcgtttccatatgtcatctgaaatccagacagaggttcccaaacttcatctcttgtcttctgcacacctgcaggcccaacaccatgtggaagccaccaagacttgaggcttgcaccctctgaaccaatgatctgagctgtacattggtttcttttagctatggataaaactggagtgctgggatgtagggtgccacgttccaaggctgcacagagcagctggcccttgggcctggcccaggaaacaaatttttacctgctaggcctctgggcctgtgatgggaggggctattgtgaagatctctgacatgccctgaagacatttttctccattgtcttggctgttaacatttggcttctcttcacttatgcaaagttctgcaggtagcttgaatttcttccaagaaaatgggtttttcttttctactatatggtcaggtcacaaatttcccaaacttttatgctctttttcccttttaaacagaagttctaatttcagaccatctctcaggaaggcatatgactgtatgctgttaggagcatccaggtcacatcttgaacgatttgctgcttagaagtttcttccaatagatatcctaaataatctctctcaagttgaaagtttcacagatccctagagcatagcacagtgctgccagtctctttgctaaaatatagcaagagtgacctttgctccagtaaccagtaagttcctcatttccacctgagatgacctcagcctggaattcattatctgcatcactatcacccttttggtggaaacaattaaacaagtatctgggaagttccaaactgtaccacatcttcctttcttcttctgacccctccaaattgctccagcttctgcctgtttcccagttccaaagtcacttccacattttcaggtatctttatagcagtctcccactctgctggtaccaattttctgtattagtttgttctcacactgctataaagatctacctgagactggataatttatgaagaaaagaggtttaattgaatcacagttccacaggcttaacacaaatcatgactggaagatgtcaggaaacttgcaattatagcagaaggtgaaggagaagcacacgtcttaccatggtggagtgcaagagagagagcaagggcgcagttttaaaccatcagaactcatgagaactcactatgatgaaaacaacaagaagaaaatccacacccatgatccagtcacctcccatcagacccattccccaacatggggggattacaatttgacatgagattaaggtggggacacagaaccaaaccatgtcactagtagtgcttggtataagaatattcattaggctgttgagtgttaaagcccagaaatgaggcattagtgggtgaatgttgaaagcgggagctgatgcagtaaatttagcccactcttgctaaaattgtcttggtggagctatagatggaggcagcaaggtataaaacaaatattcatttgtctgcttgtttgtttgaagactagagactttttaaggaattgcttctcttgttattgttaaaccattttgttataaattttatgagatctaatgggaatggtaatatacagcctagaatacgaatttcaaaattataaatataatgattgaatgttatgtatgaacactcagaagaattttgagttttgcccttcatgttaggaaaaggtgtaatttcacaatattcccttcaaagattaaaaagactgggtttagagtattgtattaccaagtggagggataatctttttttttccctttccttttgtgctgctcttccaagatggcattcagaatttgaatttcaccagtggacacttgttgattctaatagtccctttctttttttttttaaattttatttatttattattattatactttaagttttagggtacatgtgcacaatgtgcaggttagttacagatgtatacatgtgccatgctggtgcgctgcacccactaactcgtcatctagcattaggtatatctcccaatgctatccatcccccctccccccaccccacaacagtccccagagtgtgatgttcctcttcctgtgtccatgtgttctcattgttcaattcccacctatgagtcagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggattgctgggtcaaatggtatttctagttctagatcctggaggagtcgccacactgacttccacaatggttgaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttgttttgagaagtgtctgttcatgtccttcacccactttttgatggggttgtttgtttttttcttgtaaatttgtttaagttcattgtacattctggatattaaccctttgtcagatgagtagattgcaaaaatttcctcccattctgtaggttgcctgttcactctgatggtagtttcttttgctgtgaagaagctctttagtttaattagatcccatttgtcaattttgtcttttgttgccattgcttttggtattttagacatgaagtccttgcccatgcctatgtcctgaatggtaatgcctaggttttcttctagggtttttatggttttaggtttatcgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgcagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtaattggtagcttgatggggatggcattgaatctgtaaattaccttgggcagtatggccattttcacgctattgattcttcctacccatgagcatggaatgtccttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgagactttgctaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgtcagttttcaaagggaatgcttccagtttttgcccattcagtatgatattggctgtgggtttgtcatagatagctcttattattttcaaatacatcccatcaatccctaatttattgagatttttagcatgaagcgttgttgaattttgtcaaaggccttttctgcatctattgagataatcatgtggtttttgtctttggttctgtttatatgctggattacttttattgatttgcatatattgaaccagccttgcatcccagggatgaagcccacttgatcatggtggataagctttttgatgtgctgctggatttggtttgccactattttattgaggatttttgcatcaatgttcatcaaggatattggtctaacattctcttttttggttgtttctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactttttttggtaggtaagctattgattattgccacaatttcagatcctgttattggtctattcagagattcagcttcttcctggtttagtcttgggagagtgtatgtgtcgaggaatttatctatttcttctagattttctagtttatttgtgtagagttgtttgtagtattctctgatggtagtttgtatttctgtgggatcggtggtgatatcccctttatcattttttattgcgactatttgattcttctctctttttttgtttattagtcttgctagcggtctgtcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgtcagggtgtcaattttggatctttcctgctttgtcttgtgggcatttagtgctataaatttccctctacacactgctttgaatgcgtcccagagattctggtatgttgtgtatttgttctcgttggtttcaaagaacatctttatttctgccttcatttcattatgtacccagtagtcattcaggagcaggttcttcagtttccatggagttgagcggttttgagtgagattcttaatcctgagttctagtttgattgcactgtggtctgagagatagtttgttataatttctgttcttttacatttgctgtggagagctttacttccaagtatgtggtcaattttggaatcggtgtggtgtggtgctgaaaaaatatatattctgttcatttggggtggagagttctgtagatgtctattaggtccacttggtgcagagttgagttcaattccttggtatccttgttgactttctgtctcgttgatctgtctaatgttgacagtggggtgttaaagtctctcattattaatgtgtgggagtctaagtctctttgtaggtcactcaggacttgctttatgaacatgggtgctcctgtattgggtgcatatatatttaggatagttagctcttcttgttgaattgatccctttaccattatttaatggccttctttgtctcttttgatctttgttggtttaaagtatgttttatcagagactaggattgcagcccctgcctttttttgttttccatttgcttggtagatcttcttccatcctttggttttgagcctatgtgtgtctctgcatgtgagatgggtttcctgaatacagcacactgataggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttgtccgcaaagtattttatttctccttcacttatgaagcttagtttggcttgatatgaaattctgggttgaaaattcttttctttaggaatgttgaatattggcccccactctcttctggcttgtagagtttctgcctagagatccgctgttagtctgatgggcttccctttgagggtaacctgacctttctctctggctgcccttaacattttttccttcatttcaactttggtgaatctgacaattatgtgtcttagagttgctcttctcgtggagtatctttgtggcattctctgtatttcctgaatctgaatgttggcctgccttgctaaattggggaaattctcctggataatatcctgcagagtattttccaacttggttccattctccccgtcactttcacgtacaccaatcagtcgtagatttggtcttttcccttagtcccatatttcttggaggctttgctcgtatctttttattcttttttctctaagcttcccttctcacttcatttcattcatttcatcttccatcactaataccctttcttccagttgatcgcgtcggctcctgaggcttctgcactcttcacgtagttctccagccttggttttcagctccatcagctcctttaagcacttctctgtattggttattctagttatacattcttctaaatttttttcaaagttttcaacttctttgcctctgctttgaatgtcctcccatagctcggagaaatttgatcgtctgaagccttcttctctcagcttgtcaaagtcattctccgtccagctttgttccattgctggtgaggaactgcgttcctttggaggaggagagacgctctgctttttagagtttccagtttttctgctctggtttttccccatctttgtggttttatctacttttggtctttgatgatggtgatctacaggtgggtttttggtgtggatgtcctttctgtttgttagttttccttttaacagacacaaccctcagctgcaggtctgttggagtacccggccctgtgaagtgtcagtctgcccctgctggggggtgcctcccagttaggcttctcgggggtcaggggtcagggacccacttgaggaggcagtctgcccgttctcagatctccagctgcgtgctgggagaaccactgctctcttcaaagctgtcagacagggacatttacgtctgcagaggttactgctgtctttttgtttgtctgtgccctgcccccagaggtggagcctacagaggcaggcaggcctccttgagctgtggtgggctccacccagttcagttggagcttcccggctgctttgtttacctaagcaagcctgggcaatggcgggcgcccctcccccagcctcactgccaccttgcagtttgatctcagactgctgtgctatcaatcagcgagactctgtgggcataggaccctctgagccatgtgcgggatataatctcctggtgtgctgttttttaagccctttggaaaagtgcagtattagggtgggagtgacctgattttccaggtgccgtctgtcacccctttctttgactaggaaagggaactccctgaccccttgcacttcctgagtgaggcaatgcctcgccctgcttcggctcgcgcacagtgcgcgcacccactgacctgcacccactgtctggcacttcctattgagatgaacctggtacctcagatggaaatgcagaaatcactggtcttctgcatctctcaccctgggagctgtagactggagctgttcctattcggccatcttctaatagtctctttccagtgctatctctgtgtctagctaagaaaataggtctcttcctagaaaattgcttttaatgaaggagaggtatgaggtaaaagtagggacattttgctgtcaggcagagcttgagttggatgtataaaaaaagagctggaatagtttttcccttattgccactttccatttacatttgttcccaccattcaattattctttttaaaaaggctagaggaagtgatggaaaaactgaagataataaagacacaaaatgctgaggatggatatttgtgaaaatacataatagcaaccaattgtggggcaggagggaagtcagagaacgctggggtctgtctctcctactctgccacagcatttttgaagcagcatttagtaatttctgcacagggggtgccatacttagacaactccttatgatttttcaatttctcattatcttcaagaagtgttccagaaaagaatctagaaggaacactatcaaagataatgggttacagttttccacaatgggtaaatagcctgagttttcagattaaagaatcacactgaatattgagtgatgatgtggtttggctgtgtacccacccaaatctcatcttgaatccccgtgtgttgtgggaggttcctggtgggaagtaattaagttgtgggggcaggtctttccgatgctgttctcatgatagtgaataagtctcacaagatatgatggttttatacaggggagtttccctgcacaagctctcttctcttgtctgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccatttcagactttgctaagctagtcttcctgagaaatgtcctaatttttactcaccaattgtctgtggatacctctgttttgcacaccatggtcaattcatattcatttaaatatatttaataatttgatttataatgtgtttcttatgcatttaaatatatttaataatttgatttttaatgtgtatctcttatataataatgattttgagcataataaaatagattactctttctttcttgttccaacatttgattcttgcattagctacaaaaagttagttgagattatttctcagcaatgtagagctactttgctgaaagactgctgtatctttttaaaaacttaatccaaagaaaccaatagatcataagaaataaccaaatataaagtatctgtctaaccaatagacaaacctaattagaatactgcctgcatgcttatgtaagtgttggcattcagaaaacaataccccaaagtatgttgctttggcatgctgagcagtttaaactaaaagagattgaagtcacctcagatataaaatctttctcccatctcctgctctcctgtcttctgctcctctttctccctcaaagaaagtcatagaaaccagagttcctcttatgcaaggtgaggcataaaaactagaacccagtccaggcaggttggctcacacctgtaatcccagaacttggggaggtcaagatgggaagatcactggagactaggagttcaaggctgcagtgagctatgatcacatgactgcactccagcctagataacagagcaagatcctgtctcagaaaagcagaagcagaagcagaagaaggagaaggagaagaagaagaagaagaaggagaagaagaagaggaggaagaagaagaaggaagaagaaggaagaagaaggaagaagaagaagaagaggaaaagaagaagaagaaggaagaagaggaagaagaagaaagaagaagaaggaagaagaagaggaagaagaagaagaagaggaagaggaggaaaaggaagaaggaggaagaagaagtgaaggaagaagaagaggaagaagaaagaaggaagaagaagaaggaagaagaagaagaaggaagaagaagaggaagaagaagaaaaagaaagaagaaagaagaagaagaagaagaagaagaagagaagaaggaagaaagaagaaaagaagaacctgcaactcttctgccccaaagcaagtggtgaaacatagaaaggtcactggtatggtttggctcttttctccacccaaatctcatcttgaattttactcccgtaattcccacatattgtgggagggacccagtgggagataatttgaatcctggtggtggtttcccccatactattcttgtggtagtgaataagtctcataagatctgataggttcatcagggatttttgttttgcatctttctcattttatcttgctgccaccatgtaagaagtgcctttcacctcctgccattattctgagatctccccagccgtctgtaactgtaagtccaattaaacctcttgttctccccattctcagttatgtctttatcagcaacatgaaaacggactaatacagtcactttctccattttcttgtctcccttgaggatcctcattccggaggggtcctgccccatacctgggaggaaggagtgctatacagagaggccaagatgaatctgaagagaggcctcactgagtccttcttcagtcgatcaccgttagaccaatcccttttgttcaatcatatttctgtctttcttttttttttttttttaaatcaagacagagtttcgctcttgtcgcccaggctggagtgcagtggcacaatcttgcctcactgcaacctctgcctcctgggttcaaacaattctcctgccccagcctcctgagtagctgggattacaggcgcccgccaccatgctcggctaattttttgtgtttttagtagagctggggttttaccatgttggccaggctgttcttgaactcctgacatcaggtaatcctcctgcctcagcttcccaaagtgctgggattataagcatgaaccaccacgcccagcctgtttaatcagatttctatagagctgtccattcttcactaaaccaaagcataaatgcaatttttcctgagtctttgagtttttatttctgacagcttccctgtcacataaaactttgatttgaaaaatttggtaagcttttatcttcctaatctgtcttttgctataagagtatgactgtgattcttatcatgggtgaggaaaggtatcacatctttccactcctacataaggtatgatatacattttcctctttggtaaacaaaatttccgaaagacaagcaaatggactgtaatgatattctatgactataccacttgggagcaaagttggccatataggaaaggctgaatattaggatttattaaatttatttttaagtgttttaattctgtggaataattggtgtttaggcaatttatataccttatattaatcactcataaatctcctagaaaattaattttattagacaaactttataaaggaggaaagagtaattaaaatactattaatgaaaaggatcaagtgaacaagataagcaaactttgtttcctctgccccaagtcaaactaaaatattctgtgttataaaaagagtataggggagggaaaattttctttatcttgtatccatattaggttcatcagggctctagacagagaaaaggcagattaacaagagaaaaataaacagaactttattgacacatgcatcactcttacctgtgagagcactcagtgatgcgagcactcagtgatgagtgatgatggttagaacctaagcttataaagcatcttagcaaaacaatcattgttgtgtagggaaatgacaagacaaaagaaaaggattttgagcttctaggggcagcatgttgtgggaaggcaaatatgtaaggaaactaaccatagataatggtcagttaataaagtttcttttgttgattcctctgctgctatctcaagttgataagggtctaaagttgtctcaagagattagcttctatccttcctggtagagagaggaggggggcgctgttacacatctgtctcttctttggcaaagaggaaggacagaggttttccttaaatatgctgcttctcaatttcattcctctcacaataatccttatgccaaagtggcatatttcgggggtgacatatattgttaccctttaataaattcatgctgcaatatgtttataataatcagtacatatttgttcattactttttaagtactcagtaaaaaaaaaaaaaactgtaagaatattaaaatatgaagggcaaaatgcctccctttaaagagtgctaaattcagctgtggagctaaacatatatatcttaagatatgtcagtatgtatctttcttttccgttttgaatgaaaaatttcaacatatgatgaagtagagagggatgagatgagatctctgcaggtcctgggtctgtggtgcttatgaacattttcctcctttgcctggcccttctgtgctctgaggagggggaggctgaccccttcacctgtgtttttcagcaccacccccacacttgtttctagcaatagaaggctccaatggagatgggggtgagggggcaagagaatccttagcgtgtttctccctctgtttcagagcttttagcttcaaacaacatgttaacatctggccttagttgctacaacaacttatttttagttttagttttcctttaacaattgaaaagaaattacagagatttactataaatttctcagtaggcatctggaaaaaaattaagatattgtcctcataaccaaactattattatcatatcaaagcaaagtagcaggatttcctttgaactctgttttagttttttaaaattcctaactctcctacaattctgtttataattgatatatttgaatcccagtctaaagaaagtaaagatcccagtcacattgaagtatattttatgcaattggtacattcttattttaaaataatgttattgtttatctgaaattcaaacttaattgggtatgtaatgtttttattcattagatttaggagtcatagccatgtttcacttggttattgtgcttttataggtcataggtaaaatacaagccctgggtcagtggctaaaggtaaatatgatgagctaatgaagctcacattataatttactggagctcacgttataattgatggtaataaacaggcaatacacaattaaatcaacaatatgttgataagtgctgtaaacagagaaaaaaaagtagatgtgacaatggtaaatgtgcactgggaggtcagggacaacttctctggtgaccaagtgacattgccctgacagctaacttacagaaagcacctacacatgtgcaaatattatgcttcaccttcaaaggttaaaaaatatatatgacgtaaagtttctatgaaagccaaattataggtcacatcactttttcattctcagaagaagcgattgaaaatgtaaaccccgtgaggtgggaatgcatgtagtctactcagcaaatgtaaaaaactgaatataagattttgatttgtagggtatcttgagtaaactagaagggtattttgagataaagtcaaagaggtagataggtgccatgttatttaaaggcttttatgacataaggtggaaattggattttattctacgcgtgctgagaagcttaaatataggagaattagatgaaactgattcctcttgcaggagagccacctggctgcagaagattgtcagagatcaagggtaggagccttgggctggttagcagggcatgattatagtaagtcaggtgagagatgtaggtggttcccaccagagttgtagcagtggagatagaagagggatggatttggaatgctgcttggacaaatacttcctggccctctagggtgattcaactagctctgcttgctttttctttatatttgcaaaagaattgtgagtgaacttgtatcacaacatctaaaatgctatattaactttcctgattatgttgtttttttctcctactagactataaaccccttgatgacaaaaatagtgtgcatttcacagcatcttgctcatattcagtgctcagtgcattctggagaggaagtaatttaatgagattttagtttacattccacaaagaatttccaatgaatgtggcttctacaatcctgttaattaaaaggattgcaacaatagtccaaaaaatacacatgatatgtaatctggctattatagaaactttaaacgctattcttttaactttgaaggttaagcttggttcaagagctgcctggaatcacagcaaaagtaataaaacacacaagtttttagcctctttaagggaaaatacatataacttctccaactttcctttaccaaatcatatgactgatattgaactattcttttctcctttgctgcttttgcaatcaaaaccactcccattatcttggtaaagaatgtattctatgattccttgactcctataagcttaatgacatcagcttttaaaatgttgacagaacaaacaaagtgcacacagctgcaacattccctctgcctgcagttaggtgcttttatgcttttactaaacacacacacacacaaacacacacacacacacacacactcatactcattctacttcatttcaatttgaactacatgtggcttactacgtctcagttaatggcaagcaacataacttgttggcttttataaaagttaattattacttgtatattaatttgtttaattttgtttgcccctaaacactctgagaaggaatcattgctattttgttagattttctgctacctctcacatgagcctgatacttggatttccattttttaatgaataagtaaccgatgtaatgaactaaataataaccttgttgaacctaatgttatgaagtcaagtgtgtttgtcacccaaagaattttaagtggctggatggtgagaagagtcccgttagagtaatgcccatgaattataacacccactagcagcaaaacaacacgtgcattctagagtggctcaacctaatgcgtgaggcatttgggaaactcttgagaacatactcacaaaagagtagtattcagtttatgattatttatcttagagcctctttgtgattacttatttggtaaatatatcaatttatagaattattcaacctggcttctctataattattaattcattatttagcattcccatttgttgtaaaatactctctactcttccctgaaactgagttattacgttaaggctcattgatattttattcctcataggcaggatcgtgagggcattaggaagaacttgggtatttctttgttagagatggacaaagtagttctatatacaacaaggttatttgctggacccagccctacattacattgtatgatttttgcctcgtcagctcttattacagtgactatccccttgtagagagatactcaagtattatttgttgtaacttgaatgaagaaacagcacttgagttggaaataggaaaaaggcaactcttcacagtttgtgtttatgtgcccagaaatgcttgttgactacacacaaacaccatgctgaaatataatcatccaacgaaataaagctaagctgagataattaccactgggatatttttagtcaataataattatatgttaaccaactggtattttctgccaaacgagagatggcatttctgttgatgacacgttgcatgtgttctttctacagctgtatcttcatgagtcaacaggctttctctaagtctctctgcaataggaattaacaatcagaccatcttgctcttttttttattgccctttttgctccacttgatgtaaacagggatactggccatttcttaaatgatttttatttttctactatttttctcagcataccaattttcccttcaatactcaagtttaacgttgagagagaaatgaattttgcccccctcaaagcctctgtttacatttagttaatgagataatttgtttaaaggctaaataccattactcatatgctaaagtttcacaccatgtagaaagtttatagaaacacattaaactgaatgccaaaactatctagacctcactaaaaattgggatctatgtgcctcattttagtgaagaagtttgaattaagagagatcacatcactctctctgacatccagggtgaagtctcagcattatggactccatcctcaccgtcatcttgtactagttaacttttccctaactggtaacctacacataagaatattgcactttttcattatgactgacagagatcctagtattggtgtatggagactattagataaaaatcttggcattaaaagcaggagaaggaatatggaaaaatgcagagctgtcaagaaggctaatgcatataggttttaagaaccacatgaaggtactacttttggaacacagtggaaatcaaatgcatgacttatcaacataatcatttttggatagtatgcactacttgaacatatttaactaatccaaagtcttccaaggcttggatatacactggtagaatgatgattaacaacaggacttatatctgtgctttcttatgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactttgatatcatattaatagaaaactctctaaaatatcagccttaacataaattgttgaactgcattttagagttcttactttttcattttttaattcttatatttcacaaataaagatgtatgctttcattaaaacgtgtatacataattacactcatcctcttaatatcacatatatataactaatatttttaagagcataagtggaaaacatgcaaaaccaagtgaatataatttatataggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtctcaaaaaaaaaaaaaaatctatatgtgaatagataagattaaataaaatatatctaatgctaataaatgaaactggtaaaaattgaacagcttatcaaagtctgaatgaccatcgaatgttttagtggtagactagaaactgaagccaccttccacttctgcagaaccatgacaaactgggatagaacccatggtcttttagcctttgaattccagttgctcttagaagttccatatcaggataaattgaggtatgaggagaaaggattgtattaaattcattaagggccaatacagttttctggctctgggaaccattgtgtattctcagagaagaagagagagagcattggaacttgttactttctctactacacagctcatagaaggcagaaatttatttgtttttgcataactacagaactcattaaagaggtagatcaaattttcagacttgatctgtctagggtggtttctaggagtggcaaattataagctggtataccaagcatgaattggagttggctaggccaagtaagggatggtgatacattagggtacttggacagatgaaatagcacatatggaggtccatagatgaaacaatgaagtgtaatctaggacctgaaagaactttgtagttagttgaatgtatacattgaggtcattatataggggagatgaagattggtgccatgaagtgagataaaaattatgcagagattgaattatgcagtttcatcagagattggaaaattatgcagagattgaattatgccgttcatcaaatatataaagaaatttggaatcgattctaaaaactaggaggatacaacaaagtgttttaagtgagactgatgtaatcagattttcatttttttaaacttggatttgaaactagtagagccttagtgtcttagatcctcttaacaatgaaggacaacagtttattcacagacattttaaataagaatgcagatccccaaagaattgaaatgacttacatcacattcctcctaaaaatgtcagtaaaaagattgataaagcccaggtttctgttcttggaggtattcttttgagaatgtgagagatgttaaaattcttttttttaattagaaaatcacattctattataggctgctacatgtaatcaacctcaccaaaaaaaaaaaaaagaaaaaaaaagaaagggaaagcattactgaatgctacctgtcccaaacattagtgaaactgatggataacattttttaaaagtatttatcccagcataatacaattttctattatgagagcgaggtatagaattaaagcaactatcaaaatagcccatatcagatgcaatctttaccctgaataacaagactattaaaggataggagtctaaccaaagggacttttaaaagtgtctgtcatttgctgatggtggcacagattttattactctacaggtcagagggccacgtatttctctgtttatagtgaggtgggttttttttaatagtacatttatctttcttgaatatgggaaatccatacatagttactgtgttagaattcctcactaagaataattctcgataatcaacgctatcaggagttgagggtggcataagagagttcaagaataagatgataatttgatgatggaaaaataagtgagttctcctaatgcatacctcctatcattgtagacaaaagtttatgttctcaaagctgttttcacgtactacactcttcacctctatgtgatttgtttgctagagctgctgtaagaaaattccagagactgggtggcttaaatgaatgaaatgtattttctcatggtctgggtcccggaagtttatgatcagggtgctggcagcactggtgccctctgagcctgtcttcttggcttgcagacccccactcttctgcctctccccatggtcctgcctccgtgcatgtgcaccccagtatctctttttacgtgtataaatttcctcttcttataaggatgccagtcagactggattaatttccaccctaatgacctaattttaacttaatttctctttaaagattctgtctccaaacacagttacattttgaggcagtaggtttagagctttgacatgtgggtttcagaaggacacagttcatcccataataacctccaaagacgtcaatgctaaacagcctccatgagcttattaccaactcaaaaacatcgctttcttcccaggccttccctgtttgttttacttgactgattaatgtatgctgctctttgaagctcagtttctttctccagtgaagacctactgttttcccaccttcttctctaactcctactttgcactggtttacaactcagctcacaatattcccaagttactttatcagtaaaatgttttcaatagatgaaactcatagcaagtcaatacaccattttccacttaaatttgcattattttacattggattctaattgatccatacagctcgattgtctccccatctagtttgcagttgatgagaatgggaatgacacattatatttattttgtatcttcatatgtgttgctgtacatactatatacaatgatagagtgctgtgtatatattatattctcaaatgattcaatttgattcaatttctgatagtgaaatacccagctacctgattctgctggttttcaatgttactttaattggcgtgaatttccagcaattagctttccttcaccatacatactttataaccctctagactgctcaagttggctgggcctggtcttcctgacccagaccattggatgtttaagatcacattccaggcatgaggatggctgcacatctattacctcacagattgtcaagcttgattattactgatgtggatgattatctaggtgtccttatacctcagtgttccccctgtgccttttcaagaagagtattttacccagtacagaacttttttagaaatcaaggttatacaagcaactgtgctcatttgtgatcatcttgaaatccgtaaatactgtccgagtatattactatgttaggtgaaagatttgtgttgctctccacaaattatcaatgtttgtttacagaacatttgtgaaaaataatgtttggaaatgacttgctacgtgaagtaagtaaccagtaactcaagccatttctcccatgtggtctgttttaaaaatggaaattctgtaatctggcttcctcaccttggagtaatatacaaaatgtcaaaatgagaaaagggaccttggtagttgttgtgtctttcttgtttattctttcttgttaaatactcaaagaaagaaaaacagcatgcaatgtttgtagctcccattgtgttagctttttactgtcctgacatatgtcctaaagtttaaaaagcaataaaaggttgctgcttccacagtcattagctttcgttgctgcagtcaatcatccacagaggtcagagccgtatcagtttttcccatcctcattgcacaatccactctagccattgcactcatatatcattaaaggaaaaacgaaccaaggaaactaccgagactcaaaaatgaacttgcaatgtgaaaaatctcctatctccttatttgaggaaagatgctcctgtcacgctgagtaaacaataaaattataaggccaacactgtaaatggaagtattatcccatctattgatttataatgggttaattaattttcaagtgttcttatttgcaaaacatgatgtgaacattgacagaaatccttagatagtttaagatgaagtcacttttgtcttagtgacttgatcacttatacttaggccatagttaagaatctaataggattatttcagcagagtgttgccagattcatgtataaagtcaagaagtaaaagaaaaatataagttagtcatgtttgagttgggtgatgtaacctggaaacaaatctgactggactaataataacaagttaataaactcactgtgaacaaatcaattaaaaacctaggcattgttatatttatttgcatcttactgtctaactagactttagttgaaccacacttcatttcattttaattcaagcactcattgataatatattttgcatttcttagataatttcaaaaaaagatagtgtgccatagtcatattattataagggactagagttatattctaagtcttctgacattcaataaaattgttataattgggttagacatatatgaattacaaaacatgggtttgaaagtggtcacccaagcatgattaggaaaactgcatacaagtagtcttactaaatacaagttgtaccactccttgcttcatccctcagaaagaggcatgatgttgtcactgctgctcatcttcagcttccactttagtttctgactaattctgccctagcattttcttcctgtgcttttggctgtgattttccggttacttgaatttcttgtctgccttctttgagctagaattttcaggtttagtgtttgtattgttctgactttgtgtttgggaagactgctgccacaagtatgtcccggtgtatgtaattatattcttgaccaatgctccttgtctctgtccacataacctctgttgaatcccaaatgtgtacccttggcaagttgctgggtttagtgtgagagtcgatacggcaacatcacatagaaaaaatgttcacggccaatttctaatttgataatgtgatgaaatttatggatgctttcctcattaagatgttcatcacacaaacagctgcatataatttaaagacatattcatgcatatgaacttaaaaactcatggtttagaggtgtttttaatgcatttccctggagtttttcattgtatatgacttttttttttttccttcttttgtcccttggttatattaagctgcctcttaatacttagaaaagcagtgcttaagaaattggaatatctctttccataaatatgtgataaaatgtattgtaacttatatgatttattaaattgagtcacgcctgaagcaaatgcattattaagtagttaaaaaattcatgacatgtccttaacacactgagagtgccttagaggagttcattcatctgataaatatgtgtttaagaaaattgcttgaaatgaatctcttttatgagttttggtaattattgttcttatttaagacttagatatatatagcataaataacagaatgtgtttttcacatagggttgtggtttgtttttgaatgcaaatagtcagtcttttcttggtgggtatataataaaatgctttttttgcatcattaaaagttctcaatagtctatggtgtcctagaacatattatctacattgtatataactatgtttctgttttgagatttaaaggaacatatgcaatagcaactttatatgagatttgatttttcatatcagacttcagcctcaagcatttagttgaagaatgaagatcttaaattttgacttttctgtttttagccagacatgttcaaaataaaagtgctatttaaaaagaggtctgtttccatgtcatctgaaatagggatgttttaatttatgttatagtttgagatacaccaaatcaaaggaacaagcctgcctcaataacccagtataattttcctatggctgctgtcacatagagagcacacttttttttaagttacagctttccatccctttagcacttaatcatgtagagatttgtatcgttgattatgcataaaataatttgactaaatactctgaggcagtgtcggtgacattttgttgctgttggtaccacctcttgtttcattgctactactattagtaccatcatctttgataattactacaatttactgagtgctcgcattgtttctaacatgaagaaaagggctttattttaactatgttgcagataagaaactgagatctagtgattttaaataacacacacaaaagagaagtattgggtggataattatttctgtttctttttgtaatccatgtatgcaattcaacaacacacaataataatagtataaactatgatcaaaactcttgataggctttttataatgcgatcggacaacactatttaactttctcatttattatttatctaaactatttgaataatttcaaaatattctctgcttttcaggctacttgatttgcagcccaaataatctcaaaattgtaataagtcaaggaacatttttagcccgaattattaaaaaattgctttaattttgctttagaatcaactcctcactacccattgcattttagttttatgcgtttctttatcttctattgatggactttgtaatatattaatttatatgcttaaagtcccatttagctatagttttccttttgatttaaatgtaacttaaagagaggaaggaaaatttttatttcatcacaacttcttccaagtattttataaaaattctgatggttctctttactgaacttcttctaagtgtttcataaaaattctaatggttctctttactggcttgtattagcttgtactttctttgctgtaaggaaatatatgagatggggtcatttataaagaaaaaaaggtttaattggctcatggttctgcaggctgtacaggaagcatagcagcttctgcttctggggaggtctcatgaagcctccaatcatgatggaaggtaaaaacagagcaggacgtctcatatggctggagcaggagcaagagacggggaggggtgctacacacttttaaatgatatctcatggtaaatcactcattcactatcatgagaacagcaccaagaagatggtgctaagtcattcatgaagcaccacccccatgatccaatcacttcccaccacacgccgcctccagcactgggattacaatttgacatgagatttgggcaggaacacagatccaaaccatgtcatggctgaatttaccaaatcaactgtgaatggaaagaagtgaatgaatgctagcaagtaaatgtatttcagattaaatttttttagggaactagaagtaaattgccctgtttaaaaaatgaatttataatggacttctagctttggcagcatgaagatgttgtcacattctctccaaaaagcaagtacagatgcttctagacttacaatcatgatatctacccataagtaaaaaaaaaaaaaatcttcagttcaaatatgtttaatacccttatacccaccataatatcaaaagttgtaggttgagagactgtaagtccagatgcttcctgacttacgataggattacattcagataaacccactgtagagtgaaaatgtgtatgttgaaccctagtaactcagggaccatctgtgtgatattggaaaaaaatagaaacaacatttcaaggcacatatgtcaacaaaaagcagaaaacgagttaataaaatttacttttgaaataaatgcaagagttgcaagttagaggagtatctgtggccttctttccaggtcgctgccatcttcactccccacgtcaatagagtcagcaagaatagtatttgtaacagcgggcattgaaaaccaacagtttcgaggctatgcatggggaacttcctcagtttggagtagcaagtgaaaacctatggctttgccagctaaaagtgagtacttaggtgggaacaactgagcaaaacatttgtgttagcacacagaggtcctggttgggggagcaatggaccagcaagaaagttagccaagagattctgaaaatgagcgagccatagaaggtctgagataaggtctcgcatatcactggctattagggaggcctgagagggatttgagaaacagaagctgaggaagacttgaggactcacttcaactttaagtgtgttttccaaaccactcactaataaatgtgaagtgggtagacaccttatggaaacaaagcctttgagtacatcctctatccaaataactgggtgatcactaaactatgaagacatgctggagggccaggctcattcctataatccctgagctttgggaggccaaactgggaggatcatttgaggccaggagtttgagaccagcctgggtaacatagagaagtctttccctgcaaaaacatttttttaaaatgtatctgggctagtggtgtgtgcctgtagtcctaattacttgggaggttgaagtgggaaggtcacttgagctcaggaatttgagattacggtgagctgtgatcaagctatcacactccagtccgggcgacattgtgacaccctgcctgtaaaaataaatgaatagataaatagacgcagggcagtattcctagaaaacaaggcataaaaatacaatagtaatggtaaaatacaattaagtagagtatcagtggctgggctacacatcaaagctaattttaacacacatacacagaaatataaactgcattccagagttggtatgatgcattttctaatatattaaattttcaaccacaaattatgtgatatccgaagaaacatgaaagtgtgaccaatactcaaaagagtattgagtcaatagatattgacactacatgggaccagatattggatttagcagaaaaaaaaaaattcaaaacatctactataaatattttcaaaatattgaaggagtgacatcagcaaaatggcggagtaggattcttgggcttcactctccctatagaaatccaatagcaacacaggaagtataccatcctaaatgtcccagaactcaggagtgaggctaagacttcccttggacccttggacttcaggacaaagaaaaatggaaatcaaatattaagacttcagatgtttcacctcgttgccctttctctaggccaacacagtaccatacacagagaattctcctggacccacagtttctacagttgggaaagttagttggaagcaaatcttcagttttcccaccattcaggcactctttacagaaggctcattcctattttgtcccacaggaaacattgggattacaagcaggggtggaccacctggggtcagttggcaaaaaagagcatttaggagcagctttaaaaaagaatagacaaacctttaactagacttactaattacaaaagagaggttattcagtaaacaaatcagaaatgcaaggcgaggcatcacaatttacaccactaaaatacgaagaatcataagaaactattattaacaattacacaccagtacattggataacttagaagaaatggataaattcctagacacatgaaagctttgaaaacaaacacaaagaaatagaaaactcaatagagcaataatgaacacagagactgaatcagtttaaaaaaaaaaaaaagtcttccactgaggaaaagcgcaggactggacggcttcactgctacattctactaaacatttaaagaagagataataccaattctcaaaccattcaaaaaaactgaagtataaacaatgcttccaaactcattttatatcccaaactcattaccacaacaccaaaggcagacaaggacactacaaggaaaaaaaaaaaaatatatatatatatatatatatgtgtgtgtgtgtgtgtatatatatatgtatatatatgtgtgtatatatatatgtatatatatatgtgtgtgtgtatatatatatatatgtatatatatatggcaacatcattgataaagatacattttttaaatcctcaacgaaactattagcaaacccagttcaagaacacattaaaagaatcatttttcacaatcaagtgagagttattcttaggatgcaaagatggttcaaaatatgcagatcaataaatgtgatgcaccactttaacaaaatgaaaaaaaatgagaagatgcagaaaaagcatttaagaaaactcagcacccttttcttataaaaattctcaacaattaactatacggaaaaaatgtacttcagcacaatatatgacaaacacatagctagtattattcttaacagtggctagttgaaagcatttcctgtaagatcagggacaagacaacgatgctcactgtcactacttctctctttctttctttccttcttttttttttttttttttttttttttttttttttttgatacagagtctcactctgttgcccaggctggaattcagtggcataatctcagcttactgcaacctccgcctcccaggttccagcgattctcctgcctcagcctccagagtagctgggactacaggcacctgccataacacccagctaatttttgtattttcagtagagatagggtttcactgtgttgcccattctggcctctaactcctaacctcaagtgatccatccacctgcttcagcctcccaaagtgctgagattataggcatgagccaccgtgcctggccacaccacttctctttgataaagtactagaaatcagagccagagcagttaggcaataaaacaaaataaaaggcatactaataggagagaaaaaagtgaaattgtttctctttgttgataagatgatcttatgtgtaaaacaccttaaagacatcataaaaaaactattagaactgatcaatgaatgcactagagttgcaacattcaaaattaatgtgcaaaaatcagtagcttttctatattgcaataatggtctatcttaaaaggaaattttttaaaaaatctcatttacaatagcaataaaaaagttaaatatataggtgtaaatttaactgtaaaatacctgagtattagaccattcccacattgctataaaaatatattagactaggtaatttataaagaaaagaggtttaatgggttcacgcttctacaggctgtacgtaaagcatgatgctggcatctgcttgcttttggggaggcctcagaaaacttacaatcatggtggaaggcaaagggggagcaagaatgtcacatgatcaaagcagcagaagtgggaggtaccacatacttttaaatgaccacatctcataaaaacactcactattgcaaggacagtataaacaggatggtcctactcatgagaaatctgttcccataattcaatcacctctaaccaggccccatctccaacactggggactacagttcaacaggagatttaggtggggacaacatccaaactatatcaacttatatactgaaaactataaacattgaggaaagaaattcagggtaatacaaatcaatggaaagatatgccatgttcatggattagaaaaattgatattgtgaaaatgtttatgctacctgtcttcatctgttctgtgttgctattataggatacctgagactgggtaatctattttaaaaaaaaagacgtttattttggctcagcattgtggaggctggaaagtgcaacattgggaagccacatttgatcagcatctgatgagggccttttacttcatcatgacatggaagagaaatggaaggggaaggaggcacacaaaagaaaggccaaattggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacattcaaatcacagcattctatccctggctccccctataactcatgtactcacaatgaaaaatgttttcaacccatttcaatagtacccaaatcttaacttattctagcactaaggcaaaagtctaaagtccaaagcttcatctgggactcaaggcaaagtccttccagctataagcctgtaaaataaaaaataaatgtattttctaaatacaatggtggaacaggcataagatgagtattctccttccaaaagggagagagaggcaaaaagaaaaatcagcccaaagtaagcctgaagcccagcagggtagacattaaatcttaaagctcagaatattcttgtacttcatgtaccttttcctgggcacactggggtagaggaggggcttcaagacctcggacaggcccacctccaagactttgctgggtgtagcccgtgtggctactgtcatggattggggttgcatgctggtgcctgcagatttcctaggctggtgtcgcatgttgctgatgacttctgtgggtctggagtccagagggaagtggccctgctcccatggttccactgggcattctagagaagactctctgtgctgactctgccactgtgacagatttctgcctgagctcctaggcagtttgacaaaaactttgaaatctagttggaggctgctgcacctcctccactcttgcattctgcctgcatgcggaattagcaccatatggatgtggatattgccaaggcttacgacttttgccttttgaagctgcggcatgagctgtacctgggatcccttgaaccatggctggaacagccagagcagctgggatgcatggagcagagaatcctgaggagtgtgcttgaggcctatcccccacaacattccacccttggagacctctgggcctaagataggagaaacagcctggaagatctttgaaatgcctttggggtctttttcccactgtcctgataaatggcctctggctttgttctcttcacactaatctatttagtgaagagttgctgtaccgcacccttggcttttcttctgaaaacagttttattctctaccacatggtcaagcaataaattgaccaaatcttttcactctacttcccttctttctagcagttcactagcagttagaagtaaccaggcagcagcctgaacatttgctgcttagatatgtctacaaagccctaggacagggacacaatatgatcaagttctctgctaatgtctaacaaagatggcctttacaccagttcccagtaagatagtcctatttccatctgaggtctcatctgaatggcttttactgttaatatttctgtcagcattctggtcatgacaactgaaccaatctctaagaagttttaaacatttttttagtcttttttgtcttcttttgagccctcattatattatccttaatgctccacatacagaaatactatttataatagaatattattctacttaaatgataggtaagggaggtgatggatatggtaactaacttgtttaaaagagaaagatatgactatgtgctgtctataagagatgagactaactttagattgaaatataaaaataggttataagtaacttgatttaaaaatctgtaccatacaaacataaccataagagagttagagaggctatattaaaatcagacaaaaacatattttaaactaaggtatattactagttataaagagggatcttttaattaaaaaaaggtcaacacggaaggaaaagataacaattataaaggtacttaacactagagctttacaatatatgaagtaaaatctgacaaaattgaaaaaacagaaatggacatttcaacaaatataattgtgatttcaacacccttttcttaattgatagagaaagaacagactaaataagtaaagatacaacaaacatgaaaaatactattgttgtagaaaaaaccgggttcttgtcacacgaccagaaaatattaggcatgcagacactttgaagagtgacggggagtggaatttattggatgaaaataaaaaaaaccctgtcagcaaagcgagaggggttcctgttaacaggtctcaacctcacagatcgaatcccaggtcaccacccaggaacagaagaggccaggctccttcgccctggaaacagggcgaacttcctgagcctctaccctgtctctgcagtgcgcaggtgggcattattcagaaataatcagtcaggaaaagggaaggcttcatctgggacaggcagcctggtttctcagccttcaggctgtttcagccttcagcctcaggcggggttttgccaggggacccttggctgcctcctgtctctatcattccccctcgaaaggagcacatctaactgcccttagaataaggataaggataaacacgaagaccaatcttaactgcttcctgaagacagagggggctgctttggggaaatggcagtcagatctccctcagaggccaatctaagcgttcctggcaaaaggggccattgtccaaggctctgtttgcatgaccatttggagtctgctggcctgaaggagagaagggacaaaccaggttattagaaaacatgtatccaaatgaaacaaggggtgggtgaggacagctcaaaaacccgaggtcttttacgggtgtgtacatggagagggaggctgaaagcccactggaaaaaaaaaaatacttttacctttttgccagcgtgttaggcttctgggtccccttcccctgagcccagtcctaagccaaccagtttaaggtttgtgaaattaactcttcccagtttggaggatgcatatgacgggagcgtcccagagtatggacacacaattacctatcagtgaagagaggacagaggaggaaaaaggaaaaaaaaagtagtcattttttttcaaaggattcctagggatttaggatgcattcaaaaggggtacagactgaagatgaatggctactcatctagaatgaggagagcaagcgtccctgattcctttctctttctagcaaatacatgcggtacgtgagggagggaaaatgaagcattcctctttctttcccccattcttgtatctcccagtctcggtgaccacgacagggtgccatccatgggtgttaaagtggctttcaaccatgttcacaaggggacttaggtgataggagtatctgctcttacccacatatgccccatctcccctgctgtcagtaaactttgacaggaacaggaactttcccaggaacaggagaggccaggctcctccgccctgcaaatggtacagacttcctgaggctccaccccaatctcccagtgcgcaggcgggcattattcagaaagaatcagctgggaaaagggcaggcttcatctgggatgggcagcccagtttttcagccttcaggctgttttagtcttgaaggtgggcttttgctgggggacctttggctgcctcctgtctctgtcactatcaaccaactggatctagttgacatctataaaatattttacacaactgtaaaatatacattactttcaggcatacgtgtaacactctcaaagggaccatatgctaagcattaacaaatgtctcaatatacatgaaaggactgaaatcatataaagtatattctctgatcccaatacaattctattaggaatcaacaacaaaatgaatagttggaacatcttcaaaatttgaaaattaatcataaagttataagcccattggtctaagacaaccttttgagagatattaaaaaaatcatatgaataaagatggaaacacaaaattgaaaagctgatggaatgtgggtaagctagtgcttagtgagaactatagcttttagccttaattttaaaaaacataaaaaatttaatgttaagaatgtaagattctctccaaaaaactaaagacacacagatcaaatccaaagtaattagaagtaaataaatagtagatctctgagtgaaaagaatgaaaaagaaagtagaaaaggagaaaaacagtaactaaaatttgtccatttttaaagataaaggaaggaaaacaaaaaaaaatactgatagacttttaattagattgaccaagaaataatgagagaagaaacaaattatcaaattgggaatgtgaaaggattctcactatagaaactgtagaaatttataatgtaggactataaacggaacattatgaactactttattccaataactgtgaaaaacctaggtgaaatggataaatttgtgaaagacacaaattaccaaaacaaactcaacaaaaacagaaaatagtgagatctatatcaaaaaaatgaattattaggagacaaatgtgtaaaactgacaaaatttttgaagtcactttactaaagatcacatatgaacagcatatacaaatggccaacaaaagtgaaaattgcccaacatcactaatgattagggaaatgcaaagcaaaaccacatgcgataccaacttacttctgcaagaatgaccataatttaaaaattaaaaaataatagacattggcatagatcttgtgaatcaggaacgcttttacactgctagtggaaatgtaaactactataaccactacggaaaacagtatagagattctttaaagaactaaaaatagatctaccatttgatccagcaatcccactattgcatatctatcaagaggaaaaaccgtcattaaatgaaaaacacacatgcatgcacatgtttatagcagcacaatttgcaattgcaaaaatgtggaaccaccctaaatgtccttcgaccaacaagtggataaagaaatgtggtatgtgtatataccatggaatactactaagccataaaaagaaacaaaataataacattcacagcaacctggatggaaatgaagaccactattctaagtgaagtaactcgggattggaaaactcaacatcgtgtgttctcacatataagcaggagctaatctatgaggatacaaaggcataagaacgatataatgttttgggttttacatttaagtcttcaattcatcttgagttaatttttgtataaggtgtaaggaaggaatccagtttcaattttctgcatatagctagccagatctcccagccccattgattaaatagggaatctgtgtatatatccaaaggaatataaattattctgttataaagatacgtgcatgcatatgttcattgcagcactactcacaatagcaaagacatgaaatcaactcaaatgcccatcaatgatagactggattaagaaaacgtaatacatatacatcatagaatactatgcacccataaaaaggaatgagatcgcgccctttgcagggacacggatggagctggaagccattattctcagcagactaatgcaggaacaaaaaccaagcacccatgttctcagttataagtgggagctgaacgataagaacacatggacacagggaggggaacaacacacactggggcctgtttaggtgtgaaggggagagcatgaggaagaacacctaatggatgttgggctgaatacctagatgatgagttgatctatgcagcaaaccaccatggcacacgttaacctgtgtaacaaacctgcacatgcacctggcacttaaaagctgaaggaaaaagacaaaaagaatgatataatggactgaggactggagaagtgtgggaggaaggtgagggataaaagactacacattgggtgcagtttacactgctcaagtgatgtgtgcaccaaaatctcctaaatcaccactaaacaacttatccatgtaaccaaaaccacctgttccctaaaatctatttaaataataataattaaaatcacataattcttatagtaatttaaacatcattttaatagttctatatcacttgtattgatattttgatataaaattagactaatttgtctttcattttttaatgttttcacttcttttttagttacattttttaatttgtaaaacttttctgtggttaaaatatcaagagccgtagtatgaaaaataaatatacatagaaaagacttactttaggggctgggcgcagtagctcatgcctgtaatcccagcactttgggaggccgaggtggtgggtggattatgagatcaggggttcgagaccagcctggccagcatggtgaaaccctgtctctactaaaaatataaaacattagccgggcatggtggcgcatgcctgtagtctcagctacttgggaggctgagacaggagaattgcttgaaccgggcaggcggaggttgcagtgagccgagattgctccactgcacttcagtctgggcaacagagtgagactccgtctcaaaaaaaaaggagagaaaaaaaagaaaacactcactttaattctgtccattgttgaatgatggctgctcaaaattgtagaacaactggtttattgggaaaaaaaattgtctgtatttgcatcttggtcaaggactatattaccttgataaagtcttagtaaagtattgaaagggggagggaaaattggggtatttatgaagctttggaatatgatttaaagaagttcttttatgagagagtttcattacggagaagcaaggattttaatgatttacatttggttgaggtggcaaggtgaacattttgagaagccttagaaagacttggggagtaagctgtcattttatgccttctattgaagagctgaacaatttgctctttattgaaataagattttcagaaagttcctggaatgaaaagttatttgcaactattatcttcttgggcaagtttcctgcgattataaagtcatgttgacacacatgtagtggaatggttaaatcatgaaaatgtggacagtatgctgtgtgggggtggatggttttggttctcatgttccaccatgattctctctgttccttaacagtgtaatttttgctagtttattcattttccatctggtgtttactttttaagaaagcaattgcaggtatagccattgcttttcagacatttattaatgcttaccacacatttacaggaacaactactgtgaaccatgcatggtgctaggttttaaagattaaaatgatttaaggggaaatgagattttcctccaaaataaaaaaacttactctaacttccagatttaattgctaagcacacataattgcacctaaaacaggttgatgagggattgatgagggagagtatagagaagcgcctgtgtggcaactctgttcacatttaattaactgtctatagatggctgctaccagcattgatcaaatgactacctatacatattttactcttacacaggaaaaaattaaattggatcatgatataatatttatataactttttaccacccatgttttaagatataaattctagattaatggagaatacatcaattttaggcaattttactaagaagagcagatattgaagaacaaaaagaaacactctgtaaatacaggtgtctactcgaaggttcatcgaaatttaaatttgttgtgaattcttcacaatgagacttttcattttcattagaattcttgcagcattattattccaggattggaatacagttgcatatgataatctttgtttcctttataataactatgagtgactcagttaggaattcaccttggcacaggactaagttatttctgatctactcaatggagtgtatgtatttaggattattcatccttgtttacttaatgtggttttcttcacacattgttttttagatgtcgtttgagagaaacaaaacctttaactcttactgagagggaagatgaattttctaaccctgggatttggctgctcactgagtgtacacataatagatgggtgcttccattgtattattaggggcattcagtagagggcctctcatctaccagggcacaattgagtattcctgattattgatttgtttatttgtgtttatatatttgtaattcccctttaaatactaatattatcaagtgttctaccacatgtgatttccctgttctgagctgtctaacattaagtataatggccaaaccccattttctgtgggatttgggattcttgacctaaggaccacccagcaccatgcccctgagacctcccatcctgaacacagctaatcggactggagaagtccatctgaggaagaggaagcagttgtcttctgtagtctgaccaggagattagcaagaagtctggcccaaaaactctgccccacaggtttctctaccaaatggtgaaggccaggtgttcagttactttttcctaaggtgttgaaacgtaaagcatgtggaaaacatgcaaatagaaacagcaaaatggaagcaaacagagaccatgaatcagtaaaatccatgaaattaagggaagtgaaaatcaaagtcggaaaatagtggcagccgctccacagtagtggagcatgagggtaggttatcttcaagtagtgaggtttgtgtaaattagatttctttatattttctctactttttaatgctctgcaatttaaaaaaatgttacttttgtcatcaggataatatgttcaaatttttaaaaagtacctaaaattttaaaaaatcactagcttgatttaactagattttcctttgtttatcatcatgactctgcaaaagctgcagcatctgctgctttatgaatgaagtgctgattaggcaagcaaaaatacagttttccagacctcacatttaggcaactgttaaaagcctagtttccgagtcaaagccagatataaatttctaccctgtgtctcaactcagggccagttatggatggtggagagtttgagatactagtggttaagtttaatttcagctgcctgtgtttgtaaccatttgactttatctaaggaaggcaattctacaccttctctcaataattttttttttccacttggttttctctgacataactgagatcattgacattctgactagagcctaagaaatttcatgtatgtgtctgattcagtggttcaaggccttaaagataagcctttaattctgaggaagagcctttagcttctcccgtctcttaatacaaacctgattcatgccaggtttgtctaggggctacgtggatggttaataaaaacatgtaatttctatcccccaaattgtacctatttaggattagatttcagaatcttatttgaaacttaaacaggctttagaaataattttgtcccactctattattatagagatgaataaatgtactttcaaggcaagtagagcgacttgccaagattacaaaaaaatgtctgcgacagagccgagtctagatgtttatcttctagtttccagccagatactagttttatggctagtttccgccatgctctgagggaggcacattttccatcatcttttatctcaacactgaatactgtttttgacacatagtaggaaatcaattaatactatttaaatgaatacaaatacatgatgtaaaatatatcagagaagtctattatgtgttttcagacaagcttttatttctacagtgtatatttttatgaaactgatatgtatttttttagactaatgtgcaccatcaaatagcactcatttttgaaacattttgagcgtgatatgtatgtaccatcaaacggaattgagtaatatctgaagttgtactgggcactctgccaagatttgtccaaagaaagtaatgtgaaattagctttgcctttctgaatatttacaaaatccaagcaaaaaaagaaaaatccaaagggaaaatgctgatctctggaatactttggacaattcatgcatcaaaagccaactgcagagccactatttgcaagtcaagtctcaagatggtatactatctccaggaaaaggcttggaaggtaagtaagcactactgttgaccccaatatctcaatttccacggagaaaccatatttgttaagatgcagagagatctctctaaagtgctattgccgagattaaatttgagccatctgaaggcttcgtcattatcttagatcttagccttacttgtgccttattctgttctttaactatcacttatgctgcaaactgtgatcctattgtgattttacccttactaggtggttttcctggtaagataagtatttgattctgctcaaatttctcctcttgccttcctaactggtctcaatctttctttctgcttagtatcattctgtctcagcacccgtttatctggctgcgctttggccagtttcattgtttatgattatttggttttggtgcctgcctatatgatcagttcaagtcctagccgtgctggaaaatttctggccccattacagaccagacatttccactcacagctgcttctgtatctatcacaagtatgcattcatgcccatgtgcatcaatcctatatcaatagttgtttctacagagatagcctctgaagtccatccttttgtatatggtcataggtaaactgaaaatgggaagtaacaaggtctctgttaattaaaaggtccattaagggctcaatgccaaaagttggatacgggaaagcttgccaagtgcacaaggttagaaacttaattgcacttctctttaccaagatttctatcaactgcagttctcaaatatatgaccttcctttaattttgtactgatgtataaaatgaggattttgcctgtttttgtacttgccatttggaggacatatatgcatgcctgccataagtggaatttacatatgtatatgtaaaactacgattcttggctttatatcagtggaaaaataaatcagattatgtagatagatctgtctttatacctgatttgcttttatatatatatatatatatatatatatatatatatgcacacacacacatacattcatatttattttaatgggcaaaatatttgagaatatttacatgaaattttttatgtagtaatctaattttggaattgcactatttcttttgtagaactccaaaaataatcagtacacaaatttgaaagcaaaacagtaaacttgaagtcatttttggttactctatcttctcagaatactgaggtaattagactacagggtgtccttcaatacttgaaattatattttgctgtttgcaattaagatgcactgcagaatatgttgtcatggaatggccaccccaatggctgtcaagcagacatttttcttagccaagtcacacaggtaagtaacaaggtagattcaaggttgataaaaagcaaaagcaaatccacacttattggtttcctggtgtgacattgagtatactttgggatttcacagaagggttagtcagagtattccttcctatattttgatcagttgctaatacaggtttgattcctctttcaagtagaaatgactcagctataaatttatagctgcctctgtaggtagttaatgcaggtggataagcaatattgacagcatgactaagtctagccaaagcaggtgcatgaaaaattattagtccattctgcaaaaccctaggccatctattctgtaggatttatctgtcttttccattcccggtatcaagttcttaactactaaattaagcttatactgaagaggaggagctaggaaaatcttccttagatattcagatactcaatattccattaatcgattaattaaacaagaaatcaattaaatcacaatttatttgtgcacttttcatgtgacaagcatttcgctggttctgatctcacaagagataaacataagaaaccatttctgcacactgagaactcaaaggtttttgtgggagtcagaccagttatgaggctgcgttccagtttcaaaaatagcagtttatataaagagattgaaatttctgagaagattaatagaattcagacctgagaagaccgctcaagtcaagggacagtgccagaagcgagcatacccctagctgtgttatcgctgcctggtgatatcctgtgggtctttttattttataatatttcagagatgtgttctgtaactcatatatagggagtcaaattctgttatttctattcatgcctggcatataagactgatatgatcttactgttagacttttcatgaagaatggatgttagattcaggtatatatttttgaagttaaatggcccttgttacagatgtaccagagctccccaatatagaagcagttcttccaatattaattactatgtgttgtatattacaagttgccaaggtaccaatagaaaacacacaaagtcactgaatggaaaccccccaaataatgtaaaaaatatcacctcttttagctcttagaaaatgatgtcgacttctttctaaaggatattgttactggagggatgaggaaaaaactcaatttggaggaaattagaaaataatttgcagtttagaagggggttatcttatatacatgttggtaataattcaacattaacaataaatgttataataacaacatagttatcatagtaaactattttataccaaagcagtagtcccagaacttaacacatactaacttttgattcttattacagtgctatgatgtaggtatgtatgtcaccccgctttagatataagaaaaaaagaggcaaaaggagaccaagtttttccaaaatcacagctggtaagtgtcaaagcctagatcaatctagatagcctggttccaggtgccttagtcttagtcttttcaactgtatgctgcctatgaatttatgatacctcacttcttctcctatgctgtgctcatggtagtttatgttaatttttcagttaaaacatttgtcttttccaagtgtgcggtcatgccattggtctatttttataccactacctttgaacttttctccgtctgatgtatttctcttatctacatgtgtagatcattacctccagaataatagttgtagcaatgggcattgttgccctaatgggaattcttcaattgtcttccccaatatgtgtgagttggctttgaggttaagctaaatatatcttacagagctaaggtttatgtaagaaatcaacttcagaaatccagctgaaagtcagtagtgtgaagagaggtagtcagaatgtaaatcatttcaaaggtagagttgagagcatttcttgatagattggatgtgatgtgtgcaagagaaacagaggattcaaggatgactcattttttgattgtcattgtttttggtctggccagctaaaaaggagaatgtattacctactaagatgtggaaggcctgggaggagcaagttttgaagaaaggtcgagaatttatttattgctgtatgtattaatcagggttcttcagataagtagaaccaatagggtagatacgcagtgagagaagtagtgaaaggtggagaaagagagtgaagagtgagagactgagagagagagagactgttttaaaaaatggcttaagggtttgttaggatgaacaaatctaaaatttgcagagcaagccaggtacattggctcacatctgtaattctagcactttgggaagctgaggcaggaggattgcttgagcccaggagctcagggccagtctaggcaacacagcaagacctcatctcatatttatttttttttaattagctgggcatggtggtgtgtgtctgtggtcccagctacttgggagtctgaggaaggaggatcacttgagcccaggaggttgaggctgcagtgagctctgatcacaaacactgcattccagcctgggtgacagagtgagatcctgtctcacacacacagaaaaaataattaattaattaatttaaaaaactaaaaagcataaacaattaaaaaataaagaataaaataaaatttacaaagcaggccaacaggttggaaattctgacaagagttcattttgtagtctgaaggcagtctgggggcaatattcactcctcttcagtgaacctcagtcttttgtattaaggccttctaatgattgtatgaagtctacaaacaatatgaagggtaatttgtttttaccaaagtctactgattgaaatgttaatgacatctaaaaagtacctttacagcaacatctagtgtttgaccaaacaactggatgccataacctagctaagtggacatgtaaattgaccatcacagcatagtaagttttggatgcctactagacatctaagataaaatttcaaatagcctgttaaatacacacatctaaatatcaagagaggaatccaggcaagagacatacattcttggattcatcagaacacagatgtcagtgaagccttggctcctggttccgcagactgtacaagaagcatggtgtcagtatctgcatctggtgaagtctcagaaagttttcagtcatggcagaaggaaaaggggagcaggcatgtcatacagcaagagagacagcaagagagagaggggagggaggtccaagattattttataacctgatttctaatgagctagtagaggggaggactcactctttactctttactgcagggaaggcaccaagccattcatgacccaaacacctcccacaaagccccacctccaacactggggatcacatttcaacatgagacttggaggggacaaaatatccaaccagtatcaaatgctttacccaatttagcacagtgcccaatttattaaagtaagttttcaaacacttctttaaaaataggtgatatctctctattcctgatgacttaaataagatgaatcaattttaccccaaaactgtgtatgctgcttgaatgctacagaaaagaaagaactaaaatatattttaaaaatatctaaaaccattaaaatgtctcctggtgatatttaaaattagaaatagggcactacttatttaagtagtatattaataatgtgggaattggttgaatctttacctcttgtggttctggaactttccccttgcaattgtatatatctgtagatgacttacattatccttaactgagggaaaaaatgtgttatggaagtatttttgattctggttaatgcactttatataaaatgccaaacgtaaattattagaggtaaagatgaggctttgaaatttttatgaaatatttcggtccagaacttggttaacccaaatcctgtcctgctgatcatgcattctccatctggagttcctgagaggctctacatctgagtatcagagtatcactttgataatcactatttaatgtcttacagtatagtacagacctttggacaaaggatgaggtggtacaaatggagtagacacaaggcctgatgagaactttttaatttattttccccttaatgtgtgtcttactactggtataaacaagcatgcttgcaggaaggagaaagagatggctaaaacaaaatcaatttatccattatggattagagtccatgtataacagagagaaagagctattttcactatagatagcttcagatttatggctcaaaaactatgctgctggattgtgtcaaacagtttagtaaaaatgaaatattattctctcatttggcataagacatcatgttgctcgggcacaatgagtgatcctaaaaatataatatggttatagcttctgttaatcaagaatgaggtaaccagcagcttctgaaaacaaagactggtaatgatggagatctcccttgagacataaatctcatctgtgatcaaaagaagagtagccttggctcctttctggggatccctggcagccatgatttttaagacacattaacaaacaactctgtggcagcaggaacttcctgggaagacaacagtagaaggaccagagtagaagatgggggaaaatatcgaatacctaagaacacagaggaaaatatcagatactcagaaaaatatccaatgactaagaaataactcagaagacagcaggatttcactagagtagatggggatagaatctagaaatacgtaattttattgttataagatatatttcgtaatctttctccctgaaattggaagcaatgcaaacacagggctgctgcagcctctattccagaaggcaacctttctaccctgtagtgtagtggccctatttttttttttttacttctctttttccccacctttctcaattgcttttaattcaccaattatatattaaatctctaccatatgttcagtgtcaaactatatgccagtgtaaataattggtattacccttcacacatggtatgtctaggtccagaaatatacaaatatatgagtaatatgaattgtttaatattataaaatcttcctcagctgccatgttcagtggttgtaaatatactgtggaactatgaatggaaaataggtggaaacaaataaatgtatgctcagcaaattaaaaaattctaaccatgttcttactgctaagaactttctacctgcatatattcctggagtgtcaaacctgaaaatgatcttctgcaacatcagtttatttatattaatttgtatctattagacttaggaaaatagtataaaaacaggaaggaattccatgagggactaaatgaaatataaattcgtaatattttttatacctataaaaatgaggccaggtgcagtggctcatgcctgtaactccagcactttgagaagccgaggcaggcggatcacgaagtcaagagattgagaccatcctggctaacatggtgaaaccctgtctctactaaatgtacaaaaattaactggcagtggtggcatgagcctttagtctcagctactcaggaggctgaggcaggagaatcgcttgaacccgggaagcagaggttgcagtgagccgagattgctccactgcactccagcctggcgacagagcaagactccatctcaaaaaaaaaaaaaaaaaaaaaaaaaaaagcaaggatgtcaaatttgggaactattttctatttgaaactttccttctgtctctaaacaagtttaaaagcagcacccccacctctcaaatgcccttaatagacaatgtaatataaataggtactacaactcactaggtttgattcctgtagaagatgaaaagtgactgctccacggcaagccactatgggagattctttaacaaactcaaatggattcgagagggaaaattgttgatgcaaagctgtttaatgagttctgttactgtgaagtgaaatcagtcctcccaaggatcattcactgtgagaggcagaatggaaacttcctaatgtcataaattgttataccgatatttatagcaaaggcaacatagaactctggagtttgaattagtttttttctctccaagaatacatttttagtattagctgtttgtttcaacctgggaagttttagaagttatttctatctgggcattttcttagcttgacagtttaggtaagaagtctgtgtggctatgccagtagcatatctctttgtgacaagaacatgcatcattctttggctgagcaaaagacaaaattatttactcaagataagcaaagattattggaaggctgaaattgcaaatgatgaaagttctacccatagattttgtttgcccatgactttcattctgtccttgcaaataaaagaataacttgatatatttcattgaataatcacattttatatttccaatttactttattaaaatatgattttagtcctttaaataaagttgaattgagaacaaagagaaaaaaataatatccaataatgtcagttcagatattgtgggttaatttaaggatgaaataaaactatataaatttgtccatgtccccatgagtttctcagtgttttgaggttttgctcagattcatttacacatatggaaaactttttaatatctacataagggattcacattcgaagggatttcattttatccctcagtgaaatgaaatcccttcaaatgtgacttccttacaaagtctggccatagtcttgaattatcttagctgcattttctctaaagcgtcactgtccaactgaaatatactgtgaaccacaaatgtgaatatgacatttaaatagtctagtggcaacattgaaaaaataaaacaggaaaataattttaatgtgatataaacatttaatataacatatttaatatatttaatgtaaaagaagtatacttaattttaataaaataatctagttaaccaaatataaatgttaacttttcatcatgtaacgaatatataagaatgacccatgatttattttgtcttctttaaaagaggtttataatctttgcttacagatatttcagtttacactagccacatctgaagtactcaaagccaaatgtggctagaaagactattgaacagagacgctgtatggtacatattcttattagataactattatttaaggaagtagcataagaagatattttaaatgctaatttaaaattctaatgacaaagccatgttttatatgatatgtgtgaataaaacatagtcagatcttttaagtgaatgttttctttgtatatagagagagctgtttctgtctgtggaaaatttctgctgaggaaagaactaacaaatgacaaaaagaacggctttgcctgggacagtagcagaggaaactaagaaaaaggatgtcctaaaatgagttaagaaaatttttacttagaccctggacatcatagattataaaaggagcatttaatgacaaaaatatcataatgtctcaatgtacagtgaatcaatagtaccttgtgggactgttgtctgatactaattgaaacacagtatttgaaagctacagttgtttggtttgagtatgactgtcttcatcagcaagaataccttacatagtgtctgttctatttgctattttttttctattcttaacttttatgggtttatctttggcaaaagctgattttataaggagaaaatctataaattgcattcatggttatgccaaactcctcaggtacaactatcaaataccagcactttccagggaagattgtcttcaggatctgatcattcagcattttaccagaattgttgttggaatctatggagccacagtctctgttggactctatataactttcctccaacctggtcagaaccatagctaatcaagtaataagacattatgacaagaaataccccttacaaagacaaccaaaagagtcagcatccagtattgttaaaaacagttccaagtgtaaccaaatgtttttacttctcaatatttttttaaagtagcattattatatgtaaaatataagctttgtatggcagtagtttttgcattaagccagaacttactatttttcctgaaaatacttactaatgtacagaacttttttattataaaataatgattggattagaatgtatcctaatgactttcaaacatttaattttattattttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctgcagagtgtacaagcatagcacgggcatctgctcagcttctgaggaggcctcagggagcttttactcatggcaggaggtgaaaggggaggagccatgtcacatgggaaaagcaagagcaaggaagaaaggggaaggcgccacatataccaaacaactaaatctcgtgagaactgacttaataccatgagggcagcactgaactaatgagggatctgcctccatgacccaaacacctcttaccaggtgccacctccgacactggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagactctcaccaggtgccactccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctctgacgctggagatgacatttcaacatgagattctcaccaggtgccacctccgacgctggagatgacatttcaacatgagattttcaccaggtgccacttccaacacgagatgacatttcaacatgagatttgagtggggtcaaacatccaaactacatcattctgcccttggcccccacaaaattcttatgcttctcacattgttaaatacaatcatgccttcccaatagtcccccaaagtcttaactcactcaagagttaattcaaaagtccaaagtttaaaatctcatctgagacaaggcaagtcttttccacctataaacttgtagaataaaaattaacttatttacttacaagatacaatgaggttataggaatttggtaaacattcccattcccaaatggagaaatcagccaaaagaaaggggctgcaggccccatgcaagttcaaaacacagcagggtagtcattaagtcttaaagctccaaaatacactcctttgatgaaatgtcccacatacagggcacacagctgcaaggggtgggctcccagggctttgggcagctctgctcctgtgtcttttccgcactgaagtttcaagctgctgttggcaccacccgtctggagtgtggaagatggtggctcccttcccacagctccactaggcaatgtcccagctgggactctgtgtgggagttccaaccccgcatttccccatagcactaccctggtagagtttctctgtgagggctctgcccctaaagcaggcttttgcctggtaacccagcctctctcatactttctttgaaatctagggtgaggttgccaaaccttcactctcgcagggtgcatgcctacaggcttaacactacgtggaaaccaccaaggcttatggtggcttatgctctctggagtggcccaagctgtactgtgaggcctctgagcagtgactggaaccacagcagccattatgataggaggagcctcctgaggtaacactgggcagtagcactctgggcctattcccataccaccaaaaccattcagtccccctgggcctctgatgggaggggctgcctagaagatctctgaatgccttggaggcctttttctcattgtcttggctattagcacttgactcccttttagttatgcaaatttctttagtaaatgattgctgcacaacctacttgaattcttctcctaaaaatgggctttttgtttctaccccacagccaggctgcacattttccaaatttttatgctctgcttctcttttaaatataacttccaaatttaagtcatttctttgttcctgcatttgaagctggctgttagaagcagccagacaacttcttgaatgctatgctgcttagaaatttcttctgccagataccctaaatcatctctctgaagttcaaacttccacagatccttagggcatgaacagaatccagccaagatgtttgctgagggataacacacatgacatttgctccagtttccaacaagttcctcatttccatctgaaacctcagcagcctggacttcactgtccatatcactatcagaattttggtcacaactatttaagcagtctttaagaagttctaaactttccctcatcttcctgtcttcttctgaaccctccacactgttccagcctcagcccattaaccaattccaaagctgtttccacattttcagctatttttataacaatgccctatgccttggtaccaattttctgtattgggctgttcttgctttgctattagaaataccttagaccgagtaatttataaagaaaataggtttacttggctcttggttctacaggttgtacaagcatagtgcttgcgtttgcttggcttctggggaggcctcaggcagcttttactcatggcagaaggtgaagcaggagcttgcacacacatggtgagatgaggggttcaggggtaagagaggtaggggaggtgccacacacttttaaacaaccagatcttgcaacgacagcaccaagccatgaggaaaccattcagatgaccaaagcccctcctaccaggccccgcctccaacgttggtgatgttagaaatgctcgtttcccagtgccgtaaagaaatagcacttgaacataaatttaacttcctcagcaaggccatttttagactttctgcagaaaggatacactcgccagcagttttgccatgagagtatattgaacaaaggagactgggttatttataacctgatccatccactctacttctgtgtccagtttttattggctgaatcggaccttatatttagatggagaggaaagtctctttgaagaggaacctctactttactttttacagtgattacatttctagatgagatttgggcagcaacaaatattcagattatatcaggtagcgacataagaaaagtaaagggaaaagcaaaaaggagtgaagaaatgtacagaagggagaaaaaaagaaacaccgaaaaaagaaatagaaatgataaactttaaccgtaattattttagtgaataaaattttaataaataaaggagggcattttgtagttttttgctttatacatttaaggaatttttttttcctaagcttttcttactagttttaaaatatattaaaaaaaattaaaaattgtatacgtgcatctgcttttcttatttggaggctactgtaatgtttaaactgcattttatttattaatatactccttgtgtgagaaaggaggctcacaaggctatgtaaaattcaacaagctagcataaataaaatgtttggaaaaaataaatgacaaggcaatatgtgatcttaaaacagagtggtaatgaggtttaaaaatatataacattatgtccaaaaatgagattccattatgtctggcatgtaagaagagctcaaaagaagacagatttattttatgtgcttaataataaaagctaattgatgtattctagacacaatacccacagtgtcctcaggactttaaaaatctcatgcatattttacaattaaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgtgtttagaggagtgtgactggaagtggaaagacactttttatgacaagcgctaaaagaaagcagttcgttttggaggccttggaaaaagagcagggacacaggttctgcgtggtattcttttgcaaatacctgaaaccactagttgggaaataaattaaatgaattaataaactaggaactgtagtttgaagttagatggagtggatttggaaccgatttaagattttttaatgagcagatgattgatgaaattaattgtcacacaaattgatgtttgctattaatatttagctttaactgaatgaatacaaggtcagtgctcaaatattggaaatgttcctggactagacaattctaagattgctacaatgctgccagatccaccgttggactttccttaattcttattcaataattaatgaatatgaaattaatcttcataatgtaacattatgaagcacagaaacataaaaacaagtttatctgtgaatgtatcatagagaaaaatgagatttaacatttaaaacagtggataatagtaacattgaggctcctttacatctcgatagatttttaatgtctttgtccgtcaaagtattcaagtatttgtggaattcagctatgtaccagaaataaagtagatcaggtaatacaaacaaacaatttaatatatttcaggagaaaaattagaaaatattcctccttttacaacacgtataaagaaacagctaaattgataatctcaggtttttgctttgtattgaattttctacccgaaaagccttgggcagtactttttcaagaatgatgttcttttcatatttgactttaataaagacagcacattgcccgcgtccataaaatggtagatgagcaaattgctctgtgttttactgctcactcgactcctacattcatagtatttgacaagtaggacttaaatgggaacacttctttttttcttggagagggcagttactctgaaatcttaaatgaatcatattggagtaaggtgacataaatttccctcctcatttattaagatccaatctgcatgcagtactctgccagacacattatattaggttggttaaacagatatgatactagcttcttaagagaataaaaatcagatgatatcaacatagagacccagggttattattcatgacagtgccctgtgattcttcatgaactaatatagctcgcgaaagcgaagggatccaggaattctgtgataaatatgaggcagtttgtcctgaccagagatctaaagattgaaaacagtcatgagaggctttttgagagtctggaggacaagtccatgactgtaaggaggtcatggagaaacaagcaagtactgttacctgagcatcggtttgagtaacaaggagtagacgacgaagtgaaaggaccgagggataaaatgttggtgcccatggggtaagataaccatatcatgcagtcaggaatcccaacagaaactcttgcatattactaggtcaggatgcagatgagggaaaaaataaacatggactgcaagcatgaattctgatactgcagtggtgtagagatagcactacctacagcattctgcctaaagccaatgatctctgagtgggaattgacaaaaaagcaccactctttagagctttaggaatgagaatctaaaagaatttctcacatctccgctagccctcttggactctccattgtgctaatcatattcagtgctggtctctaacacttcaggggtctaaccgaatcacttttcttgtgtttgtgacccagcttgccccgaatgcacaccctttggatatcatccctccattcttggcccaatattgtcccttcactccttgtagatctgaatttaaaagtagaacaagcaggcacttgcatctgcctaaatagtcatgtgaactacattttgaacactagtgttctgaatcttcatttctgcaagatatctttaaagtgggatttggaattttgttagaattacatcagaattattgataataaggcaaataagctgctttccaagggaaacgggaaatctgtatactgtatagtgataaaaatgatgccattaaacatcgtaagttaagctctataaattacccatactccagatagaaaagcaaaccaaacagaattaacccagaaaagggatttcaaattatatagttaacatttgttttccttttttctaccctgggacttattgttatctattagtcaccttccttagaaaacatcaagtctgtggataaatacacttaatagtgttagcaggaatgctattcatgacagacctcaacatgttgactcgtactttatttaagctattatgagcttggcgaaaatctgaaagaaagacgatgcaatttattttaggaaatacttcttaaaagtaaagatttcaaatgtgggagatattcatgaatagaaagagttggttttgctctcattggttctgcttgttttgctactgtctagctatatgagggactttaggaaagccattcctaataaggtgggttttagttttctcatctgtgacattaaggaattagaaatgatcatgtaaagggaccatttccttctgttatactatagattgttattgatacacaaaatgattggttaattcaagttcaattttgttaacctgaaatattttgaattacttttgagagatccttgtttaaaagccataggcaattttgtgtgtgtgtgtgtgtgtgtgtgtgtgtgtgtgtgtgtgtcttttagctcagtggttatcaatggggcaatgttccctttcagcaggcatgaaacaatgagatattattgattgtcacagatatgggagagctactgcattgagtgggtagagactacaaatgctgctgaacgtcttctatgcacaggaaagccgtcccttaacaaataattatttggtccaaaatgtcagtagtgccaagattgagaaatcgtgcaactagttatggtccagattgatggcatacctcatccttcatgatatagtgatccaagtgccttgtcatctaaaccaaacagagcagaatctccaactctccctgccctgagaaaagggactctattttctgtcagacagtaaggattggagaccgtatttgctctcgtgcttgagagcccacatcattattgggttaacagtcatagctagagaattcagtctgtgtattttttttattagtgttattttccctttctcgtaatgtaacaatttttataaatgtttcatgggctatgaaagaagggcatttttcattttcatgccactgctttagcaatgtatagatacaatcaatattatggattgtgatttaggtgggtgttctatatatttacagtcaattaaaaaccattgaagagcttttcattgatttcattaatttctattatcttaataattctatattcaggcagggctactttagctatttgtgtgtatgtgtgtttccgtgtgtgtaaatgtataaatacatgtacatgtgtgtgtgtgcatatacatataaaatcaaaggcatacctagacctaaacaaaatattctgttctcatgatgtaattaatctcataagcaagataccattctctgtgtgacacagtttttttttctagttagaattcacattcactaaatgtttaacactctcttgatttcactttaaaaatagaacatcaggctcacatatggctgctctctacactagaactaccctcaggggtgcacaaattgaatacactcagtatttttctcctggagttttttaaaaactccatttatttccttaaacttttgagacaacagggctgatgttttctgtaatgaagttagctaaatgagctttttattgaaatttattcaataagattcattcttcatgtgtcaatcagatatcacgattaccatgctcaaatccaaattcaaatttttgttttatgagatttcctacacttctggagacttgaattctggtcttctctaacagtcattatctatttatctttaaataaataacttctgtacactgtggattgctttatttatactttggtaatagttttctgctcaatttgacccagagataggctcaggtagtaatattaagggcttctgaaaaatatcaattactatacatatatgagtaatggtggtagtataatttacacattagacagcaaagcaaatcaacaaaaactaaattaaatagggcaaaaagatgctgtggtacgaaattttctggataattttagttttagatcatgttgttaatttataattgagaatttgataaattagttcaatcttcattaccaaccatttgaaacactggctgatatcatggccaggtaaattgtgtcctttttttattaaacgtagttgactgaacacttgcttttcacacattgaattgggtcctggcaatacttggatgaatcaaattgtttccatatccttgagaaactgccagtgcaggcaaaatagggtaacagatgtaataataaatgcatgcacagcatagattggagcaaatggaagcactgacaaactcttcttttttaaaaaaaataattttcatttttttgctgatccataatgtggtacatattttggaggtacgtgtgatagtttgatgcatgtatataagatttaatgctccaattagagtaattgggatatttatcacctcaagcttgtatcttttcttggtgttgggaacgtttcagttcttctcttcttgcttctttgaaatatatttttaaaatgttaattatcatccacctactatactgtcaatcactagaacttattccttctgtccgcatttttgtaaccattaaccaacttctcttcatccctccctccccaatacccttcccagcctctgataaccaccattctaccctctatctccatgaaatccacttttttagcttccacatgagtgataaaatgcaatatttgtccttatgagattagttaatttcacttaacataatggcttctagttccatccatgtttctgcaaatgacaagattttattctttttatggctgactaatatttctatacacatgcacacatatatatatatatatatatatgtatcacatttctgtattcattcatctgttattccatatattggctattgtgtatagtgctgtaataaacctaagagtgcagatatctcttcaacatgctgatttcctttcttaggctgtgtacccagcagcgagattgaataatatggtagttttatttttagttttctggggaaggaacactatattgcttgtttttcatagtggctgtactaatttacattcccaccaacagtgtgcaacagtgtgcgagagttaccctttctccacatcctcgttaccattcataatttttgtctatttgataacagctcttttaactgtgatgagatggtgtctcattgtggtttgattctaatttccctgatgattagtgatgttcaacattttttcatatgcctgttgaccatctttatgtcttcttttgagaaatgtctgttcgggtcctttgccaatttttaattggattattattgattttttttgctattgagttgtttgagttccttatatattctgattattaatgccttattgtttggataatttgcaaatattatcaaattctgttggctggctctttactttgttgatttgtttcctttgctctgcagaagctttttggcttgatttaatcccatttgtctatgttgctttgcttttgttgcctatcttacacaaaaaatctttgcccagattaatgtcctgaagaatttccccagtgttttcttctagtagtttcatatgttcatgtcttacatttaagtctacaatccacgttaagttgattttgtatatggtgagagataggggtcaagtttcattcttctgcatatgtatatctcattttcccagcaccatttattaaggagcctgtcctttttccaatgcatgttcttggcacctgtctagtggacaaacttttaatttttctgtgagtaaaagcatttggacagatgttattgggagtggtaatatcattctttgttttacaaaacaactctgttaatagtggaaatgttaggtcaaaagggtgaaaaatgtttttcagagatatcaataaaagtctattgcaatgcaaaataatgtattgggtatggaatagttacaaaaatctttgtgatcttgattaagaagtgatcattctacaaatagtgacatgttgaacatataccatgttcttacctctgtgtttgtcatctcatataaactaagtgcaatagataaaatttggtttaatttgtctctacaaatttaattgtaagagtttaggatttgggatatcattaactcttttaaatctagagacaagcacattgcaaaaagattttttttttaattatcaggtattaaagacaactgagaagtgttatactgaaatacttaaatgacataatttaaagattaaaatattgaggtaagtgttagggtataggtctcacttagaaagtacctgatttttgttcattggattcttaagcacactcattagaactcaaatattagacataatcaatcaaccacttttaaacattatttattgaggcccatttagaatcttggcaaggtatgatgctggatgttacagagaatagggtgggtattgaaaaacaacaataatgaaaaataggacaggaacaaacacttgggagtttaaaaaatatggaaagctattggtctaatttgaaattttctttttctggttctttaagatcattcagtttatgtgtacaactgtattttgaggtagaaattgggatatatatatgaggcattttaaactgaaccatctttaattaataatttattctaccccaataataattaatattctagcctaccaatagtaaattcaaaattgtggtctaacagtatgtaagatactgcaatttcacaaagtataagatacaatatttctcaaaaagaagcatatagtctcatatcggtaagtaatcacctgactatgtgacgttaaatcagtgtcatttattgataattacacaccaaaggaatgcagcattttagagtcgtaagagacttccaaaatcctctaatctggcctcttacatgatttcatggaaaagatgtttgaattaattcaaaataatggataatagggtgaagacattccctaataccagcaaggagatttctactgaattaactctcttctagtggatagctcaaggggcaaccttttttatacatacaaatcaccctttgattgtaacctcttacgtaagttttcagcattagagaagaaatatatttgcctatttctaactttatagagaggattgaaattgacccagtgctccatctcatctcatgccattcaaatcactacacagattccgaaaaggagtctatgaggatgaagtggagtgaaaatgattaaaagaggaacttgctagaagtggtttaagttaagtgtgttactcaatgatcttcaggttgataagctcaactttagtattatctaagttatttatgacagtttcacagataaacgtatatgtggtgctttgaaaattgaaaaacgatgctggataggaaaacaggtggcaactgaaatattcataatccaatgtccctttaccttaatcatggactaaacaacagtttacagtacagtgtgtgattatattaagaatatgactaaacatttatgttcatctagtagaaaataggtgtgaattttgaaagtgataaatgactaccttggtggtattgtaagagctgtcaccaaaaatgagcaaaaatgatacaacgttttgttgtgtctaaatttttattcaaacaatataatttcttttgtaacatatgtctcattttattaaattcattttatgtgccacatattgccaaacagctcacattcaagtacttcaggagaaaaagttgtatctgctttgtatattgaaaataatcataagtttcttcatatgactagggattcaagctgaaaaaaatgagagatgggcctgttaacgtggatgaaatctcaaattaaacaaaaaccatgattaaaaaatggtgagagtaagcacgtgaaaagatgttaaacatcactaaccattaggaaaatgcaaatcaaaaccacaatgagacaccacttcacattcattagaatggctgtcatgaaaaaaatattgcaacaacaacaaaaataacaagtgttaacaaggatgtggagaaattaattggaatctttgtgcattgctgctgcggaagaaatggtgcttcctcaaaaaagtttgcatagaataactacatgataaagaaatgccactgctatgtatgctaggtatatactcaaaagaatggaaaacaaagacttgtacatatacttgcgtgccaattattataccaacattactctcagtagccccccactccccgaaaagtagaaacaactcagatgtttattgatggatgaatagaaaaacaaaatgtggtatatacatgcaataaaatattatttagccttaaagaggaaggaaattctgacacatgctatcccatagatgaatcctaaaatcattatgctaagtgaaataaagcagacacaaatggacaaacagtatgattccactaacactatgtacctaacacagtcaattcatggaagcacaatgtagaatagtggctaagatggtcatggaagcacaatgtggaatagtggctaagatggtcatggaagcacaatgtggaatagtggctaagatggtcatggaagcacagtgtggaatagtggctaagatggtcatggaagcacagtgtggaatagtggctatgatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagcggctaagatggtcatggaagcacagtgtggaatagtggctaagatggtcatggaagcacagtgtggaatagtggctaagatggtcatgggagcacagtgtggaatagtggctaagatggtcatgggagcacagtgtggaatagtggctaagatggtcatgggagcacagtgtggaatagtggctaagatggtcatgggagcacagtgtggaatagtggctaagatggtctggggagacggaataatgtgaagttattatttaatgagtacgaaatttcagtctggaatgatgaaacgtgtcaggacataacagtgatgatgtttgcactgcagtgtgaaaacccttaacaccactgaactgtacacttaaaaatggttaaaatgatcattttatgttacatatattttatcacaacaaaaatagaatattttaatcttgacaaacgtaaccacagaaaacaacttacaaaatagaatttcagaaatttttgctaaattggaatacatgctgttttatttctacgagaagatggatagtaggttatttggagctgaagaattataatgcagcttccccaaattgtgatctcctatgtggcagtggttagaaacaaataaaattcttatctcttatccttaaagaaaatcgaaattaccacacatgtatttattcagatagctgttctgagttagacggcaaaatagagcttttattaaaaagtaggatatattaaatttaaacatatataatgtgtagatcaaacattcaaaaagcagaactaattaaaaactggataaacattttagaccatattaaaaattttaggccgcctttctaaagtctagattacattggattaccattgtagaattgaagagtggttggttttgaattttacagttgtaattgcaaacttgcaaaaatatatattttaggtgctactatttcttaattttcattttgtaaattaactagctcttttgaacagcatttttttttcttagtatgatgcctatgagaaaaactacctgccttggaggaatttgtaatagagaaagataatatgtgtgtgtgcgtgtgtgtgtgtgtgagtgcatatgtaaatatttccatatattatatgaaaagtgaagttgaataacaagagaagtttttctttgctaaggaaaaaatacatttgtttttcattaagtaaagattattatactggcattattttgttcttacattggttttcagaaagttcaatggcatattccgctgtatgagccatgcagagctgcatttatctactgtattatcttcctcccttttttctagatattccttttttgtctgtgtttttcttcctgctggtttagtgttatgcatatcttattattttactatgcaatttcttatcttgttgtacccaagcgagttagtgagaacgccacactatgagatgaatcaagagtcctttattaagccggcggccaaagagacggctaacgctcaaaattctctcggccccgaggaaggggcttgattaacttttatacctaggtttaggaaggggagggggactcaaatgcaataattctacagaagtaaaaacatgcaagaatcaaaagaagcaaaatggttacagagagataaacaatttaaaagacaaatggttacaaaaagagcaacggtaccaggtgcaaggctctaaatctttcattataattagatacagggagtatgccggacaggaactcaaggctttatgttttctctctttaagaaaaatcctgggaacttcatacattgttggtgctagtaccttatcagttcattgggctcctttgaaatgctgaggatctgcttacacaggtcaactcctggcagaagcgggttgggtaaggagcccttagtgtcttgtaaattatggggtcaattggagtttttccggctttcccagctagagagagtcttatttacatgagaagcaaggctaggtgattaaagagacaagcaggataaaattcaaagtagcgagttagagtaaaaacaaggttaggcatttcaatcttaacgtcagaagattttgaggttaaataataaaaccaaatctaataaaagtaaattataaaattggtcacaggaaaaaaagggggaaatagataaatataatgtaaagagccaaaggtgagttgaatatagtgctgtactgaatcccgagttgggattaacctagacttgcagctggagttcttcagcaagctgtgatgtctctgacctagatttagctatttgatatgagatcttgtaataggtgaattttgttatgtgaagttgtgggggatgaagttggaaaggactttttatgtgacctagaatcatctgtttgtcatttgaagtcagatgaactattctctcttctgggaatctttcctacttctgcctattcatatttagggtaaatgattattgtgtttatctgagatgccctatggttatgtttgaatattacttacctgtctcaacaatgtttaatacggtagccactagtctatgttagactattgagcacttgaaatgtaattatttggggctctgagtttctcaaatcacatggttggaataaatttagactgcatacatgtggagggacagacctagttatttgattcatctttcccatgatgaatttaaacttttaaatttttttgtcagacctatgtcaagacaagtttcttttttctttctttctttttttttttttttttttgacagagtctcgctgtttccccaggctggagtgcagtggcacgatctcagctcacttcaacctccacttcctgggttcaagtgattctcctgcctcagcctcctgagtagctgggcctacgggcgcaccaccatgcccagctaatttttgtatttttagtagagacgggatttcaccatgttaaccaggatggtgtcgatctcttgacttcatgatctgcccgcctcggcctcccaaagttctgggattacagacatgagccactgcatccagctgacaagttttttttttaaatttgttgcattggttaagtttttttgtcttcactgtgcttgtactctgttaaggtcctagatttaatgcacaagcctcagttttaaccaattagttttggtaggcccaaagctcactggctctgtaagaggatcagaatctaattccttgatcagatatccaggtccagtgctcctctgctcctaccccttgtcaccacggctcttgcaatatattatctgtgtgtgtgtgtttgtgtgtgtgtgtgtgtgtgtgtgcgtgtgtcgtttcattagaaatctctaggtgttattttaggattgtttctgagttagcgtaattcctgatttgggggatcaagaagattttattaacagtattcagtgtccagtggaatgttgcttaggatttgtaagagaggaagaagatcaaaatagtgctttctgaagatttttctggttgtttgcctgtgagcatattacaaaggaaagacagtcgaacaagatgccatttatttaatggctttgatgatgaatgagaggaaacttgttttaaactgaacacaaatctaaagacaaatttactaaatataatttgtccttttcagatctatgtacagttactctcccttacaacgatattaaaaactctcacagacattttttttctcccaagaggattacattattgagaaatgtaaggggccttaacacttgccggaataattaatattttgtccgtcatctatctaagatgagttgtctcgaacagttctgtatctcatgtggctttagtttgatcttagaatactggcttagaaacctagggatagcatggtctggataaaaaggaaggtctgtaacaatgattgaggctattggtctatattgcaaaacattttgcacatttgtactttttaaagtttctcttttttattttacattgatgctaataaaaaggcttttaaaaaatttaccattatgttctaataaaagtccttgctttgatttggaaaggctaagttatgagacagccacataattttcattaatatcaatcatgtgtacaaatattttagcatgaattcttaaaagcttaccacgatttgagcacagttttgttgactgatgctttcaactttcaaggcagaagatattcaaaagtagcaaataccctctccagacttttttctctgaatgtgaaaagcctataattagcaagtattttgtcacttggtaagggaaatgcttcagagataaacaactcatggactgtgaaacactgtagcagaattccaaacatttagatttggaagttttttattcattcgatatttgagtgcctgttaacgtgaatatgcagtgctgaattggacagattttactctaatggaattaagaatctggaagagaagacagacattacatttatgattatagataggatatactgtaggtaaggagaagtgttgaattttctgaatgtttatatcaaagtaatttaggtcaagattatgattcacaaaatgtggttctcagacaagtagcattaacatcatcaggaagcttcttagaagtgcaaattctaggctccacccaagacatactgagtcagaaatactggggatggaactcagcaatctgtgatttaatgttttctaggtggtgctcattgctcaagattgagaatagctgttctaggtcagagtttctcaacttgagcactattgatatttgggccagaaaattctttgttacaggagtctgtttcgtgcattgcagtttgtttagcagcattcctggcctctaaccattagatgccagtagcatcccccagtagtgacagccaaagatgacaccagaaattgccaaatatctccagaaggcaaattcttattagcagttccctgcttcccctcccccacattgccccaggcaatactcaaatgacttgccctgccttttatcttatcctatagtgtgtggtaaggtgctctgaaacaggacaaaggaattccaccatgtttattcattatgaaagaagtaaatttgagcccaagaccagagatggtccaagttctggtcattttagtctttcattttttgccttgttttcaacctatttttcttctcacttcaataaatactcttatatattaatcctgttttatccttaaatagtaacacattctgtttatgttctaaacttagtgatttgatgaatctcatgtaattaacatgacggttagactcaggcacctgcactttccaaagatctttgaacataattaagaaagtgaagggcataattttaatagtaaatcaaaatattctcattgatgaattatgttataataagtctctgtcaatcacagattctcttgggaatttgtttctttccaagaagtgctgagtctttctctgtagttactcatctattatatttcaaaagtgtttctgaatccatggttatgaagtaggaatatccagtttcttatctgtctgttaaccaagttccaaagtgttttagttttctgggttttagactataggtggtcctgtttgagattgctaagacccaagtagataagagtagttgcatttaaaaagcagagattactgcaagtatagaagtaatgcattttggtaggtttgcaaacatatgtacactttctaaaatgtctagatagctgtgtacctatggaattttttcacaggttagttttgctggtaggcctataacaagattcaattatcattaatatttggctcacattagctaactcataagggtcagtgatatggtttggctctatgtccccacccaaatttcatctcaaagtgtaatccccgtgtgtcaagggaggcacctagtgggaggtgattggatcatgagggaaattcccccatgctgttcttatgatagtgagttcttatgagatctgatggttttataagtgtggttaccctgctctctctctctttcctgtcaccttttgaagaaggtacttgcttctcctttgccttctgccataattgtaagtttcctgaggcctcctcagccatgcagaactgtgagtcaattaaatctctttcctttatgaattacacagtcttgggtatgtctttataggagtgtgaaaacagactaatataagaaatttgtaccagaagtggggtactgctataaagataacatgaaaatgtggaagcaactttggaactgggtgacaggcagaggttggaacagttgggagggctcagaagaagacaggaagatatggaaaaatttggaactttctagagacttgttgaacagttttgaccaaaatggtgatagtgatgtggacaatgaagtccaggctgaggtgatcttagatgaacagtttcctcagagatgaggaacctattgagaactggggcagaggtcactcttgctatgctttagcaaagatactggtggagttttgtccctgccctagagatctgtagaactttgaacttgaaagagatgattttgggtatctggtggaagaaatttctaagcggcaaagcattcaagaggtgacagagcataaaagtttagaaaatttgcagcctgaccatgtggtagaaaagaaaaacccattttatggggagaaattcaagctagctgcagaaatttgcataagtaatgaggagctgaatgttaatagcgaagacaatgaggaaaatgtcttcagagcctgtcagacctccatggaagctcctttcatcacaggcctggaggtctaggagggaaaaatggttttgtaagatgggcccaggaccccactgctctgtgcaccactgggacttggtgtcctgcggcccagctgcgggtctaggaggtctaggagggaaaaatggttttgtaagatgggcccaggatctcactgctctgtgcaccactgggacttggtgtcctgtagcccagctgctccagctccagccatggatgataagggccaaggtacaactcaggctgttgcttcagagggtgcaagcgccaagccttggtggcttccatgtgaagttgaggctgccagtgtgcagaagacaagaattgaggtttggcaacatttgcctagattttagagcatgtatgaaaatacctggatgtctaggtagaagtttgctgcaggggcagaaccctcatggaaaacctctgctagggaaatgtggaagggaaatgtggatttggagcccacacacagagtccccactggggcacttcccagtagagctgtgagaagagggccactgtcctccagaccccagaatggcagatccatgtgtaagaattaaagaaagaagaaagaaacatgaaaagcagctcaacagtcaaagacacttttattttttaatataaacctgagagggacttctgaccgatttcagtcaggagcactctctcttacagactaagagtatttaaggattcagggtgggaaagcttatcacaggctcggaatgtttctgtgtctctttgtcttgcttctctgggagagagactttttgtgtctatttccatatatcttcctgaagctgcaggcatacccgtctgagttgcttttacctttcctatcttagtgcacctaaagggaaagggatgtgcttattaggtccactattttactggggcccattgtattagtgtgaagtttggcgattaccaacacaccttcccccttccttctgtgcctgagctgccttatctgtgttttactgtctgctcattctggctgcttgttgttaaaagagaagtgatttccttgaaatgcacgaggttagaaagggagctggaacttaaaacagtggtatttgaccaggatgacagtgctcttgctctatcaccatgaacagcttgtaatgtgcacctggaaaagctacaggcactcaacaccaacccatgagaacagacgcgggggtggaacactgcaaagccacagtggtggatctgcccaaggccatgtgaatacaccatttgcattagtgtgtcctggatgtgagacatggaatcaaaggagctttaagatttaatgactgcccccactggattttggactaggatgggggcctgtagcccctttactttggccaatttctcccatttgaaatggggacatttaccaaatgcctgtacccccattgtatcttggaagtaactaactggtttttgattttacatgctcataggcggaagggacttgctctgtctcagatgagactttggatttcagacttttgggttactgctggaatgagttaagactttcagggactgttgggaaggcatgattaaaatatgaaaagggcatgagatttgggaggggctaggggtggaatgatatggtttgtccctgtgttcctacccaaatctcatctcaaatataatccccatgtgtcaagggagggacctggtggtaggtgattggatcatgggtacggttcctcccatgctgctcttgtgatagtgagagagttctcataggatctgatggttttataagttgtggtgtcccctgctctcttggtctttcctgctgccttttgaaccaaagggacttgcttctcctcatcttctgccatgattgtaagtttcttgagatctcctcagccatgcagaactctgcgtcaattaaacctctttcctttgtaaattacccagtctcaggcatttctttatggcagtgtgaaaatgggctattatagtcagtgagggtcaagcatgttttatctcaaccaacaacagattcttgggtaggatggcagtaatgcagtttgataccaaaaggtgatggataggatgatgatgataataaataatatgtaataagaacaaattttagaaggatatgtttcaaagagtacagaagtttgttagacctgactggtattggatagacataacattgtttaagttcgacagaaggagaagatccaccctgtgtggggaacaatgagaacaggtctgaggtacagtgaatgagattgttgatttatgggaacggtgaagttttggaaaatacacagaatgagatgtggcatacttgaaagattctattccagggaaaacatacacacactggaaaatggagatctcccttagagactcgggatagagaaagaagcagctaaaaagaattgggttctatcagaataaaataccaccagtcaataagaagataatcaattaaaaacaggctaatgacaaacactaccataagatgataacaaaagtctacctgcattaaataaactgcacaattgtactttaatgtagcgggaggtagaacatgtacccttgaactaaagctaaagccaagtgagccccctcctcccttgagtatcatctgctagtatgggagaaaaataattcaagacataatcctgatcataaggaaaatagaatccaatgtttgtaaaacttgctatataaagaaaagtattgcttactattgctggacaagaaaaattcaagatatgaaattctgatcattaaaaaggatcccaaaatttattaaaatattatgtgtaatgaaaagataataaatatttattgaatgaattcctcaattttcctatgaattgagaagtgctcatgaaaatgcataggtaaattataaaatgctattccatttcattcagggctctgctgagctgaaataccacagagatccctttccagactgaattgtttgaaaaagttctccctatcactttcttcatagcacatatcatttgaggttttactatttttctgtccttcactagagaataagcaccatgtggtcagtgagttcatttgttttaacttgtggtctctcatacctagaatagttctggccaaatagaagacactcaataaatatttgttgaatgaataaatgaataaaaaaacttcattaaatattttgaagggattttcatataaaagaaaaagaaatgctgaacttttcagcaaagtaacccatgtatttgagataaaattaactcctccactttaagtttgatttacgcaaaaaaattgtacatttttaaactataattgtaacctgataaatatattttctaaataagttaataaattttggaaaacatttgatgcaagatatactgtgagagagccatgagatctggccagttgaccatgttactattggaaatgttaataaaacagtaagattgctgatgttgctttccattagaaaaaaatatcagagaaacatatgctaaggggataaacaaaaatgaggagtctagagtctacttgatcttagttattgagacaattctattaacaagagagtggggggccaatataatgtggtctattaacaagagagttaaggatcaatataatgtggtccttaactatatccttacataatttgacacatgaatgtgcaacatagtaaagcattagtgactttatcatgatgagcatcagatttaggatcctgtaatgaacacatcccagtctctcttctagctaaatattgaagtcagaatggagagattgcatcctttggaggcttgacggagactttgattgccatttggccttaagctccatatcaagctaacatgaattagaaaattattcccacactgctgtaaaggtgaagccatagactccatgtcagatcctcggcacatatgtaattgagtttgtgccataaatagcaaggtagtacagaagttacgtgaaaattagtctgtactatagttacaaatatgtatagtaaaaattgtgattaaattcagggcattttaaacttgagttgtccttttattattcggagacaaatatagtaaaatctagaggagtggttttaccccaaaagcccaagaattattcatcagcagaacaaaggcataaattgaggcctcttgaatcccaatccttttgtactctttaatacaggtactcttggatttatggtgagtttatgtcccaattagcccatcataagttgagaatatcataagtcaaaaatgcgttaaatactcccaacctaccaaacattatagcttagtctagcctgtcttcagtgtgctcagagtacttacattagactgtagttgggcaaaatcacctaacacaaagcctattttataataaggtgttgaatatctcatgactgcatgtcactgcctggaaaaagataaaaattcaaaattcacagtacattgaaattgtgatggttttatatcatcgcacagtggaaaaattactaacttgaaccagcataagttgaagaccatctgtatatgacacttacctgcagagaatcatctggattctaactgaataaagccctcaactgagatttttttattgcgaaactttgatttgaaacacagtgaataaacatcaaaatataaggtacaaagatacaagtcaatactttgaatataagaaaagcaacctttgacaataagattccaagaccaggatagtcaacattactctttcatcgtgactttaggatgaccaaggcaggcacaatgaagataaaatatggcatatccttgttcttcttcagagccatgagtatttgctttttgtttaaaggtgtttttagcagcttgaagaagctgctaaaccattttttgactctgaatgttcaggaaactatgttgagctctgaagatgcaataatttttaagttatctacatatatctctctctttcttaccaaccatacatctgtgcaccatgttagattttatttgttatgattctcaaaataggagataatgaaaatattaacagactgctgtttagtttataaaatgctgtttttcagttaatattaaattctgaacaatatgactagtattcttatggttgtcttactcatgaggaatctgaggctcatagattgtaatttgacacaaattacaaaccttctaaatggaaaagcacaagatagggatttctgactccaaagccagtgtttgtttgtttgttttcttactgtgttgcttgtagcatctacttacaggcattattattattgcttaaaaaatcttgccatctgtttacattgacttaccactttagaaaccatttgctaaaaagttgacagtataataaaagtattccattattaaggatgaataattagaactagatgtgaaaggtgaaagggtagagtttaaatacatataatttattatttaagaaacttctaataaagaagattcttttacaatatgactgactataccttccaaaatttcagtgaatgttattaaatcagcatcctcaaagatttcatgtctgccaagtgttgcagacaaaaataaaactctttgaaagcatcttgccaattgtctctagctcctttatgtgatgaaatgtttgtagatttattataaaatcataatttccattttagtattttcataatactatatttgatagaagtcacttaattaaaagtgttgtcaagggaagtcagctgaaaattaagaaagcacagacagctgcctctgttgctaccatgaaatttatgtcttttaagaagtactttattctcattcaacaatgtttgcatgttggttaatttcaaatgtatctttcaaatttatgaatgtataatttttattaaacaaaaacattataaaaattaacgcataaaagtgaaatactcatgtttttatacagttaaatttagaataaatgtaagttttttgaaggaacaaagtatcgtttgtataggagagaaagaatgtgtgtatgtgtttgtgtgtgtgtgtgtgtctgtgtctgtgtatctgtgtttatagaggtggtgaaaatttattaaatccccccaaaatggaactggatatgacattatagtgtatttggtctacctagaccaccttacttgtcaacagatgggagccaggagactttaaataagtatcttaaggtcacatagtatgttagtagcagagcagaactagaacagattttctcattctcagttatcttttctcattactcttcttcttctttagttttatttgttatttgtgataatttacagtgcatttgtgaattgacatgcctatgagacttctgttggcctactttgcttaatcctaagagggctattacatgaggacatctgaattgagaaaggcaggaaaatgtatttaggtgtgacattaatttgtgacctatgaaagtgctgtagcatgcccccatatctaggccttcagtttaaacaaattggttaaataggggctgtggctcccacactctctaattcctaaggcttttctctcccatcccaatgtaagtcaatgctgattgaacctcgttcacttaggagtgtccttgtgactgccttctgggtataaatgctcaagataatgatgacacgtatggtaactgtattctcctgtattctgagagatgaaagtgaactgtgattctgcttgcaaggtatctgtgcctgcttgtattcttccccagcatttcccagtctttctgacttttccatagatcttcatcatttccatagacatttgtcttccttctttttttaacttttacatgtcatatgggagtggcccctgtaagtatcatttgttcttacccaactttctctatgacataagaaaccttttaaatactgatcaaaataattcaggcaatgttctttaataatataaaatataagtattgtgtttcagatgaatcagacatattcgtttagtaggtcagattctccatatcattatagtgatgagcatatagtaggatttatggaaatacttcacttacatttcccttatggagatgacaatagtaagaatttttactttttttcttacctttcactacgtaaggatgagcttggattatttattttaaaatccataattaggcatttccaactacttaatatggtttatataaacttactaggaatatctgttgaattaaaaccttaccttatgtttgattttaaatgtacctgtcttaatccttaaaataagaagggtacatttttttcaattactcctcacttaagaaaagatattcttgagtagttatttataataaggagatcatggactacttacattttaactcaaattcttcttaagtgtttacatttttaaatattgattattgctagaaggaactcatacattaaattggcatactctttttttattcttttcttgccttattttcaattattctataaattagaaaattttttttcttagaataaacaaaatcacagtgttctgagattttgcaaagtctatgtcactgaataacagtgaatatgatttttccttatgaatgagaatattttctctggcaaaaatagaattaaattagaaatcaactacacaaataaatttgggaaaccctgaagtatttggaaatttatgaatatatttctaaaagaggtcacaagaaattgtaaaatattttggactgaatgaagactaaaatccaacatttcaacatttatagaatgcaactaaaacggtagttttgggggaatttatagttttaaatgtctattttagggaagaataatattctcaaattaatatccctagcttaatcttaagaaacttaacaacagaaaagcaaagttattcaaagcaaacagaaggaagaaaataataaagattaagatggaaatatacccaaaagttaattctttaaaaagaccaacaaaactgacaaaatcttacctagatttactacaaacatgagggaaaacacaaattaccaagactgacaatgaaagagatgacatcattaggaccctaaagacattttaatatattataaaaatgttattataataatttagataactagcaaaaatggataaagtcatggaaggacccaaattaccaaagtggggtcaatgagaatttgagagtatgaataaaactataaaattgaattagcaatttaatatcttctctaaaataaaagccctctatctcatggccttattcaaaattctgtgaaatatttaaagaagaaatagtagtaatctttcctactggtaccagtaggaaccataaaaatgtattttattaataggctagtgtaatcctaattctcatatcagacaaatgcatcacaaggaaacacaaccaaacagataaataaacaacaaaaactacagactaatatttttcataaatgtagaggcggaagtctttaacaaaatattaacaaactaaattcaagaacatataaaaagcattatacactgtgaccatgtaggatatattccagacagtcaaggttggtttgtcatctaaaagtcaaataaggtaatacattatattaacagaataaagtaaaaagcaacacagtgaactcaatatacagaaaaaaattgaaaaattctaatagtcatgataaaaactctcaaaaaactagtaataaaagggaatatctttaaaatgacaaacagtatttagttcacagcggatataatacttaatggtagagaatgttaatttaatatttctattaaaatctgaaatgaggcaagaatgtctgttctcatcacttctattcaacatagtactgaaagatctagccagtgcattaaaaaggaaaaaaaagcaattaacagcactcaaattgaaagagaaatgtacaattattttacttctcagatgacatgatcctttatgcagaaaatacaaagagatccataataaactacttgaactaataaacaaatttaccaatgtcataggatacaagattaatataattgtatttctgtgtactttcaaggagcaatctaaaaatgaaattatagaaaaattatatccatgacatcagaaataagatacacaaaaaaattaagaatataatgtaaatgtaagtataatatatattaatatagcataattataatgaatatgaaataaatataaatatgtaaaataacatcacaaactaagaatataaataaaaaagattaaaaaatctgtgttaaaaactacaaaatgttgctaaaacaaattgaagatctatataaatggagagacattccatgttcatgaattgtaagtctccatactgtgaagatggcaattctcccaaaattgatctatacattgaatgcaatttctatcaaaattctaagtaggctttttttggaggtagaaattgatgagctggtttagaaatttatgtgaaaatgttaaggacctaaaacagccatgacaatatttaaaaataagaaaatggccatactgcccaaattgatttatagattcaatcctaccccaatcaaactactgttgactttcttcacagaattggaaaaaactattttaaatttcatatggaaccaaaaaagagctcacatagccaagacaatcctaagcaaaaagaacaaagctggaggcatcatgctacctgactttaaactacaccgcaaggctacagtaaccaaaacagcatggtactggtaccaaaacagatatatagaccaatggaacaaaacagaggcctcagagacaacaccacacatctacaaccatctgatctttgacaaacctgacaaaaacaagcaatggggaaagaattccctatttaataaatggtgttgggaaaactgtctagccatatgtagaaagctgaaagtggatcacttcctttcaccttatacaaaaattaactcaagatggattaaagacttaaacataagactaaaaaccataaaaaccctagaagaaaacctaggcaataccattcaggacataggcatgggcaaagacttcatgactaaaacactaaaagcaatggcaacaaaagccacaattgacaaatgggatctaactaaactaaagagtttctgcacagcaaaagaaactaccatcagagtgaacaggcagcctacagaatgggagaaaatttttgcaatctatccatctgacaaagggctaatatccaaaatctacaaagaacttaaatttacaagaaaaaaacaaccccatcaaaaagtgggtgaagaaaatgaacagactcttctcaaaagaagatcattatgtacccatcaaacatatgaaaaaaagctcatcatcacttttcattagagaaatgcaaatcaaaaccacaattatatatcatctcacgccagttagaatggcaatcaataaaaagtcaggaaacaacagatgctggagaggatgtggagaaataggaatgcttttacgctgttggtgggactgtaaattagttaaaccattgtggaagacagtgtggtgattcctcaaggatctagaactagaaataccatttgacccagcaatcccattattgggtatatacccaaataattataaatcattttactataaagatacatgcacacatatgtttattgtggcactattcacaatagcaaagtcttggaaccagcccaaatgcccatcaatgatagactggataaagaaaatctggcccatatacaccatggaatactatgcagccataaaaaacgatgagttcctgtcctttggagggacatggatgaagctggaaaccatcattctcagcaaactaacacaagaacagaaaaccaaacaccacatgctctcactcataagtgggagctaaacaatgagaacacatggtgaacagtaaggggaacatcatacaccgggacctgtcagtgggtgaggagctaggggagggatagcattaggagtataggagtaatacctaatgtaaatgatgggttgatgggtgcagcaaaccaccatggcacatctatacctgtgtaacaaacctgcacattctgcacacgtaccccagaacttaaagtataataataaaaacaaaaaagaaattggaggaattgccatacccgatttcaaaacttactataatgttacagtagccaagaaaatgtggtactatcataatgacaaaaatataaatcagtgaaatagaattgaaagtcaagaaataagcccttaggtttatggccaattaatttaaaaaaatagcaaggcaattcaatgaaggaaagaatagtattttcaacaaatggtgataggaaaattatatatccacttgaaaaaaaatgaatttagaccctgataccacaatagaaaaaaaattcagaatatagaagaccttaatgttagcactaacactataaaactttttagaaaaagactaccagataatcttttaccttgatttagacaaatattcttaaatgtgatatcaagagcatcattcataaaagtgaaaattaataaacttgacttattgctaagagaatgaaaagtcagggagaatgaatttgcaaaccttatattttatgaagatcttatatctaaaatgtattttaaaaaatcaaaacaaatcaggcgagagattttaacaaattttttaccaaagaattcatgtgattgggtaatacatacatggaaaggtgctcaccatcattatctttcaggaagtgcaaattaaaaacataatgaaatacctctatatatctacaagaatacctataatcaaaacggcaacattggcaaaatgcggagagactagaacctttatgcattgctggtggaaatacaacacttggggagacaacgtgacagtttcctaaaaagtaaaatgtgtacttattacataacccagtaattccactgttatttatatgccaatgcaaaacgagacatacagctatgcaaaatcttgtacaggaatgtttatgacaacattctttatatacttaaacactgcaaacaatacagaattctattaactagtaagtggataaaaatgtatatatatacagtggaatatgaatgattaacagtaaaaagaacaaactcctgtggctactataagatggataagtcctgaaaacattatgctgattaaaagaagcatatgtactgcgtattgtatgattccattcaaatgaaaagtccagaaaagccaaattttctagagacaaagagcagattgcctggtgattgaattttacctatacaatggctaaatttttaagatatgaacattacacccccaaaatgagagacatggaaggagtaatcagagccatttccagatgtaatctcagcctcttaccatagggatgatatggactggaggaaattctcaagaatgtgattattttaattatgatgggaacaaggtaactataaagaatagaaaacaaacattttagagataagccctgattccatttctgtattgaatttacagataattgtttagacactacttttgatcgaaataacatatataagctatttagacttaaaagaaaaagacatgtagaaagtttcctctagttgaacaaaaccttcaactgctttctgtattcctattttgactctcgaaaagaaagaaaatgaaaaggcaaacaatgggtgaagagcttttattcaactacattcttttacctgatatgttttaggttcaataaaagccaattttatgagtttgtggatatatatacacacacacatatatacgtattgagcattgcttgaatattgagacttttggaatgatcaggtatagtaaaataaactctgatatagaggactagaaagaaaaatgactttttaaaaataaaacaggtgcatttgtactttgaatgtacagtgtatgtgtcacatgtttatatgtgatacttatgcacattacttatatacgtatttaatgttaaacatgtaaaatatacacactaagagtacatgttttgtttatattttgctaggttctcatttaatcacaaggaatattaacctaattaaggcacaacattttctttttgccatattctaacagcaaagataaagagacactccagtgtcatgttatatgtatgacagatgcttacagtcaacaattgccactgcaaacagcattggttagcaactgtattaaacttagacgtactgttggtgatttgggtggacttaacagttgtcaaaatttggggtaagtcagttttcatcttgtgagtttgatttttttttttttttagtctgggtcatgctctgttgcccaggctggagtgcagtggcacaatgtggtctcactgcaaccaccacctcccttgttcaagtgattcgtctgcctcagcctcccaagtagctggaattacaggcacgtgccaccacgcccggctaatttttgtatttttaatagagctgtagtttcaccacattggccagggtggtctcgaactcttgacctcaggtgatccacccacctcagcctcccaaagtgctgggattacaggcatgagctaccacgcccggctgtgagtttgattttaatataaagttttctaaccacatgaaagagtttctattgttttgattaccatggctataattgatctcaatttttttcatgcaggcaatattagcattgtgatacataaaatatatactcaatttaattctttgggagtgaccaccagctctctccttaactgactactctctagggataaaaaagcaatttgaggaaatttgggccatgtaaagatattgtaaacatcaaaattgtgagaaacaaaaactaaatataatatgaattcaaattgtgtgtgtatattcacataaaatctgtccaacttccaacagttgaatgactggaattatttctaacttctgagatttgatattggttctatgactaaagaacaagctggaaaggactaccatgttattagaccacccataggtaaaattattttcaaggcttacatagtaaaacatatattttatatatatatatacacacacacacctttgtttgcattattatactagatattgtggctataaaacagaatagaatatgaaatttgtcctcaaggatgtaaaagtacatttatctttttctttcttctcagaacattgtaataaatgtagtacattttcctctgtagaattagtaaccatagtattcatttgaatattcagtggtaatgtgagtttcaatttttagctttataggtactttctagtgactgatataataggtttcagaggcccattaactctacctggtgtccacataagtaatcacatactctgttgtatgaatggcttacatttttcataacgacctgcaaatataaaacctttctttctctccctattagttattctctcttggcacgtaagtagaagagacataatgaaataccaggagttttatctatttgaactcaagtaatatctcccaaggtgacattcccatgggtaaaaaagcagtcttcttcatttttgtgttttaaaacacttatttagatctagacttaagtgttgcttttcttgtaggagtttgaaaatgcttaacagtctaaagttaattattactctttacaaatatattcaagtttctcaagttatctaactggctattcttcctggctggttgcctgtagattttcttagaaaatttgctactttgacagggtagagttacatgatattgtccctactgttgtattctggatgtctctcatgctgccctatcagaatcccgagaaatggcataggaagatcactggagggtacactgagcataaattgatctggctactgccaggtcttgagaatgagaagagggaagagttgctgtgtatgttgagcaattaaagtactatcaaatgaatctgatcacaacatattgcctggaaatatgctatattgctatggcaaagtctattttgtatatgagattgattgttccacatgagggcaggaacttgtctttcataatgagtcagagaagtgacaatttctcgttatatttcagagttatgggggattgactatagtgtgtattctgcagatatgcctcaaagataaaaataaattaaatgcaatggaaacgtgttgatgaatttaaaaagttgttatttaacctattggtatttattagctcccctgtggcttctatgttgagaataaaaagatgaataaaacaagtttacactaatatcttgtcatctcaaacgctcaaaatagtcagtcttaaatgactgatttgatgcttttttttttagtaaaatttaaaacctagtgactaaaagggcattctttggagtggcagagatgttctatgttttgattgtgatggtggttatatgcttgtatatatttgtctattaaattttccattaaatactgttaacatgggtagattttgttatatgaaaatttgactcaaagtaagttgatgttggtcaaaaggtgcagtttcagttacacaggatgaataagttctgaagatctttcatacaacatggtgactatagttaaccgatatcatattttatacttaaagactgctaaaaagaatagattttaaatgttctcaccacacttataagcaaaaactggtaactctgtgaagtaatggatgtcttaaccagtttgattgtagtaatcatttcacaatatacaggcacatcaaaacatattgtacaccataaatatatacattttttccaactatacctcaataaggattagaaaataaataaaaatggtttattttctctctcattatataatagatgataatgtgtaccagtactgctggtaaaagtattataaataatatttgctaatatatattaatgcagttacagattattttccctttgttccgatgttctgattgtggaataattactgagtatagagttaattccaggcttgctctttctctctgtttctttcttctctttcactcacataaactaaaggcataatttaataaatgccctttcgtgtggacctttggaatgtcttttattccattaaaacttagagaaattgaatggtattttaggcctttaacacattgtttaatttactattttcttctaaagaattgggatttcaacaatccaaaggtgcctcaagcttaacatgttcaaaattgaactccctgttgttcctcactaacttgtatcttctgctctccaaacttctgtgaatgataccgtcacttaccagtcacacaagacagaggtctagaattcctctatgcctcccttttcctggtcctttccctatgaactgtattccagtcccatcagtccacctccttgacacttcctggatccattcccctggagttactgttgtgcttccatcttaattcaggctccatttatcttttacctggcctactgcttttctacaattaatacttctgcagcagcaaggtgatcactacagtgtcaaattggttatgtgaactcctaaagtttaatcttttactaatttcccatttcctaaaaggttagaatccaaattccttggtatgacacacctccatggtatgacatggaggacaaggtcctccatgatatgaagcctatccacctcttcaatagcaattatagaacccgaccatatttaataagtttatttaatattgaatacagaatccgaaaccgtaataggttgtctcacacatatataaaataaaagtattataaagaatatttgctaatgtatatttatgcagttagtgattattttccctttgctctgatgttttttgtttttgttcctgcttttgtttgagagagtttcactctgtcacccagtctggagtgcagtggcacgatctcagctcactgcaacctctgcctcccaggctcaagcaaccctcccacctcagcctccccagtagctgtgactagaagcacatgccaccatgcccggctaattgttttgtatttttagtagagttggggttttgttatgttgcccaggctgctcaaacttctgagctcaggcaatctgcttgtctcagcctccgaaagtgctgggattaaaggtgttagctgctgcgcccagcctataatttttaattaatttattttctctatctggaataaccttacacaaaaagggtcatctagtgaaatagctactctgtgccagtgtcaactgcatttggaaattactcatattcctctgagggataaatgaccaactcttccttataccactacagcatcctatttctatacatgcattactttgtaagttctttgcagagcatttccataactgattcagctctgagattcctataccacacctggcatctgacacatggtaaacaccaaatccttgacaagttactgactactatttatattttatgtgatttatttaagctgaactaattatgatgctttcaaaatttaaatgtgtatagttttaacatcaatgaaatccagaagagatagttgaaggaaaggtttctgaggtttttaggatggaaggaagcataggtaaaagatcataaaactgtcagcagctttttaaatatatagagtgttacataaacacatatctgtccataagtagtgatgccataaaattgtctatccttcacctcaaatacacaaagtgtaatttattttttctttaatggatttggtcttccttatgtgatgagtattgggatatcatactttattttggtccatttgcgtctaatctcacattagtctataatgctgtagattcaagtatccctttaggcagtgctgactttcttggttaaaaatcctgtctctcaaccagtacctctctacctccttaccctaaagtggcatctgagggaagggttgacttcctaacctcttagtgctgagataagatccctgcattgtgatgccctgcgacaaatgtgaattccttttctttttttctcctatattcctgcagttgctggtctctctgttggtcataatggctgagctcctaaactgtttgagtccagagtggcatatttcttgtgtgtccagtagagactggtggtcctctcttgcctacccaagctcttcgtggctcatgatggtgacataggctctctgaatcacggcttcaattgttatagggtcctcactgttcaacctccaggccactttgccggtccaactctactctagattaccctgaaatgattcaaatgataccatgtgtctgtttccattagtgaagggtgatgtgatagagcagtcccagtcataatgtctttggagctagaacaagaatataaatggagattattagttttacattaaatatttaactcatgaatcaatctgacagtttgttaaaaatatatgctatccttctaccttgacaaaaatatcttcttaatggtctggagagccagatttgaattgagaatcatctgactccttaaagttctgcagccaaaaaaaaacacaaacaaaacaaaacaaacaaacaaaaaaaacagcggtacaggagaactagcacctgacacctgccctgtgtctaacactaggttttttttcacccctgaggctgttagcatcttgagagcttcaaacaaacatgtgtgaatgccccagcctgtatgttgaaactgtttacacatgctactcctcaggcccagagatgcccatataggtggctcaattcattgcaaagaggaaaaacccagggaatgaactctcacagaccagggcagagggcttggagaggaatgttcagagtcctgggtagggatggattccagacaggtataatatcaataggtaattatggcctccccttggccttatggaatccttgccacatgagtaggagtgagctagaggagggagagagaaccctccaacgtgcagagactgggtgtccttgatctaaggttcatacttactcagttcacagttagatttccataatctcaagtctaaaaggctcctatctaccaacgtcctttcttaaggtcttctgtttaattataccatggtctcgttctccttttatattcttaaaaagaacaagtcactaacacagtctgcctgggaacagtacactttttggtaacatcttagagcagaaaatatatttaaaaagcaacaatataaagaggaaattaattttctttttgtttcctaagtattacttaatacttacaatatatttttcctattacttatataggtattgccatcgacactttgtaagttgtagtaatacacactcataaattcagcagttaactcctctagctttgcacgtaatgctgttatttcttttaaaacacacggttatcctattacgcatgtgaagcttggaataaaatatatattaaaatatgactaaaaataaaaacagattttataggctttggaagtactatactttaaaagatctatatttttcacactgaggaaggagaactactgaaataaagtgtactgtgtcaaagtattacacacagaatatgagaatggcaatattgaatatccttgcccaactgtggaaaattaaggattaagatttgaggaaagtctaaatgcgttaaaatggaaaatgtaggccaggcatggtggctcacgcctgtaatcccagtactttgggaggccaaggcaggtgtatcacctgaggtcaggagttcatgaacagcctggccaacatggtgaaaccctggctctactaaaaatacaaaaattagccaggggtggtggcgcatatctgtagtccagctactcgggaggctgagacaggagaatcacttgaacccataaggcagaggttgcagtgagccaagatcgtgccactgcactccagcctgggtgacagagtgaggcttcatctcaaaaaataataaaaataaaataaattgaaaataataagcacaacattttgtcatttagttgataaatctacagtttagagtttgccatgagtcaaacactatcgtttcccaagtgaattaactttcataataatttgcctttttaaaaatgataattacccattccataatgggtaattacaggtaactatattttaaaagaactcactattactgtttatgtatctactgatttgaaagtgaaaatgtaaaaatgtttttatcaacatcaccaagatgtttttctacaaattctaactgaattgtattctactctataaactgatagacctttgctttagaaacttatgtggaaataccaatccagagaaatcctgtctccctatctcccacctgggactctttagaacctttagtattcacttcaaaacgtctgatatgggaattatagtgtggtgttctttaacttttaatatcacagatcccataatttggagcatcatgtaacattttgtagagctactattcctcagaacacaatttgagaaatgttctaatagagtcattttccacaaataggaaagtcctacaaatattattatactaaatcataatgaaaactagtctgatttgatgtattaattataaagtagtttagattactttaacttttggtgattattgccaaaacttctttcctattaagagtattctacaataaattaaatttagtccacatataatgctgatcatatgtacagtaacattaacatctaagatgacagagtaatatacatcttattacttttgtgaaaaatagaaagggttacataataaaatattaattgtctagaatttggctttctagaggcttgatatactgtgatgtagcccttaaaatatggatgttcttgtcagaaatgtagttctatattgggttctacttttgttgtcagtatgactgggacaggttactggatctctttaggtttgtttactcacaggtaaaatggtggttaataatatcttcctggaagagttgtgatactaaagagatggcctatatatgtaaaccacctggcacctggtagaagcattgattactcttctaccattcattttctttgaattcaattttttttgaggaagtacttcttggtgacagtgaagttccttaaccctcaagaaaaagagaaaactcagattcttggaggaaagaatgtagcactctcttttaccttgttataaaaggttaaattttcccttcagaaatttggaaggcgtggggaaaatttaagggagcaataaagaagaaaagcagaaatctgaacatagatgacaataaaaagaaatgataaatacatgcatgtacactcatgcatgtttgcacacacacatgcacatgtgtacacatgcccaacaaccacaaacacatccacaaataaaacaagagacactggccaggggcagtggctcacgtctgtaatcccagcactttgggaggctgaggcggacagatcatgaggtcaggagttcgagaccagcctggtcaagagaccagcctggccaatatggtgaaaccccatctctactaaaaatacgaaaattagctgggtgtggtggtgggcacttgtaatcccagctactcaggaggctgaggcaggagaattgctttaacccgggaggcagaggttgcagtgagccgagatcacaccattgcactccagcctaggtgccaaaacgagactctgactcaaagaaaaaaaaaagagacactgaaaaaaagagaaaattaactgtgatgctcactattcctgtgaggttgatttaactgctacctgcactgcaatttaatatgatgaacttaagagtacaaggcatctggaattaatctgaaaaattattattagaataatgacacttgaagtgttgacttttgactacaatggaatatttattaactagaacattctgcatacaggcaggaccttgtgaagcaaaatttatagctttgtgttcaggaatgattacaaacaaagatagcagaatcagggctttattagagtactatgcaacagttttgctaaatatatgttaaaggaatctgaaagaataaagagaatcatgaagattatcctaaggattctcctaaggaaattgagctttctgtgctacccagagaagggcccagatggtactggattcccgctgtaacttaaagggaagcttttacaatgtctggaacctgcgatgtcttgaaaatgaaggtagaggatgtcctcaagtttcttacagcaggaacccacttaggtggcaccaaccttgacttctaaatggatcagtacatctggaaaaggaaaagtgatggcatctatatcctaaatctgaagaggactcaggagaagcttctgctgaccgctcgtgtcattgttgccattgaaaactgatgtcagtgtcatgtcctccaggaatactggccagagggctctgccaaagtttgctgctgccactggagcaactccaattgctggctgcttcactcttgggatgttcactaaccagatcctggcagcctttcaggagccacagcttctagtggttaataatcccagggctggccactgtcctctcacagaggcatcttttattaacctgcttactattgctctgtgttacacagattctcctctgtgctatgtggacattgccatcccactcaacaaaggagctcactcagtggggctaatgtggttgatggtggcccggggagttctgcacttgtgtggcaccatctcccatgaacatccatgggaggtcatgcctgatctctacttctacagagatcctgaaggattaaaaaggaagagcaggctgctactgaaaaagctatgaccaaggaagaagaatttcaggatgaatggcctactgtagctcctgagtttgctgctactcaggctgaagttgcagactggtctcaaggtgtgcaggtgccctctgtgcttattcagcagggctctgctgaagactggagcactcaagactgccacagaagactggtcttcaactcccacttctcaggccactgaatgggtaggaacaaccgctgagtggtcttaagctgttctttcatagatactttttttttttttttcctcctgagacggagtatcaccctgttgcccaggctggagtgcagtggtgcgatagctgactacaacatccacctcctgagtagctgggattacaggcgtgcaccaccatgcccggctaattttttgtgtctttagtagagatggggttacaccatgttggccaggctggtctcgaggttcttaagctacatggcaataaggttgttggaaaataaacattattgtctaaagaaaataggaaagtgaaatataaagttatgaatttaaagctatttagaagggcatgaagaaagaccaaagaagtattcaaactgaaattattctaaaatgaaatttcaaattaaatttaatctagtttcacattgctgattaaattttagatgacactgtacaaagctatctgggagagtgaaaccacatgacaaatttactggttgtcattttctactttgtgattttagcctataatcagttttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagactagtttccgaggctgagcatggtgggtcacacctgtaatccgagcactttgggaggccaaggtgggtggatcacctgagagcgggagctcgagaccagcctgaccaacgtggagaaaccccatctctactaaaaatacaaaagtagccaggcgtggtggcactttcctgtaatcccagctacttgggaggctgaggaaggagaatcacttgaatccgggaggtggaggttgcagtgagctgagatcacaccattgcactccagcctgggcaacaagagaaaaaaaaaaaaaaagaaaaaaaaaaactagtttctttaaaatgtggatatcagttaaaatctgtgtattgtattgcattttgaatgcactggattaattccatttttaaatgaaacgtggaaaatcttgttttaagatgaagaatccttgctaaatagaatctctgaaccctaaaatggcttttttaattgggaattttcaaaatatgaatttggttagttacaacaaacaatcaaaatccttacctatgaattgccctcttctaaagcaagaatgttcaactcggatatctagtggtaaagcaaaaagagatttccctgttagtcctcttacaggttgtgggcattgcttatttgactttgaaacattaaagaagaatgtgtttcagggcagacatgttggtaaaactgtttctgttacaaaaattttagaggacaacccaacgttttaatgtggtgaacctcatttatcatcctgtcactgcaccatcttttttcagtttcatcctggaccagggtttcatggcacagaaaaaaacctggccatcaaatcatagcatatgaacaagtagatggccaaatgtttgaaagcataaacatgcctctctcattgggcactggttgagagggttcgaagcccattatttgtaattgcagttcagactaggagaaaaaaaactccatccagaagagaaacgattggaatgtttgtatggatttgggttttgatagcttctgtaacattccatcactgtttgtgtgagcattttccaatcagctgtcccaacatcaaagccatttctgcataatttttttttctctatattgcttgttcttttcaaaatttggttttctatccccttctcccccagtctcagtgagatttgcattttaatgtatgatctgtctaatgtattgtctatttcacttctaacagttacatctcttacatttacaaatgtacttcaccatatttcttccagacagtcacctttcttattattttactgccctcatgacataatattgtaactatctgcagctcttggacaaagagaacctttccagaagagctttcaactttttctcttttgccttggagtatgtctctctacctctattatgttcttgtaagtgataaatatcttatgagttttttttgtctatccataatgataatagaatctgagcattaatatttattttggtggaccatgcacaatttctaaaatccataatttattttcataaccaatattacagtaaattcattaagcatatacacggtttggaggcttattggcttaataggttcaattcatagaaaaggataattcactacctactcaaaagcatcctaccttgagagtcagctaagtggggaaaggaaaaatatgcttttctcttcagacagcctttgtatcagtgtttcagtaacatacatgactacttattgccatttcatttcttctctttgaatattgcctttgcctctcctgggacagtagagttaatcttataggaatacctaattccacgaattccttagaatagtataaggctgtgcagtgattggcccttaccttgctctctggtctctccttccaccaccggcttctgagaggttcgcagtcttacatcttgaaaaccactttcagtttgtgaaatggaccaggattcttctttttcttttctttttctctcttttatttttttttttgagacaaggtctcacactctcacacagactggagtgcagtggcatgatcattgctcactgcagcctctacctcactggctcaagcgatcctctcacctcagcctcctgagtagctgggaccacaggcatacgctaccatgccagactagtctttttttgtttgtctgtttttgtttgttgttgttgttgttgttgtttagagacaaggtctcacgctgttgcccagactggtcttggggtcctgggctcgagtgatcaactgcctcagcctcccaaagtgctaggactgcaggtgtgagccacttcactcagccagaccaggattctttcaagttttggtgacattacttatatttttccctatttttggaatattctccccatctgattgcactggaacagctttctaacatttttttcaaggctttgttaaaccataaaattaaaaaaataaaaaaacattccttgagattaattctcctggctgtgttgtgcaatccttctaggtgcctgcatgctctgtgcttatctttaatgataataaccctttatgtgttttaaatcatttactcattctgacaagcatattcagtaaacaactgtagttatcatcagtcctattttatgaatgtagaaaataatgcaaagaaaattaagttacttacccaatgtctcacagctaatggtagaacaaattttgaagaggtctgtgacaggactgtccattagaagtcgaatatgaactaaaaatgctatgcaatttttaaaaaatttcaagtagatatattacaaaagcagaaagaaacaggtgaaattcattgtactgttattttattctcaatatcatttcaacatatgacctataaaaatgagattttttttatttcttcacactgagttttcatatccagtgtacattttaaacttaaagcagatcttgattcagactagcattctagaacacatgtgcctaattgctacctttgttcaacagcacaagtctttactcttaattacagcacccctctttgtattgaaatagttttatttgcctacctgccccattctactgtgtgcatctttactaggtgaagaatgtgctattcatttctttatttcaagtatatagactagttagtgcctaagatatagaaacaataaatgcttatggaattttgttgctgcagtattgcagtggcttcagagtacagagatttttggatactctttttagcaatcattgtagaattgaaaatctaaaagattcaaaacgcttgacaaaatttctagaaggcatgtatttgcctgttagacttctgagcaggtcatacaagaagattgggaagctatcctggaagttagctgtagcccctacagacagtagaatatgccaagtttccactttaagagtgcatgtaaatgctatgacttttactaaaaccacatggcaatataataaatgaaaatgtggtctaaacgtgttctggaacatttcctaattattataacatattgtattttgttatcattatttagtagaaaaatgggatcagaattagcattgtaatattattttggtaaaattatgaatgggatcatgcctcatacatagtagatgcctaataattattaatctgatttgatttatttgagccagggttagtaagttcaacttctactggtttctgttatttatttgagaacctattcaacttgccatcattgggacaagctgggacagttccttaaaatgaactctattagagtcaaattgttccatctgttttccctaaatgaaagaagattcccttgatgctagtcaatgagtgagggctccttgactcagaaccagatgcaagctttataccagccttccatttcagcccaattacattcttggcagcctgtgagactcatggggtaaactttttataacaattatcaatatcagccaatttttcagaatgggcaggaataaacttcaatggctccaggatgagttttctgtcttccaaagcctctgtctggctggctgccatggagaatatgtaggagcataaaggctgctgttttatgtaacactctagaaatcagctaactttatgactacttagagttttaggattttatcaatctaaattaattatttaatattggcttaggctacttttttgtgacatagagaacattatttttattcctgtgatacagacctccaaggtgtgtgtgtacattacatagcaatgactggagtctggtttattgttgactccctcataaagctattgtggacgaaagagagaaagcatcttactgatgggatatagaatcagtgaaaacctggaaccattgaattcccattgggttagtgtgtgtatattaggatgggaggtttggggaagtagagtggaaattgatggtgttatgagatgacgtcgtgacctttaactcaggaatgactcaatcctgtcaatatctaacaatccctatacattgtgatctcaggtagattgttttgcaatggcaatggcaattatgaacacacactattattcactgaatgttcataatcacaaagggaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaatctgcaccctgaccatgtgatagaaaaaaaaaaaaaaagcccatttaacagggaggaattcaagcaggtggcagaaatttgcataagtaaagaggagccaattactaatagccaagacaatggggaaagagcctccaaggcatttcagagacatttgtggcatccactcccataataggctcagaggcctaggaggactgaatggtttcatgggccaagcccagggccccactgccctgttcagccttgggacactactccccatatctcactctgctccagctccagccagaaaatttgcagcctagtcatttggtagaaaagaaaagccatttgcaggggaggaattcaaacaggctgcagaaatctgcataagtaatgaggaaccagttgccaatagccaagacaatgggaaggccttgaaggcatttcagagacctccatggcagtacttctcctcacaggcccagagacttaggaggtctgaatggttttgagggccaagtccagggccccacggacctgtgcagccttgggacactactccctgcatcccagtcacttcaccactagccatggctcaacaaggcccaggtacaactcaggccaccacttcagaggatgcaaactgtaagtattggtggcttccaagtggtgttaagcccatgggtgcacagaatgccaaagctgagccttgagagctcctgcctagatttcagagaatgtatggaaaagcctggatgtcctggcagaagcctgctgcaggggcagagccctcatggagaacctccaggaagccaatgtggagggaacatgtggggttggagtccccacacagaatccccagtggaggactgtctagtggagctgtgagaagagggccaccatcctttaaaccccagaatggtagatccaccagtagctttcacatttagcctggaagagccacaggcactcaacgccagcccatgagaacagttgtgggggctaaaccctagaaagccacaggagtggagctgcccaaggctttgggagccctccttttgcgtcagtgtgacctggattgagacatggaatcaaagaagattattttggagctttaagatttaatgactgcttttctgggtttcagacttgcacagagcctatagcctctttcttttgaccaatttttccattttggaaagggaatatttacccaatgcctataccaacattgtatcttggaagtaactaacttgtttttgattttacaagctcatatgcaaaaggaacttgctttgtctcagataagactttgagttaatactggagtgagttaagactcggggggactcttgagaagatatgattgtattttgaaatgtaagagagccatgagatttggaaggtgccaggggttgaataatatggcttggatttgtgtccatacccaaatctcatgtggaattgtaatctccaatgctggacctaaagcctgatttgaggtgattggatcaacagggcagattttcctttcgatgttgttttgtgataatgagtgagttctcatgagatctgatgttttaaaagcgtgtggtacctctccactttccctcattctgcagccgtgtaagacatgcctgctccccctttgccttccaccataattgtaagcttcctgaggcctctccaaaagtagaagccactatacttcctgtacagcctatagaactatgagacaattaaacctcttttctttacaaatcatccagtctcaggtatttatttgtagcagtacaagaacaagcaaatacagagagccaatgcatcacatggccagagtagaagcaaaaaagttaggggtaagatgccacacatatttaaatagccagatattgtaagatctcactatcatgaggacagcaccaaggatatggcactaagcaattaatgagaaacctgccaccataatccaatcatctcctaccaggctccacttccaacattggggaatgacattcagtatgaaatttagagagtacaacatccaaactgtgttaatactgttacagaaatactcaacaaaatactaacaaactgaatttagcaacatgtttaagagattatacaccatgacccactgggattattcctgtgctaggatggttcaacatataaaaatcaatcatgtaatacactacattaacagaatgaaagataaaaattacatgatcatcacaattgatacagaaaaaatcatttaataaaaaattaataccctttcgtgatgaaaactctcaacaaactaggaataaaagaaaactatttcaatatattctaatccacacatgagaaacccatagcacacattactcgcaatggtgaaattgctgaaaaattgtccttgaagatcagaaaaatgataggatgctcacttttgccacttctattcaacatagtactggaatttctgatcaaggaaattagccaagaaaaagaaataaaagccttggaaactggaaacaaagaggtaaaattacttctgtttacacatgatgtggtcttagaaaattttaaagatttccaaaaagtttgttagaactaattaaaaacaataagcaaagtgacagggtacaaagtcaatacacaaaaatcagttgcattttgatacactaacaaacaacccaaaagaggaaattaagaaaacagttctatttgtagtagcaccaaaaggattaaaatatttaagaatttagttatctaaagagataaaagtcttgcatacaaaaagctacaaagcattcctggaaaaaaaagatatatattaatgaaaagctattccacatacatggattgagagacagtattgttaagatgccaataatgtccaaaacaatatacacagattaatgtagtccttataaaaatcccaatgattttttgcataaatagacaaacccttcctaaaacttatatggaatcttaaggtatccaactaatcagtacaatcctcaatatagaataacaaagcattgagctcatacttcatgatttcaaaatttactgcaaagccacagtaatcaaaacagtgtggtaatggtgtgttagccctttttttgtgtgttgctattatacatataaagacatacctgaggctgggtaatttataaggaaaatgggatgtataggaagcatggtgctggcatctacttggcttctggtgaggcctcaggaagctgtcgatcatggcagaaggaaaaagggtagctggcatctcacattgtgagcaggagcacaagagtaggggcaggtgccacactcttttaaacaaccagatctcatgtgaactcggagtgagaactcactcattaccaaaaggatggcactaagccattcatgagggatccagccccgcaatctagtcagcttccaccaggccccacctccaacactggggattgcatttcaatgagattgggaggggagaaacagccaaaccacatctattggcataacaacagacatatagaccaatggaatagaatagagggcccagaaataaattctcaaatatgtggttaacttattttcaacaagggtattgagacctcagtgaggaaaagacagtactttcaacaaatgtcattgggaaaattgtttatctacatgcaacagaatggaatgggattgttaactaaaatgatgtttaaaaactagttctaagtgaatctatcacttaagtgttaaacctaaaactataaaacatttagaagaaagcaggacaaaagcctcaagatttgggtttggcagtaatatttcttggaaatgacatcaaatgcacagacagcgcaagaaaatatacacaaattggacttataaatttttttaagtgtgcatcaaaagacatcatccacagagccataaggtaatccatagattgggaagaaatatttgcaagtcatatctatggtaagggattaatatccagaacatatagaaaatgcctacaactcaacaagaattacaaaacaaacagcataattgatagacaaaggagttacatgaatatttttccaaaaagatatgcaaatatccaataatcatgaaaaaagatgctcaatgtcactaatcattaggaaaatgcaagttaaaaccacaatttgataccacatcacattcactatgatgcatactatcagaaagaaagtaaatagaaaatatttggtgatgacgtggagaaactgaaagtcttgtgcactatttggtgggaatgtaaaatattatagctgctgtgggaaacagtatgatgtttcctcacaaaattaaatgcagaattactgtatgatctataaattattcttctggataaatacccaaatgaattgaatgcacggtcttaaagagatttttatgtacccctattcatagcagcattattcacaaaagctaaaatgtggaagcaacctaagtgtccattgatggatgagttggataaacaaaatgtgggatatacatacaatgggatgttattcatccttagaaaggaaggaaattctgacatatgctacaacatggatgaaccctctaaggttcatccatgctaagggaaataagctagtggcaagtagacaaatactgtatgactttatttatatgaggtacttagagcagtcaaaatcatagacacagaaagtaaaataatggtttccaagaagtgcagtaaggaatgaagagttactgtttaatgcgtacagattttcagttttgcaagatgaaaggggttctgaagataggtggtggcaatggttatccaacaatatgaatgtacttaatactgctcagttgaaaacttaaaatggttagtatggtatatgataaattttatattgtgtgcaatttactataattaaaaaatgaggaagaaacacagtttaattttaaataaaaacacacatgtatatatatatataaatttttgatgtgataaaatatggtctcccataagaccaggaggacttaatcaaatttgctccagctttatgaccttctttagcccctctgaaagtcatcactccatatttgctgaggttcgaagttgggtgtgcaccagtctggtagagactagctccacttttagccatatgctgttgtgctgctaccatggtttctcacatttgttaactgacactgacaaggctgaaagaagcagtggcatgcaccttgcaggggagacatgaatgcgtccacacctgaatttgccatgttcagacctcagttatttcccctaatagaacaaattctgatagtacgaggaatgttgagagctaccccttcaactatagcctctgggtgctgcaggccataaccaggtcgggtgtgtgctataagggggtggagatcaagcagcaccatcccctggggcagctattaaaattttcacttccaaattgtatttaaagtctgtctcccattggaattctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacccagggtacttttagtaagatgagatatgtgagccataaactgtgtctaagaagataaagtatgaaaatatatgttcaaaaggagctaaacaactgcatgcttcacatttgcctccagtaattcaagaagagatgaagtgcaattactcatatgcccctttcaacatactactgtgggtcaactgggtccatcatagaacagtattagggaagatcttctatgtcatgaataaagagttgctcaactgtggcttaattatcatttaatagtgactctcttagcttcataaagtacattcttcaaagcttgaagctaagtagaaaggcaaaagaacacacaggttggagggtaagcttaaggaagcagtataagcatcgttcattcattcagagataaccggtattgcagtaagtaggctggacttggaatcgtaattcaggagttttagttgctgattcttcactgggttcaatgaggcttttttgatgactttttcatcatggatgaaatgaagtcgttggacaagatgacctccttggttccgtccagctctacaaaacattttggagccaattattttgtcgacttttttctcaggggtcctttatagaaacagtgtataaaatttactgataaagtaattaactctttttgacagttttccttcagttagattaatattttcagggttcatctatcttgtactatgtatcattatttcattctcttttattgataaaaatacttcattatatgaacatatcacctgcatatgattaatgtatttaatattgtcaacttattcagaatataaatactatttgtagagccctatattagtagaggtaaggatgagaatattcaaattaaatgagaaggattacacatagcaactataacacaagaacaaaccatttttgtttcaaagttggtaaaaagttaaactttacttggagtagatgaaacaaataccaggcaaatggcacattgttttgtttcatattacaccagtagtttcggttttacagccaaaatatatctaaagttttgtatttgaaacttttgtcatctcagttgtttccgttttggtcatcactattttttcatatacctttaaaaaataaatttattgatataaaatcatatagcataaaattcacccttttattttttaaaaataatttttattgtgtctatttaatgtatgtatacatcataatgttataagattatatatatatatatctgcatacatagtaaaatagttagtataggggaacaaattagcatattcatcatctcacatagttacccattttttcctccttgtgataaaaacagctatgaaatttgcctttttaaagtgtacaattcattgtttttagtatattcatagaattgtctaaccatcattgctgttcatttctgaaatgagttcatcatctccaaagggaaatctagtacacagtcatttctgattttcctccccccagtctctagcaatcactaatctactttctatttctatggattttcctatttgaacatttcctatagattgaattatgccatatgcagctctttatgactgtcttctttcagttacattcatatttttaaggtttattcctcgtgtaccatgtatcattccttcattcatccttattgacatataaataccaatattattatatggatatatcacattttatcaattaatcagttcatgatactgggatggcttcctttcatcatagccttactaccttaacatcttcttattttttcttttcattatgtgtgggtgattaacctctgggattttactctattcttgctttgttgtctcatccagtttatatatgaattccaaaatgctcaaaatgggaatacttagacactaattcaatgagatacataaataccaaatatatactcagtcttattcaaagtaattgggtaaataaggaaattttaatattttcttctaaaaagagtacacagccattttgatggttaatggtagtatctgataacaggatgaaatgtaggtagggtggagaattaaaaaatgcttactaaatcatggtagttacgttacctccatcatcatcatactcaagatcactttattggatacatactctgtggaaggtacttcatttttaatatgtattatagtatttgatattaaaacaacttattttggacatgtaggatttttaaaaaattatttcagatgacaaaagtaaattacagatagctaatgtaaccagctccaaaattaaatactgttatgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctgtgtgtgtaaaactaatattgtttgggaggaattcataattcatagaagaggtggactttcaaattgcccatgatgttagatgaggaaaatttggttaatcgtgatgagaagtgaggcagggtcactagtttgaagaaaacaaccacagcaataaaaaatgtactctccacattcatgttctaacactgattgatgttaagttgtaggtttagagttcagccttactggcagacttacttgtaaattccgactgctccttggccaatctgattattcttaacaactcaacaggagacttgaaactttaatggagatttgtgattctcccagggcgtatatctatatcttctcagcagtgtcagactgatctgctgccaacatgtttttccccctctcagtaaaataaatctctgactacacatcctggcaaaagcacacatttctcctggcaagcttcctcaatgggcatcgaatatcttgagatttcagacaaaatcatttttctccaggggaaacatgactcgtgtagatgacaggaccccagacaaacagcaaactctgctcagaattttaacaattactaaaaacatatttcctatcacagactcatttttttttgccaccagtacaccccccccccacacacaaacacacaggtgcacacatacatgtgcacatagtcaattttcctgtacttacctgcattatgaaatgccaaacttatggtgagtttggagaggcaattttttttttttacaaataataccctccataaataaacatagttattatgaatgcacactcattgtgtaatagatctgtggtttgtgtcacttagccaactttgatcattttctgtcatccagaaaataacttctttcttaacaaccaacacataatcaatgcttggcagtaatgggcatgtgatttaggtttgtgcctaattagcacattgcataccactaatgtacagcacaggaatgagtacctggaccatctatgaccaatgaaagcaagggacctcctactgagaaccctggaaaatatagttttggtttttttatgttgtcttgaaagtgacaggctgtagggattccatatgctatagtcattttttgatcatgaagagaaagcttgtctgaatggagccatctgaaagaaaactatggtaagatattagtcatgcccctgatgacaacactgaagtatctgtatcaagtcatgcatgtctgcatgaagccctacatgcagtcagccagttcgggaggtaatctcattcaggcaggagtttctgatacttcaaaaagcaataaatagtcctttagttttctcccacctcctacctaaaatagaaaatggtaacaatgacttatctatcaattcttagctgatcatccttcttctaaaaacattaacttgtatatcgtgtcacgtgcctgtagtcccagctacttgggaggctgaggcaggagaatcgcttgaacccgggaggcagaggttgcagtgagctgagattgtgccactatactccagctgggcaacagagcaagactccatctcaaaaacaaacaaacgaacaaatattaacttgtataatagctgtttacagttaggtaagttacatcctgggcataagaacaaatatgattaagtccattatacaattttaggctcatcagcattttttcttaatcatctgaatttttctcataaactttaacactgttccaaaaaaaaaaaaaaaaaacaaacaaaaaccttaaagcctacatatgcttgagaagttattttatccaaagaaaaacgacaacctattgcccaaagttattgcctcatttccacttgctattaccttagaactaactagtgttttgatattagtaaccatcctataactatttctttgtaagtattttcatatattttatattcgtgcccttcattcttgggtctgattgttgttaagtatgtgaattttaattattctttctgtcacttcttttaatgttgtttctgtttaaatgaatgcaatactaccaatttattcaactaaatcaattttctatttaattaagtcttactttatggtttaattatatacttggattacagtgatcaatcttctctctagagatttaactgaaatatgcagaaattgataaaggtaaagttatgtcattatgcatttgaagagtcatagcatctgttgtttagatgtatgaattagttttccagacaacaaaattcttcaatactactctatgcaattatgttgagaactataacatctattaatatgttccttttgtctacattttaaatacagccactttttctttgtatatttcagttatgatattgcaatttatttttctttctataatgtcaactgagagtgttaagcttttgaaatagccaatggtgaatttttagtgtttagtgacatagtataatgcctaatctataattttaaggaataaagtctgatctaaaccttgatatgttcatgattgccactgtgtattttataagggaacatattaaaattatcagttagtttcccttgacatgtttgcattacacaaattttccacagtggatttatattattttaaaatcggaaaatataaaaaattattgtctttgacccatatgtctttttcttctatcaccttttgtatgtcaatatgctgatattaaccatgactacagaaatattttcataagggtgagaaaacttgcttaagttttactggcactagtaacatatccatctgtccattcaactgaaatgctaatgagaagacattgcatcttgaaaagaaagacatagctttatcaaagatgttggagattaaacatgtttgtcaattggacaatgtcaacaatgcagtttagatgttactttaaaataagctctattttctgcatgtatcactgcagtgtagagttctagacctttgggatcatataaacacatcaatctttatatttactttatatgagatgctcaagtggaagagaagcatgaatctgcttacatctttcctttgcctggtgatttaaatagactggaccattcaacaagagtgttgagtgtatgagtatgaagtctagaaacttttggtaagagttttaactgaagaaagttaatcagttaaagctggtggttatgctactattctgcaaacaacccttctggtgggaaaatatatttaaaattctagagagagattttattttcctcttatgctatctttttgcaaataatccaaagaatgaaatggtcgtgtgaaaattgctgctattcacattttagctacaaatcagaaaaacatcatttagttgagtggctatcaactgctccattatctagcctgaaaaaggctctttatcacaggaagtaccattcataggatcggcacttccacaagaattaataatgattacttacaattatgatgacttttaaataaaaacgaactttattctggttactttttaggtaaatgcttttattttggatatctaactttatcttatttaccagggatttgattcattttttaaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtagccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacattaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaacaagacatttatacagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgcggagaaataggaacacttttacactgttggtgggactgtcaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactcctgggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaatatgtatctctcatgccatgttgtaaaacaaacaaacaaagaaacaaaaaacataccttttagagtgtatggctattttggaaatccaaaagaacagtcttttagttacattgcaatgatcggtgattaacgtttaaaatatagtaagtaaaagatatcttatttgaatgaggcaaacaattaataggctaacacagattccagcaaactttttatttaaagaaccagagggtaaatatttaaggctttgcgggccatattttctctgttgcaactactcaactatgctgttatagtgcataagcagccatgagcaataaatagatgtagctgtgttctttacaaaaacagttcttagaaagccagattagcccaatgctgtagtttatggacccctgatctagtatactgtaaaccaaaaataaaaccctaaggcccccaacagaccaaacagactctctcttggccaagaggaccccagaaaaacctgaaaacctgaattcctggctgtgatgggaagggatgttgaaccctcttctttatatctccttccttttggaatttaagcacaactgaccagcattcaggttaaaatagagatcacaagaataacaaaacagtccctttgtggctaattaaaaacaaataaaaggccatgcaaggcaaaggttaagtcccatcctacaaaccaaaaaattttgtaaaactggcgcttttttttttttttaaattaagctggtacaatttgacttaatttctaacctaactacagatagcagaccctgaaggaaacaaacatattttaccccaaaatatattttttgttatattttgaaatggccccacaaaaccatcttttgtagggaaaatttggatctgcagacaatctctattaatgtaaccagaccttccctttcccaagcctttcccagatctaggggagattagctgacagtctgacaactttaatgtctgaaaagagacatttaccatctattctctctgaggcttcatctgcataaaaagagccttggcctttacaaccccctttaatcttgattcaagcatttatttcttctgacttcaaatatttagacaaagtttaactcttgcaaccaattaccaatcagaaaatctttgaccccactgatgacatgtaaaccttccccacttcaagatatcccacatctttaggctgaacccaggtacaccttccttgtatttatttatagttgtattagcctgttctcatggtggtataaagaaatacctgagactgggtaatttataaaggggagaggtttaattgactcacagttctgcatggctaaggaggcctcaggaaacttacaatcatggcagaaggtacgtcttcacagggcagcaggagagagaatgagtgccagcaggggaaatgccagatgtttgtaaaaccatcagaccttgtgagaactcactcgctatcaggacaacagcatgggggaaaccacccccatgattcagttacctcctaccgggtcccctgacacatggggattataaggattacaattcaagatgagatttgggtggggacacagctaaaccatatcaatggttttacctacaattccgatctccctaaaatgtgtaaaaccaaatggtaacccaactcccttcagcatatttctcagtacttcttaagaatgttccctgggccatggtcactaatattggctcagaataaacctctttaaagtattttacaaagtttatttcttccattaacaatgctaagtttaaatttatatatgtgtaaatgtattaaaaattatttaaatgtaatattgtaacattatgaaagtaggttatgagagttgagatttgcaagatagtattaaaaaatattctgacactaaaacactaaggaagaccttattcaaagcaattgcgagagggctgtgcgtggtggctcacgcccatattcccagcagtttgggaggccaagattgtggatcatttgaggtcgggagtttgagaccagcctggccaacatggtgaaaccccatctctactagaaatacaaaaactagctgggtgtgttgactcacacctgtagtctcagctattccagaggctgaggcagcaggatcacttgaacctgggaggtggaggttgcagtgagtcgagatcccaccactgtactccagcctccagcctgggcaacagagtgaaactttgtttgaaaaacaaaaacaaacaaaacctcccccaaaaaacccataccaaaccaaacgaaagaactattgcaatatagagaagagacttaactccaactacagcaaacactgctagaggtacttagagccaatgagcagaataatgcagtcaatgcatggaaaactactaacaggaggtatccagggcagggggagtcttgctaaactggtataagagttatagaggaaagaaacacgaaacacggctggcagttaaagacaggttttctttagttgaaacctgagaggtgctcctggctagtttgtcaggagccctttctcttacagactgtgagtatatatttgttttagggtgagaaggcttaccagaagcttggaatgtttatgtgtgtggataattttatggtgggctggaatgtctctgggaggagaggagattatcttggggcagacatctcttcagccaggaggagggttgtctcggggctagcatcttcctggctggaaggggttatctaggggctagcatgtctgtggtcggggaggagtttggaatgtttctggttggagatgttatttgtggtttatggtcatgctgaccttagccattaggctgatacactttggatttaggtggcttttattaggttgaactttagaatgaggggcatgtccaagatggcaatgctcctgctctgtcaactggattaacacaatttttgctaaaggcaagccatagacttaaatttcaagggtaggggtagaggaatttgatcaagtgtcaaaggcaggaggattctcactaaactgacccagcaggattcttgttaaaggcaggccaaggtcaagggctagttgtgaagtagatggaggagcctgaacaaattttagtcaaggcagatatcttcatcaggagtgctaaatgcatttctaaataacgtcacaacagcaatcaataaataaataagtacatatatatatatgatcgatgtggtcaaaaacttagaggaaacaaaaatatttgctgtgatcattctactggatggggctgtagtacatactctaaaagctgtgaatgactgaatggtggctcaccaaaaattccaccaaaataacctattaaagataaagcatggctgacttaattgcttagtttggtaaaaaagatcactcttgtcacagaaagtgagcagcatatggaaagagaaaagcaaagaagagttgcttataaagttttgggggtatgtagtttgacaggtatttcaataagtggtcttgattagagttgggcatactttgtgattaagagtttaggataggtgaattgagggatgtgagtgctttggagaagctcttaaataggaaacagtcatttgtttgtgctgtatgttgttctgagaaagatatatttatgagccttagatgggcggtctatttttcaagtaaatgggtttttggaaagttcttgaaaaaaaagaaggttatttgcaacttcagcttcctggaaagaatttcctgaaatattaaagtcatatcaatgcagacagttgaatagcaaattgtgttaatgtaaacagtaagatgtgttggtatagatcgtttcaattctcaaaggaacaagaaataggttccttcttgagtttataaagtaattgaaaacccaaaacaaacacatcaaaatggaataaaaaaactcaataaaaaagatcgaaaggaattacatgattaaatattaactggcacaggagttcagaagagagggatattaggtgaatactttaaaggtgttgggaatttaacaatgctttgaaaaaagtgaaaagtttggacaagatctggtgtatttattagtgggcattgtaagaaaatctgagtgggagtgaagttttacatatgtggagaactgtaagccacagataatctggactattttataggctatcggtagataataaatatataaatatatgttaaattttatattttattattaggaagccacaggtctttgaggagtgtttgagataatggtaagtattgtgttgaattgattgggctgtgtaatggtaatacctagagccatagaaaactcttacaaaactagcagtagtctgggtgagtggtcataaagaacaatataaatataggagatgaagatacaggaaaggtgtaaccaacaggatggtatgtatgtaaatggaattttgagggagagtagagccaaaactataaaaagtttaattgtagtactgagttttatatgtctacaagatatgtgatctagcatagaattagaaatatagaactggcctatgggaaatgtcaggacattagttgaatgtttaagaatccatataagaaggtgtgagtagtaaaatagtcactgaagagctgttggaaaaaaaaaaaagcctacagctgagtttggaaggatgcctttgtttagatagcaattgagaggaaagagcatatagaaaaatttgaagaacaaataccagggcaagatagtggttcaaagtcaagagaagaggattgcaaaaccctactgttcatcatcattgttacacactatgaagttgagttaggtggatattaaacatgggggaagaacatattgtatttggttattgcaggtcagtgatgatgctggaagtctgaaatttcagtagagcaaggactgcagctgtactgcagaagatacagagaatagcttgtatggctgttatggagaacaaggtggaaacccctcaggcaaaaggtttattgaggcttactgtgaaagggaaaaaactaggaacagagaaaaacaccagacttaatgtactttttatttatttatttattttttgagacagagtctcactctgttgccaggctggggtacagtggtgcaacattggctcaatgcaacctccgcctcccaggttcaagcgattctcctgcctcagcctcctgagtagctgggactacaggtgtgcaccaccacggctaatttttttatgtttagtagagacggggtttcaccatgttggtcaggctggtctcattctgttgaccttgtggtccacccacctcgacctcccaaaatgctggattacaagcatgagccaccgtgcatgtactttttttctttaatccttttgttttttgaagcagaaataaaagatatttaagagcttagagcgcattgacttgtttataaaacagagcttctctttgcgaaggagaaagttcatctcttcccaaaagtcttgggaaaaaaatgtgcatgcaatgagatcttgaagtagaaataaaggatattgaagccatttctaatggcctcagtttcttcagttaaatatatggatcctggggctcttcaaaatatgaggaaagtttaacattgttgtgagcagtgttttagggagttgaattaggagcctactgtgttttaattgtgagtagctaaatattctagatttaccattgatatatttaattaaagaataaaatcttgttgtttaacaaacccttcctagatttatttgagcatttcctgtgatagtcatttcattttttccacattttatttttaattgctcagctttttttattgagtatagtttcttttaaaacatggaatgctacagaatttcaattgtggatatatcaaaaatagttttaaatgaagattatgtttggattaaagtttctcagagaactgatttgccagagttttttctactttttgaaaactctttctctatgtagagatagattatatatttattgatttaattttaaaacactgaaactagattatcacgtcaaaattaaatgcatacttaaattagccgttagcaagaccaacagaaaccaatatggtgactttttattgttacatatggaagatgaattttgtcggatttcaacttctcagaagactcacagcataacccgttaagcaaagctgagtttattacctataatagtcagaaaagacaacattttacaagagtcggagtgtccagaaggagaggattaaggcgaaatatgaatagggttggaaatctaggtttgagtagataagactgaactttcaatgtgaggatctggtttggttaggcacatttcaagacgtaatagtttaggattggtgaacacagaaaggcaggaatcttgaagtgagttgtttgataattgagccatttacccagttttaggagtttaatgtttctagaaactaattttcagccattttctgaaaaaaaaaaaaaaaaaaaagtttttcgttctgatttacaacgttaagttcataaacaagaacttcctagaacaaacagtaaaataatgtgaatgtaggctgcctttatttttggtcctgatagataaggtggatgcagaagtctcagttcttaatttcaataccacattgagaactaaattaacaatggaaaatgctttattatctgctttgtgtggaagaggtataaaatataaggctgcatttacctgaaagattttaaattaggatactatgtttttctttttgtcagccaaattatgggaaaaaaaattggatcgaaatggcagtaatgatagttagggttactgcagactgaaaatacgtgcttagatctcagggtacacaggccagatagtgattctattctgccatacattttcattttaggaaaactgactgagtcgaatgtgtgttcagaataattggctcttaactgtcaaagagttaaaaaggagaaaagattatttaatcaaagtaccttgtagatatgcatagtgccatgctttaagaatatttcaagtactcctaccttaatctttccatgttaatgcacttaagtcattgatctgattcactcatatttgattacttaaagttaaacaaaatatatcatacaacatttagaaatgtagttccagaatgaaggatcactattagtctggtagataactgttaatctagtaacaggagtttcaaaactggggattccactagtgattataaatcaaactgtaaagtaggataaatatgaaatccagaagaccagattataaagaacaaaaaaaaccccaagaaaattaataagggcagatattagtttcttttaaaataattcatgcaaaaatctttattatttattaagctagagaattacatgtgaattttaaaagtttatcctattaatgcaacattgagagtctaacagtaaaatttgcaggagtgtagatctaaaggtatttacaaatctcaattctctgtagatttttctcaaggccaaataattatccaagaaaattgactttaaataaactgatattaagtgtagtctttatcttttcaaacaagcttcacttccttctactttgttctaagggaaatcatgatgaattttctttcgatcacccctaataacaacctatcactcatttaagattttctttcactatgaggaactatggggtcacgcatttctttttctcttctcttgactaggaatcaccattcatactaaaattgctctatggcttttctttctctctaacaccacagacctcatctcaatttaaaattctgcattgtgcttgtgtactcacccaatgatttcttcctatccactgcaaaaaccagttcactgagacgttggtattgcagtaaagaagagtttcagtaacatgagattagccatgtgggagaactggagttattactcaatgagtttccctgaagtcttggaggtcagggtttttcaaggaaagtttggtgggcatgggactagggaatggatgctgctgattggttgggggggatgcaattataaaagtgtggaaaactgtgcactgagtctgcctctggatgggaggtcacaggactggttgagtcatgagtccaggtgaggccagtctgaaaatcatctcagaagaccaacctgaggttctacaacagtactatcatctatattatctatatataggcgagtcacaaatcttgtgacctctggccacatgacttttgagcagtaagggattatagaaactatagctacattttaggagaattcaggcctctttcataatttcagttttgtgtcctttcattagtattacaagggtggtttcaacccctgaacgaggaggggatgaggtttagggagggactattattattcttgtttcaaggttaaactataaactaaatttcaccaatggttcgcttggccaatacccaagaatgagtgaagacagccagcctacgagcctaaaagcaagatggagtcagccatgttagatttctttcattatcataatctttgcaaagatgtttttgcctgccttttgagagaaaagctacttgtcgagtgttttgttttgttttgctctatttatctccatgatgcaatggaaaatggaaatttattttctcttaatttattgagaaaatattgtaaggatgattttgttagggcatgctatttggctcttgataattcatgatgatatgttcatcacaatcaagaagtgggccagagatgagaatattttaaaaaattcatagagggaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaaaaaaaagaacccaattcctttttagctgataaaagaagttcagaaggtgatacaggccttaatttaaagatcatatagaactatcagtccatacggccagcctcagggagtaactgggaaatcccttctttatctccttactttcctccttcctaaaaagtccatttgactttccctgtttcccaggccacagttccaacatgtcactgttcccatgtgattaaggtcaagaactactggccctctgtgttattcttgactctaacaggagagtcatattggactatgtgttttgaattagatactgaagaaaacaaacttcagctttgctaatatttcttgcttcttgtcatataaattgtacgtgtaactattaataatatttaaataatgagagaaggggtcagaaaatcttgttctgccaaaagtgtcagacaccttttcgtgtgtttttgtggctaatctttgtaactcatcatttagtacttgttttataactttgcaagtggagacattcagtttctgagagattgtaacttatacacattcattcactataagtagtgaatctaatctccattaatatcacctttcttcctagaatgagcaggagattagggatgtgtaagcaagaaaaggctagaattgggtaaaattgggtaaaaagattatgatttaaaaagagaacatattcaaacctactttaatgtggctatcttctcttttacctaatcatatatatatatataattatgtataattatatatatatatatatttatctccagagtatccttatatcctgtcagttttacctcgttagtaatttcaggcagagatattgttaagatgttttaattttctaacaaatatggccaaacttacctcaaaaatatgtaaaagcaattatctgaaagaaatgcaattatttaaaatgaagacatagttcttctagagttgaaaaagttcattcattgatatagtagtagcctcagattttgagctgcaattgtgcaagccaggtaaaataccacagaaaaaattcacaacccagaagagaattcaagatgctgaataggaattcagtggtggtagaagaattggatccataaataggtctgcatgagaatgattcaatcttaggagacatagaactgttagagttacagtcaactggcagcacttttaagttaaaatactggatcatcatcagtaatggtttactttagagactggaggcacttctctttgcccattttttctcaccacagaatgtgcagcagactgcccatattttaattaattttcatttgttaaaccatgaacctgagtggccctcatactaaccccttgttcattgcacaatagaccatgtgttaggcgggcttcctgatctttcacgagaatgaatgccaagtacagaaatctgcttgggttattgaaggctaaaaatgattattctaatgtgtctgtttattttgcacgttttctcccctacagttactatattatctagtcaatgtatttgtcaattgtgaatgtctttgttgttgcagatacagatgtggtgtataaaagcgagaatggacatgtcattaaactgaatatagaaacaaatgctaccacattattattggaaaacacaacttttgtaagtaatgaataattaattactttatgcatttcagtactgtttagaaagctctctagatgtacataactttctattcttcagctccagcatttgtaaagcatttcaggtgaaaagttggggctggaatatcataagaatcagtaaatctattgataaaaaataccctgtgactatctgcttcattttcttcccgtttactcttgttaataattggagaaatatttccaaaaatagtagttgcttagaaagaataattttcccaatattttatatataacattagtcatacaaataccaaggttaaaaacaatggctcatctagccttatttattattaactttcttttcttctttacttttcattctttctgacttctttctagttctgttgttttctggatcagatagaaaggctttctaaaggtggtcttcagctgaggttgatgtgttttagaatttaggattctgtcagtaccattttacttattttgtatcactgtttcgccaacatggtttaaattattgtttgtatttatattggtcttaatacagactttgtctttctgaaaaatctagtaccctaaggttaggagacttagctataattacctatttggtaagcaataatgaatcagtattgcaaatgttgaaaatctagctacccaacaccaacgaaaaatagtacacagttatttacttactattttattgtaattaaagtttcaatagactgccaattagatgaatgtatacaatacagacaaaatatagtacaagctctcagaaaacctccacaaaataaaaaaataagcaaaattgttggctacttttaaaaatgtattctacttgtacatttaaaataaacgtttaatcttcgtatttattatggaatggccctatggaaaaaatggactaagaatattctgtttagtatttttacatattaaggagaaaaggtcattacaatcattaagtgattatatatgtatatcattgggctaaatttaaccagccaactaatgtacattaataataaggtcatcagccagaagaaaaataatgacatttttggttttaaactaattacagggaatcaaagaatagttactttgtgtgcaactctttatggtactcgtgggatgtcaaggatatgtacagcagattgcctactgtctaagaatgtggatttcctttgggagataatactaacccttacggagaattttaataaacagtatacagcagtgtttactatttcttcagtggatggtcctcagggatactagaaaaaagcctagagaatcattgagaaatactgtcaatagtggaaaattagccattagtaagaagataggataggagacagaattccagaattgataatgatgagaaggtatgatgataatatatggattaaagtcagaatgaatggatttttaataaaattagtttggggaacaaaaattgagtgcattttaatttttgctttttcttcataaagtaacataattttatggagattctaggccctcagtagccaagcattcaggttagatatactcagtacatgaattattctattatgtggctgtgcctcattaaatactcatttacacaagtcagtgaggttttcccccatcactaattatgttttggttttccattatttattcattacttttttatcttccatgatacatcaaaaaagaaaccaaaacaaacagaacttttagattattattccattatctcaattcttttgctggtactacacaccatcaccatctcatatcattgtggttttctccatgtgctaattattgctgttttatctttgtgtttctgtgttatatctttttaaatccttttgaggtctctttctattctcctctacattagccgtgactcttaattaccacagggtcatatttagcaaatattctaatttacttgtcttctaagattcatatgctccctaaggacatttatgtcacaacacagataattaagcaatttataagtcctagaggtgtctaaattcgatgtcgggcaggggttaggggagtggaaggtggcatcagtttgcaaccagttacccaaaactgagaacaaaaataggaattaccataattccagatgatttcaaaggagcttgtttaatcattctctcctaacttcaaaatggcattatttaatacacttatgtttttaatactaacgttaggctaaaaccgggatttaatttctcttccaggaaactctgttgaaaaatatattttattgaaacatattgctggtttttctgtgagcaattatcaatatcttaattataataataattaattggatcagatcagtataaaaagctttgaaatgaaagcatgacaagtcatttgagaaaataaatatactattgatgaaaatgtcataacagaatggcctgttctatagtaagacatattatgctaaaatatgactacaaatttatttttaaaattaagataatttgacatcttaatttatcttatgatatcttgtttgacatcttatcacttttcagcttaaacacattttaaatatgattggtgtgtacttttggttatgtaatcatggttagcagactctatgattaaaataaatattgggcatggttgccaaaataaaaaatacttttttaaaaatgaaataattgtgttaaggcattcttttggattgaaggtaggtggatttctaatgaaaggaggaaattaaagggcatacaacttttgaattagaggatgggaagtaagtggtttagcctcaaaaatgctctttataatttctaagtgtttggaaatgttatctcttaaagccagaactatttcaaacaaaagctcagtcacaatgtcataatgaggaaactgtttcctaagtattagctgtactctttctgctgtcaataatctgaatatcaccagtgaccacggctgaaaataccggcagctataaattgttttatcaaatcactttttgaaattataagggggttgtaaacataagtccaagccccatgtgcttaagtatagttaagattttaaaaatatgtatcttttttgttttttaagacacaagctcttgctctcttgcccaggctgggatgcagtggtgcaatcatagctcactgcagtctttaaactcctgggctcaagtgaaccttctgcctcagcctcctgagtagctaggaccacaggtgtgtgccaccaggctcggctaattttttaaaacagtttttttttttttagaaatggagtctcactatgttgcccaggttcatcttgaactatatcctcaagtgatcctcctctggtggcctcacaaagcactaggtttataagagtgagtcacagagcttggccccctagaatatatatcttatgcattaatatgaaaaggaataattgagagataagactctaatctgaaatctctgaaactctgtaagcctatttaaatacattctactaaaaaagtagccataacacaggaaggaaattcatatatggcagcagaatgattccaagcaaaatgttagttacgtattcattggtctaagtgtttatttatatataggcaattacaaaatagtaggtttgggaagaaccaaggaagattcattgatttataatgcctagagacagcatcagctggcttcgatgtcatcctagtgtttttcatttggtttctttgttgttttatttgttgtgctgttgggtatatggaggtgatagatccaactctgtaccgctgtgaaatcaagaaacttactattcagtttgtgtttgagtaaataggtgccctattgaaacaacaacaaaaacaaacacagtagcacagataaagaattactgaacaaaggcaccgacaattgtacctcataaaatttgagatgaggaaagattatcagaaaattcgattggccacgtagcctcacataatggccaatagtaatggatgatttgttaattatttgtaagatttggtctactcagtatctgttggaatcccagtagtgatagacatcagtagtgtaactaacactgattaatcagtgaagctgtgcatatcaatgttgtgttttgacagtattgtttctttctttctctagagcagtgtttctccactgggggtgattttgctcccaggagacatttgtcagctctggagacatttttgattgtcctgaatgaatgtgaggggtttgctgtgggaatctagtgagtagaggtcagaaatgtgcatcctacacttaacgcaaccagaaatgtcaggagtgtagagtttgagaaaccctgttctagacagagatacaagagaaaccctgtgataattagaaggtaattttctgaggtgggatcaaagtaatgacttttaaattgataattttaagggagatattaaactgtggcttccaggttcattagtttcaggtacttttcttcttttgaataaccctgcaaagaagaccagcatgcatgagtaggatcatttggccttggcttcctctcttgtgtgtattgctgagtataaaataaaagtgtgacccagttttcttacaatttttggatgatacttctgattgggacttttttgttcagataagttagtatcacttatttggctattgccaactttttttttttttttttttactaggaagcagttgttcctttttaagatagaggataaaaactgatggctactggggactccagtcagcataattgctttcattggtgcattgtgcttatgaataattgaatttcatcatcttttgcttgggcatgtccttcccctcgctatagcagttaccatttcctgttgctagataccttcatatttatcttatttttatcattcactatgaaaatatttagatacttattatatccacaatatttatttaaaaatgattatttatgtttgtttacattatttaggtaatatttggaatatttccaattcagtcatcaaaataggatgtaacattgatgtacattcagggaaacaaatggaataatacatgtttcagcaaagattggacacctttctatatttagttagggaaggaaacattgaatctaccatagacatttaggctcttcaaaattttctgtaagttagatatatgtgaaagtgaattccagcatagctttaaaagtagtggtcattaaaacagggaaattagaaagaaaatttctgatccttaccctggaagtctactcaggcactattttaattaaaagtgtgagaggaaatagtcttgttgcttctatgtgtttgcaagtgtgacaggattaccctgcagtttcaaacagttattcatacagttccccataggtttaaagggctaaaattgactactacattattattttttaccctcaattaccattatgaaggatctagaaattagattctactaactaatttattcatgaggacaaagtatctcagatggtaggaccattttattgtcaataatcatagtgttactaataaatccacattcatagccatttattatgcatattgttaaatgagtaagtcatccttataaacaaagttatctaagtaatatataaataaaattatctgagtaatataaaaataatattaaaaataatataactaaattgtttccttcagataggaatacaattatgacaaaaattaattagatgacacttgtttaattatatgaactagagcttggttcaatcttgtctgacagagcctattagatatatgtgataaaaggattacaattccagtgttgatttttttagaagattcttatttagtctctttggagctggaggtgtcagacaggatgctggaaaccaacaggcagctagatttataacaactgtttgcgattgttttggaatttggcttcctgagaggtcagctctctgacgtgtatccagaatcagtcagtccatcttgagcaagtcgaggctctagtttaaacatttgatggatatttctgcccttcattttcttgctgaataattttatatattgctgtctcccagtcatagaaagccaattagaaatttttaaaaatactggccaaaggatacaaagtgtcagacagaaggaataataagctttagagaaacacaacagggcaaccagagttaagaataatgtattgtgtatttcaaaattactgagagtaaatttcaaatgtcttactacaaaaagatgggtatgggagctgatgaatatgttaattagcttgctttaatcattccacattgtgtattcttccatatatatcagaacatcacattttaccccataaatatatacaattatagtttataaactaaaattattaatacaaataaaataataaaacactcagtgttttattactttatgatggaacttaagcaaacaaaatacattttcgagaaacttttcaagctttggaagttgatgatataaaaataatttttcccttcttttgatctttcagaatacttcagtctacacagctttgatgatgtagaactatgcgttgccaaaacttctgcagcccttccacacttcacattacataatacagatattttaatagtatattggaaatatattaaattagtattttagtttgcttgtgaaacatgcgtgagcattcaaggaagttcaatttttggtaaacattaaatgataatgacagctcattatagagctagaaagcattttccctgtctcctacttcagttgaaatttaaaaaagtaaaaaatcaactgagacccagagaaataaagagacttgctcaataaatctagtgtagtcttgagactaaggaaaacatttcttgactcctaatccattgttgtttttaatattactagctgagaattccattcaaaataccttttaaagaaatgtgaaaataaataatgatcctttagttttttatatatataaaaatctatgtttatttgtggaatttttacttaaaccttttaggaaagatgcttgaattaaatatatgtatgtttgtatgtatttattcatatgttcacataatacagatagaatagatatctatgtatagatctatctatgcagatattgatctatctatatctatcaatcaatcaaccagtctatccattttactaccagataatcagtaaggaaacattatatagtgagtggaaaagaggaaaactgtgagtgtggtttacatagctttgtttgccttaacttgtctgaagtcatcatatttgtttttaacatattttaaatattgtgatgactataacctgtgtcatcattctttccatccaaatgttttcaattattgttgaaatattgcctcgtgaacaaaggataacaaccttggctgcattacacacacacgcacgcgcacacacacacacacacacacagacacacacaccccaccaagcaagcagcacctattattatgaactactactctacttctcttctttcccctgatatatctggctgaaataatctagtttatatttgaatttcttctgtgtcttaaaaacttgtagagatttttctacttctccatctttatgatgtttctgcatcattgttgaaatgactcattatgccttattactttattaatttatttgccaagtgttgtttggatccctgttgtgtgtcagataatattccagattctggggatacaatggagagcaagacaagtttgtcagactgacaataaatgagtaattcattgaaaatacaagaaaatgtcagctagtaaatttaaatccttgttgaaaaataacatagggtgaggtctagagaatgattagttgcttaggaaaggctcactacggagataacatttcaaggtcaaattgaagagttgtgtaggttgcaaggccagtaattacaaacaacatagggttcaaactatatagatctattccaagaacagaaaatatgtaagtggtggacatgggtagagaatggtacaagatgaactcaatgagataactaggggaaagatttatactgagttttgtaggtcaaggttttattttgtgagcagtaggtacactctgaagaaagaaagtggcaatacctaagtcatattttaaaagtacactctgtcaattatatggagagcattttctagggatattaaagtagaaactgagagaccattctgaaggctattgcagtggtacaagtaggagaagatgcagggtgtgaactatgtacagggatgctattggagaaggtaaaaagtaggtgggtggaggatttgcttggagataaaatgggtagggctttgttggttaattaccttcaacttgttggaaatagaggaatcagcatcatctctgaggttttaaatgtcattaaatgggtaattctattttgaatattttgccacaatttttgacaatggaatctatttcatggttaggtcttatatgtacatgtttatgcatgttttctgtgtataacagtataacagaggaatttttagaagcctggttgaaaaaatcttgaaataaaattaacaaatttataataaatagaacatagacatgcaatccattgtctcttggggcttaaaatatattatattgcctatgattatttgattcaatgactccataatattttatatgctttttctgtcccaactacaactacagctgaagatacaatagaaaataggagagaaaataggagagctcctgccataaggaaaacaggagagctcctgccgtaaggatctcattatgtattaagggagatatgcactaatcaaataattagatatataaacatttacaatttatgacatagaataactgcaaagtataggaatataagaatgaaagttaaatattgcttttacttttattgcttaatatccatgtcagaatttctaatgcattggctgtatctgttttaaataagtcacggaaagctttcctaaagaaatgaagatgagccgggctcaatggctcacgcctgtaatcccagcactttgggagcctgaggcaggtggatcacaaggtcaagagattaagaccatcctggccaacatggcgaaaccccatctctactaaaaatacaaaaattagctgagtgtggtggcatgtgcttctagtcccagctactcaggaggctgaggcaggagaattgcttgaacttgggaggcggaggttgcagtgagctgagatagcgccactgcactacagcctggcaacagagcgagacttcatctctaagtaaataaataaataagaaatgaagatgactgcagataagttgactaagcaagaatatggcttgagcatagtgggacaggcatgaggcatggagtattagaaacaaagaatgccatggtagtgggagcagcacaaggaagggggaaacaggttggagaattaagtagtggccagatcatgcgggtcatggtgctaaattttcaaaaatgatcagatttgcttttggaaacaaatatattcccgttgaagtgagaaagtaagttaaaattgaaagttgtggctcaagaaaggacaaataaagacactagtggatggcctaggcttgagattataagcaaatggacttaggcagtgccagcagagaagagaaagatttggacgataataataagtaaaataaaaagaaagtaacaaaataagaatgtagtggttggtgatggcggttagaatgatgtatcagggataattcttgagattttggttgtatgacttaaatgaaaggggagttaaccattgagatggggaattctgggtgagaaccaggtttgagcgtatggttggatgaaaatatctgttaaacggcatttagtaactaagtggggaaatctatcaaacagtatttagggtgtcacatttcttgattcaaatgtgaaaaatgaacctttaagttaaaaatagtctccactcctaggtggaggttacagtgagctgagattgcgccactgcactccagcctggacgacagagcaagactctgtctcaaaaacaaaataaaacaaaagaacacaaaacaaaacaaaacaaaacaaaggtagtctccacttcttaaaaagaaggagcagagttgtggatcatatggtaattctgtattagcagtttgaggaacttctaaggtggttgcatggatttgccttcctagcaatggtataagaggggcttgattaattcacatctctacaaaacaggttcttacctatttgattttagccattttagtgggtgtgaagtaatatcttgccatggcatttatttgtattcccttaatttattgatgatattgaggatcttttcttgtgcttattgatcatttgtatatctttgttggagaaatgtctgttcaaattctttgcccattttttattgagctcttttcaattgctgaattgtaagattttttcatatattataaatcaaattccttgtcagatacataagtttcaaatgttttctcccaggtatgttgtctttcactttctgattggtgtcttttgatgcaccagatttaaatgttgataaagtcaaatctattttttctttagttttctatacattgttaatttagactaacttctttttgtgtgtttgagaacataatagatttttatttctatgtttagttctatgatacattttgagtggattttttaatatgatgtgaggaaagaggtccacatttattcttttgcatgtggaaatacaattatccatgtaacatttttgaaaagatttttttttctgttgaataattttggcacccttctcaaatgtcagctgaccacaaatatatgattttgtcttgggactctgtattctattaatctatatgtttatccttaggccagaagttcagtcttgactgttgtagctatgtggtgagacttgtaatcaagatgtgtgagcccttgaactttgctctttttcaaaattggatttctgtgtcccttacatttccatatgaattttaagatcaactcgtaaaatttgcaaacaaagtcaaaagaagctaagacttttgatggtgattatattgcttatgtagatcaatttgaaaaatagtgctacactaacaaggttctgatctgtagacatacaatgtcttttaatttatttagatattattcagtttcttaaaagaatgtgttatatttttccatctaaaaatcatacttttattgttgaatttgttactaggtattttattgcttttgtggccattataaatagaattgtttactccatttcatctttaaattgtttgcagctagtgtatagaaatgtaatgatttttgtgtgttgaatgcttatcctgccacattgctgtatttgtttagtagtccaggctctttatactcataaggggttatcagtctgtagctttttccaactatgtctttgtctggttttgatatcaagataatactagcctaatagaataagtagcaaattgtttcttccttttattttttggaaaagtttatgaaggattttttttaatgtttcatggaactcactgatgataccattatggcctaggcttctttttcacaggaagttttaaatttatttcatcaatccttttacatgttataagcctattccaaatatatattacttctgaaatttatgtctttctaagacttcttgttttgatctaaataactgaatttgttgataagcaattttatagtattctgttacatgttcatttctgtaaggttgatactgatgcctcttctttcatgcctgattttagtaatttgaatcttgttattttttctcatccatctatctagaggcttgccaattttatttttcttttcaaggaagaaactctcagccttattcattttctccattgtttttttagcctagatgtaacttatttccacctaagcttttttatttccttccttctgcttgcttgtgttagtttccttgtttttttcctgacttctttaggtagaagtttaagctattaatttgagatatgtattttcttcttgcccttttttcttctttcttcttcttcttcttcttcttcttcttcttttttttttttttgacacagggtctcactctgttacctagtctggagtgtagtggtacaatcatatctcactgcagcctcaacctcccaggctcaagtgatcctcccacctcagcctcctgagtatctgcactacagatgtgtgccaccattcccagctaatttttttaaaaaaagttttgtcacactgtggtctcactatgtttcctaggctgatcttgaccttctgggctcaagtgatcctcctgtcttggtctgccaaagtgttgggattacaggtgtgagccaccacacaagacttcctccctcccttccccactccctcccctctttccttccttcctgtctccctccctttcttttcttctcttctatttttctttctttttgacaaagtctcactctgttgcccaggctggagtgcagtgttgtgatcatggctcactgtagccccaatctcccaggcttaagcaaccttcccacctgagcctcctgagaagctgggacttcaggcatgagccaccatgtctagctaaatttttaattttttgttagattgtgtcatactattttgcccaggctggttgtgaacaacttaccccaagcaatcctcccacctaggcctcccaaagggaggattacagacatgagccaccgcacatggcctaagattacagatatgagccactgcacctggcctctggctttttctttctttcttcctttcttttcttttcttctttctttttttcctctttactttctcactctatttcgttcctaatatagatttttacagctaataatttccctgtaagttcttctttactatatatcataaatttttgtattttgtgttttcattttcattcttctcaaagcattttattatttctgttgttatttatttcttgattcattggttatttaggtaactgttgtttagtatctatatatttgtgaatttcccaaattgccttccattattgatttttaatataatttcatttgggtcaaataacatactttttataatttcaatacttttccattcattgaaacatgttttgtggcctaacatatgatctcacctagaaaatatttcatgcaaacctcataagtatgtgtgtattttctgctagcatttctgtctgtaagatctttttgctttagaatgttgtttgtcttctattttattactgatgttctgcctactggttctatccattgctgaaatcaaggttttgaagtctccaactatttattattaaattgtttattttccctttcaattctataaatttttgcttcatatatttgtgagctctattattatgtgcatacatatttataattgttttatttttctgatagaatggcccttttattattgcataatttttatctttgtctctagtaagaatttttgccttagagtgtatttcatttgatgttagtgaaaccattctatccttgttttgtttaccagtttcatggtatacctttttcacctttttattttaaacttattagtgtcttcaatttagaatatatcctttgtatacagcatataattattttaaaaaaatttatcctgtcaacctacacattttgattcatgtgtttattttcatttaatgcaattattaataaggtagaacatatattggccatttatttaataatatttgttttctacatatcatatgtcatttttgtttctccattcttggatttctcactccttttttgttagatattttctgctgtatcttttatatttgctattgttcctttttactattttttgtgttatttatttagccattgccttgtaatttacaactagcatcttaatttagaaaaaatttgttcagataaaatactaatttaatttcaatggcatacaaacattattccaacttcatttcatgtttttcacccctttgtactgtaattttcatacaagttatatctttatatgttataacccaatcaacacgcttttataataattgtttttatgcagctatgttctaaaacaagtaggataagaaaggagttacaagcaaatgtgtttatgttttctttcataataactgtgtggatacttttactaggtcattttgtgtcttcatgtggtttcaagtgactatttattgtcatttcatttcagcctgaaggacttcttcctttagtgtttccttagagcggggctaaaagtaacaaatgctctcaggttttgtttatttagaaatgacaacttctccttcctttatgagagaaagtttagctcgatatagaattctttgttgacaagctttttcttttaatactttgaagacgtcaacctaaatctcttctgacctctgtggtttcttatgaaaagtcagctgttattataattgagggttccttgtatgtgatgttatgtttttagtgctgttttcattaatttctctttgtctaagttttgtcaacttgactatgatctatctatgtgtggatctttttgagcagaatttttttgagtagaaacttggaattttttgaacttcttaagtatatatattatgttttatcaaatcgagaaggttggagtcattattttttaaaacttgtttctacatatttctccttttcttctctatagtctttatggttttccttctttttaaatattggatatgtctcactctatacattatttatatgtgtctcttaaaatagtaactttaaattataattttaataaaacatggtctaataatctaaatattactctcagggttttccagtgacattttttaaaacaagataatgaaaacatatattgtaaaatataaatatttacactatctgatatgaagttcattagatacatgtggctacttaatttttaattaattaaaatcatgtaaaatttaaaattccatctttcagtcacactatccacattacaagttttcaatagctaaatgaaaccaacagctactacattgtacatcgtagagataaaacattttcatcatcacagaaatttctgttagatagaactgttgcagatgtatatatcataaaaaattcccccttcataactcagtacccatttttgaatgaagccatgtaaatatttgtatctgtcaaaaatcttctacagaaatatgtttgtatatatcttcatggatctatacataaacaatataatattctataatatatacatttatatgtgtgtgtatgtgtatatgtaagtgtatacgtctacattatatttaatttcaacagtacatatggtctatactttttatccacttaatgtatcttgaagagctttttatatgaacttttttaaaacaaaaaaaattgtgtaatagcaccataaagtgttcttgtatgatgtattaccactggtttaaatatttttctattacattactgctccaaaacaaacataaacaaacagcaaagcaggcatatttcaaatatatatgtaggctaaatatattccagtgtattggtgagtcaaagaaagtttatattgcaatttattagataatatcaaatttcattaatcaaacccaccaatagtgtatgatactctctgttagtccactcttcctgttgttgggtattgttcaaccttttagttattttcaatttggctgataaaagatagaatttaatccttatgttgatttacaatgatttaattatgagagaggttgagaatcatctttttatatgtgcattggccattgttgttttctggtgtttgaattcctgtgcataagtctttcatattgggactttgcaaatgacactcatggcaggaacattttaaaaaaatatttgtacttagtcttaatctaactggaattattcattcattaatatctgtaaagtccactgaaaggatgttctgtgtttcacatatcttaataaacctttatctgttgaaactggcctgaaagaagaaatgaatgaatgtaaaggaagagagaacaatgggaacagttgtgagtaaatgtctataattaactcattcagttataaacacctgtttaataaaattggaggaatcatctaccctataagagttggaaatattacccttaaattttccttcagtttttaaaatgaaataaaatgaataatgaaaaaataaacacacacactgaacaccttcttccagccttaggattaattcagcctctatttggacattgaaaaacatgcataaaactgatttatcttagcattctacacacttcacaaaaaaattgaagctattggtgaacatttctgagaaagtggacaatacaagaaaaggcttttggatttgggccataaaaatgcaagtttagtgcatgacaactcaactagtgaatgtctgcctcagctcctaagcacagttgaggagatcagcagtgtttgcagatgttcttgggagacagtaaaatagaacccggttcttacttcagagcttgagattttgctcaagacattgaatctggaggcagctcttgattgtttcttattgtcattgtcactaaattggacttgattttataggccttctttctttccccaactaagcagaaagtgccaccagggatgtaaatctaaaattattcttttcctttatttttgttatttgctttggcatggaagggtcatttatgatatctctgcttatcaaaaggatactgacaaataaacaggaaacagcaaatcaatctattattaggagtcccgaacaggaggtataatgttacatcggttaatatattcaagaaatattgatattctaagctgaaaacctgagccttgttattctttgttttttttttttttttccaagtgaattgcacattcagaatcttcttaatggtcagatccttatattttttgttgcttgcatcctgtatctgttataatttcatgttaaaattagaggatggagatattttagcataccaatatgctaagttgtaaattatgaagacataatgaaaactcttagttaacttagagaatgttaatgtaattaatatgtaaaaactcttccaaatcaattgaaaatgaacaaaaaatataaatggactttttatcaaaaaatattgttgataaatttaaaagctgcttaacataattcacaaacaggaatatttatcaacaagaagatagtatttttcacatatcctattggcaaagattaaccctgatgttaccatgtattggaaagactgtggaataatagagcctcttactccttgatagcaggaatgtcatttgtgtttttactttgggtaaaattttgtcattattgtgtgaagtataactttcacatgccctgtaatctaaaaattccttcctaggtatataccataaggaagcaattgcacgtgtatttcaggaaacaggaacagggaggtttattcagtcatagttgcaaacaaccactggtctcctcaactgtgcttaggagctattaatggatatttctgataaaatgacctgtagaatgcatggctttcaaccttggagaattaaagtgcaagtttagtaaatgaaaacccaacttttaaattaattcactatgtaaattatttatatccttgggtttctggttaatgtctaactcagtttgctttgatacatatatatatgtttgcctatatgatgtataatttaatcttagttggtcttgaacttttgaaagaggcatcaggtagtccatgatcatcttatacttccctttatcactcagcattttgttactgattcatgcatatttgcatttaacctgtagtccagttattttataactacaagatattctatttatgtcattctcttggttatatgatatgccattctttacatatattaccatatatttattgtttatcttacatttaaatttaattgggaattaaatttgtaattgctaaatctatcacgattgacaatacgtgaagagacaaaagctgcaattaatccaattcaagagagaaaatgataaggatagagtagatatctgtcttatctattaattcatatttgtcttatctgctaaatagatatctgtcttatctactagttcattttgtattgctgtaaaggaatatctgaggctgggtaatttacgtaaaagatgtttatttggctagtgattctgtagactgtgcgaaaagcatggccctggcatctgcttctggtgagggcttcaagttgctttattcatagtggaaggtaaagggcagcctgcatgtgcagagataacatggtgagaaaggaagcaagaaaaagagagaggacgtgccaggctctttttaacaaccagctctcatgagaactaatagagtaagaactcagtatgataaaaatggcaccaagccattcatgaggaagcctgtcccatgacctaaacacctatcattagagccccacctccaacactggggatcaaatttcgatatgaggtttgaaggagtcaaacatcgaaactgtagcaatatcaaatatggtatcactgaggaatatatatgaatatatcaaatctggcacaattaaatatcttttttatttgttaacctatgttttctcctattttttggaattattaattataatgctaaattaatgatgttatataaacctaaaatgagcctttgaaccatcagctgtcaagaagatttagtctttgaagcactactatttttctgtttctatttcataaaaagaaaattcagccatggtaaaaaaagtttttttacttaatattggacattatagtttcccttctttttgtaaatatgggaattgcaaagcttttggtaaccattatttttcttacactagaaataaaatcatattactaattgaaatacttaaaatatgcgtgttttaaaataataattatattatttttgtttatgaaattatactctgtaaaatgtgcctgatgggctatcagaacaagaatgaaattaagtaactttctactgggcagctccggtctactcatcttgtaagtattatgttacacacattgtataaggccatggtgaggaaaactcataccgaaattctaatgtcaaattttttaggacttccatagcttttatatgctgtattctttaatgcagctgtgcttgaaggtcacagcaccatttaaaaatatatatatacttgatataggatgattataaagcactaagacaatttgaagaatcattagaccagcacaaactgaacttcacataaataatttgcataaatatggaagttacaatatttcttttcttctttcatcagcccataacttttccaatttattaaagtgttgggtagagaaatattggcatgactctcaaattcaccttttctgccctatttttttaagttattaatagatttcagtgatcattaatttccactttctgcgaaaaataaaaattgctttttaaatgttttagtgtatggcctatgatgtaaatgaatagaatattattttggctgtttacatttattgagcaataaaaatatatgtgtgtcagtctatatggattagtaggtattgattcaatactcataaaaattacgtagttgtatcatggcattttctgcattgggttgttttattaaatactccaatatcaaaatgcatggtaacaagaaaatatatatatagagagagcatctattatgtttacaaaatatagatattgcagatgtcaggaaagagatataatttaagcatgatcataattaattagtcagctaagaaaagagaacatgaaaaaatacacagtaaaaaaaattgattttaaaattttctgcatatatagccagctatagctacagagaacaatcaagcctttgtttacagctaaattataaaagctatttgcttcttttctgttcttaaatccagacagtgaaagagagtgtgtcttttgcatcattctagggactgctgcctcctttcccagcttctcttgatttcccttttcttcttttcaactagatcgtaatctttttccctcttctcctccacttatggtccactggctttctaaaatccttcctcatgctcaaaccagggaatttggtcatttatggactgcactatgaaagaagcattttcataatatatacttaattacatgtttcaaaattaacatctttccaaaatgatagatggcttttctaaatatttttgtcaggtatcaaaaaactaataatgagattgagtagtgagggaagttataccctaaataaattaaacataaaggatggccgggcgtcatggctcacgcctgcaatcccagcactttgggaggccaaggcaggtggatcatgaggtcaggagtttgagaccagtctggccaacatagtgaaaccccgtctctactaaaaatacaaaaaattagccgggcgtggtggcgggcacctgtagtcccagctactcgggaggctgaggcaggagaactgcatgaacctgggaggcacaggttgcagtgagccaagatagcgccattgcactccagcccgggtgacagtgcgagactccatcaaaaaacaaaacaaaacaaaacataaaggatatgtgtgtgaatatttagggagtttgatgggctggaggttgagggagcagggaaaatatcataggatccaagaagacttacatttttgtctccatcattcactatctgttaaaaatgtacccatctatactttcagaattattcagccaaagctcctggagcatgatttttttttttaattttgtaaatagagatgtctttagatatttttattaccagcttattccaaggtctagaacaatacacatccctactacacagttcctaaggttctgccgtttctcaatgttaaggcaaccaagtcctttataccaacttgtattaattgtaactgcatctctcattctgccttcactcagtcttttctcagtctcaagtcatgcaaatgaatattttatgttttctgacacttctgacatttaagtttgtgtttaatgatttcttgctatgatctttaatatctgacatcttggaataccatcattatctcattttctacctctagttataatgtttctgacaaaagtgaatcattgtaatggggcctcttaatagggacattaccgtggcaataaaagatgtaaattgcagttccaaacaacctagaagtgcaatcacgaaacagtgatcaatggttagatgaactgcacgtgtaattaaatacatgtgaggtcagatgaatcacttgagctaagaaggacagggaaggcttaaaggagaagaattagaatgatccttcagagaaacacaatttgagtaaggaaaagggaaaggtgaaggtggtatagcaagtagagaaagttgaacaaaggtacaagaaaaagaaaacatgcacatttaaagaatacaagcaatggtacaccatgttcataactgcatgattactggcccacccggtagagcatgtcatttggggaacttgttccttttctttagagggcatggatttacgtggaacataaactttcatctattactctgtataaatgataaaagatgaggctttctggcatctctcttaaactccaggctttttatccacaaatcctgcacatttcctattggctatccttcaggagcgataacaataatgtatataaaattcgaatgtctaaaactttcctcaaaatatgcctgtttttctttattttctccagtgagaatgttacaaaagcaacattcacccaatgataaaaacttgaaaacctggagttattctgtatactttcttctttctccatcttcaaatctaatccttatttttttttttttgtattttattcacaatctcccctgtacatgtccctttcactctttgcctctgcttcttccttaactttgtaacattgctttcttggattgtcatgagcctcttaccatctctcatgaactcgagatgtcatcaaatctaactagtttttcacccagttgccaaggtaatagttctaaattcaaacctgattttgcttctttcttggctttcagttttaccacttatgaaaacagtaataagcactggcatattcatgttgacaataatgcatacttcatacataatagcagtaatctatggaatcatccctcatcttcccaagaattgtttttaagctacttgtgcattttttgaagtttattctcatattgtaggttgtaattcaaaactggcaagcttgtaggctccagacagaatctggcccccaagtatatttaggattgaatcataattttaaaattatgaaattataagttaaattttgctttctaacttttttgaaaaaaatggaaaactagcaatactgtgtatttttctataggacattgtatctggagctgaggagctactgtgctcttttaaataggcggtctgattactccgcctctctgtgattcttacacagacagcttcagtcttaccctgcttacccagtggtttcaagcaaccatgttttggacccttgctctaccagtgactaacgaggttcatgacatgcatcttatcctgaacaatatggaaagggaaacatcctagtgggtttggtttcccaactttgtagcaccttcagtgtctgcctgggggcttgttgtacagtgaatgttcaacacataagattcgcttgaatggaatgatacgtacaaaacaggcaccaccaaatgttcccaagctgccggaaaacatacatttgtttctctacttgatcacataccttgtctttcttgcttaattcatctagttaatcacctgcatatttgctttactctgtttatcatatcttgcttgccttcaacagaatgtacatagatggcaggattcatgcatttttatgccctttgtactattttggatgtcgaaaactggacaggcaggcatcattgctgagtaatggcaatgaacacatgtggaaattacttttgcatcctttcatttcaatagtaattaagttgttaaatatgaaggtactgtaatagcattattggcaataatcaacttccccaaaccacaatttgaagtcatattaagttgaaattaaaccagaactatttaatgtctacaattagaatcagtgttgaccaagatgtctcctgtggctgaaagaaagaataccccaaatgcaataaataataacattaaaggcatacactaagagggattgacctaagatttccaacatcttctggcgtgttgactaagctgccgagatacgtttcttattcgtgtatcatcagtaagtttctctgcagcatcagtgacctgcccacgactctttaatttcagagaagattcagcagcttgggccccggaaaagatatttggaaaatttcccagtttgtgtgctgcataagcttgaggcagtagagggataattaataaagtgccagactgggtaattgtaggaactgtaaaagatactaagacgttgttaccggaggcacagacgcacctgtgaaagcgtgaagttaatttgtgtgaggaacatcacatgagggtggatgaggatgagggaggtgagatttccttcaaattaattcagactttagtcagagaagctctcaaaaaaaaaaaaaaaaaaaaaaaaaaccctcctgctagtgagataatgtaaggcttatgaaaagaggccctcctggattgtcttgttacgtatgcttctctctgaccttgagaaaggtgtaacaactgcaacgttggaattttctaatccctgtaggacaagaatgatgacattgccctatcagtctttacataacagcgtaccatttcatactgtccccttgaacatttccttaaaaacaatacacctcctgatactataatgttggatactttgtgtatccagtgtcaccccaaattccccataggttaatttctatcaaatttcaatatacaataaagtaatgagagagagaattaggtcgtatcatagtattgccctgaagactgtttaaaatcattgataactgcaaagttcctaacaacttgcagaccacatggtagatgactgatcagtggtagctgctaatgttgttattttcatggttatttaaatggatcttttaaaaactaaaaaacaaaattcttgacatgaattgttgccagtgaatgttgttatcttcttctaaaatgccttatatgtagattgtacaagataggtgtaaacccccataccttagcattgccatatggtgatgtctcgctgaccattccattctcttgcatatctggctcaggaattaataacctatgtcattccaaaaatgattctctgataccaattgagtgctctacaattcaattcaatacggagactaattaccaggaattagcgtacacccacagttaaggagctcaattcccctggtctgtcctcacctcagatgccagctgccagtccctggtcccaatggtactgaattatgtccaacctggctacaaatgtgagggttctcattaccccttttcaggctggagaatttcttagaatgactcaaagagctcggacaagagctattcttatgagtagcagtttattgtagagggtacaaatgaacagctagatgaagagatatatggggtgatgtctgaaggggtccccagcacaggaggctctttctctttggactggggtacatcaccctcccaatgcatccatatgtttaccaaccagatggttccctcaacccttatcattcagagtttctaagcaaggtttcatcacttaggcatgatttattcaatcactggccagttgctgaactctgatctccagctcttctctcctaccagatcttagagtggggctgaaatttctaaacttgtaatcgcatgattgatgtgatctgatgaccagcttaatcctgaaactataagctaacgcctcccctcacaaagagtcctctgatgttgcagtcgcattagcatgaaatcgaataaagtgcaaagaagtttgctatgaataacaaaagacatttctatcatttaggaaatttcaagggtttttggagctctgtgccaagaaccagagaaaagaccaaatatatattttattataccacccaaacttgccaaatattgattagtctgaatttcttatcctatccattgtgttttggggtccctatgtaaaacaaacaaacaaacaaacaaaaacaaaacaaagaaactctgactttacacttttctggactttatagagagcagtcttatggaaactataaggtgtgcacaattgtttatgcacgtatttctctgcaaataccatgcaaagtatctattatgcttaaaattttatactatttattttgtgtttttttgtttctattttggagttttttcacacatcaactcaatgtgcttgccctctctttagacgtgaattagacaaatatctctatttcaagtgaaatcttttttctaccttgaatgtatttgtttcattgtgtagtttaaattccttctgtcctcaaatttgttcaattattagattataggctcaaaattagtcaagtacagtgtagtagtttttgtttgacatcaaatgcaatgttctgtatttgtgttttaatctgtttcaccctggggatttcctttaaagagagtctgtctttaatgttagtatctttttaaatataaacattcaaccagtaagaatacaaaaacacagagacagaaaattatgacaaacagaatgtcaatacttcttttccttttgattaatctagcatgcaaattataaaagcattttggttactcaggaatttcaataggcctttgaactttttaaataataaaaatattaacatattctttaagagataacatatagaaagatatattagcaaacctgttcttactgaaatgtctaatatgtcctctttaagctttttatattcatctgaataatcatacatacatacatgcaaatatgtatacaatataaaagaaatgagaatgccattttatagtgctatgaaaattgatttttttttacatttatacatccaaattcatgttaagaagtttttaaatataactggtttttttttctttttctaggtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaacattgattatggtcaagggattctttactggtatttgattgtcagcttggggttgtagaaaattttgcaaatggggcaagccaagcaattaattctgaacaaataaaatgttctaattgaaattagtgtttccttattccatgtgagccctaaagcacaattagagcaatatgtatggttgttgagtgttttgtacttaggtatcatttgcacgattaaaaagcaaagtaaatgttggaaagccaattcagcagattagtatctgtaaagaataaatgattggaaatcattcaaggacgtttatgagctttaagacgaacaataaaaatttatgaacttaaggcaggaagcctcatataatgctttgaaagccttttgaacacatggaatttcacagttcgaaagaactgctatttgatggctttagtcttttggaatatacatgtgctatatttttaaggttatattttttgacttaagtaatttatgctgtaaaagacagagggattttagtcaaaggcctcttttcctagtatagatgttggcctgttgtcttatcttttgctttgagttatctttattcattgggattttgtaagtcatatgttatagtaagaaaaatacttgacatttatagactaaaatattatgctaaaaagtttctaacataacattatctgaaaaatctaagcttgaaaagtctgctatattaaactgatcatgaacttttaaaaaatcaggtttcaggagctattgtaatgaagactggaactggcagtaggacaaacacatagatcaatgaaagagaagagagaacccagaaatagaccctcacaactatgcctaatagattgttggcaaaggtgcacaagcaatttaatggaggacagtcttttcaacaactagtgccagaacaatcagatatccataggcaaaaaataaaaacaaaaagcccacaaaaaacaaaaacatcatattggcttaagccacacaccttatacaaactcagaatggatcatgcttttaaatgtaaagtataaatctataaaacttttagaaaaaaatgtttgggatttaaggctagggaaaaatttcttaaactgtataccaaaagcacagtccaaaggaggataaactattgttccatgatagaccctgttttcaggctaaaaatacaagttacagtctagaagaaaatatttgaaattcccatgtgtgacaaaggatcaacattcatatataaagaattcttaaaaatgaacggttaaaaacaacaactataacaaaaacacaactatacaatcagaaagtgggcccagacatgaagagacatttcactgaagatttacagatggcaataagtacatgaaaatattttaacattactagccaataggtaaatgcaaattgaaactacaatagaatatcactacgaatctatcagaatggttaattttttttaagtgaccacacccaatgatggcaagcatgcagagaaactggatcattcatacattgcagttggaatgtataatggtacagctactttggaagatattttgatagttttttaaaaaactaagcatatatttgggttggttccaagtctttgctattgtgagttatgccacaataaacatatgtgtgcatgtgtctttatagcagcattatttgtattcctttgggtatatacccagtaatgggatggctgggtcaaatgatatttctagttctggatccctgaggaattgccacactgtcttccacaatggttgaactagtttacagtccaacaatgatagactggattaagaaaatgttgtggggtgggggagtggggagggatagcattaggagatatacctaatgcaaatgacgagttaatgggtacagcacaccaacatggcacatatatacatatgtaacaaacctgcacattgtgcacatgtaccctagaacttaaagtataataaaaataaataaataaataaataaataaaaaccaaaaaaaagaaatctaattataccacataaataaaccaacatttatttaaacattaaaaaaaaaactaagcatatactaccatccgacccagcaattaaatttcactggacaattccttcaagtcatttatcccggatacataaaagtattcacacaaaaacctgtatgcaaatatttgcagcagccttatttataatagccaaaaactgagacagcccagatgttcttcaaaggatgaatggctagataaactgtggtccattcatcccatgtaataaatattcagcaatacaaaggaacaagctttcaatgtagacagaaacatggataaatcttcggaattatgccaagtgaaaaaaaaacagtcccaaatatgattgtttgtatgatttcatctatataacattctcaaaatggcaaaattaaagaaatgaagaagagattagtagtttccaggagaaaaggagggaaatgagagcagctttttttgttttatgggacaacaagagggatctttgtggagatagaaatgctctgtatcttaattatataaatgtcaatgtccttgttgttttcttgacctggttgtttacttgaccaggatttcttatagttttataagatagtatcggtggggaaaactgggtgaagaacacctgtgatctctcagtattatttattataatggcatgtaaaaataattatgtcaaaataaaagattttaacttgaaaaagctgtaattttttaaaaagtcctaaaataaggcaaattttttttttttccggtgggagggaggccgagagtttcactcttgttgcccaggctgtagtacaatgcacgatctctgctcactgcaacctccacctcccaggttcaagtgattctcttgcctcagcctcctgagtagctgggattacaggcatgcaccaccacgcccagctagttttgtgtttttagtagagataaagtttcaccatgttggtcaggctggatttgaactcctgacctcaggggatccacccgcttcagccttgcaagtgtgagccaacatgcctggtggcaaaagtttttttttttttttttaattcagtttcaatttattttattaagtgtatggattatgcaagatcattgaaatcttttaccccgaacaaggtactggaaagaggtaaaaagatttaagtatgcatttccacatttatagttttatgcaaatctgatacagtttttaaagattagtgaatgaaaatagttaaaagtagtaaaaaatgatcaattattaaataaactagtgaaattagtttgagaacttttgtattcttgtccaagtcagttgatttctatctagaagaacaatttttactatttgttttcagggaagctggttaactgtctatgaaaagtaaaactgttttaggttatgccagatcatccctgatagtgtcacaataaccattctctaaacacagaaactgaaactgctttttcatcttatttttaaatagtaactttgtgtaatttaggtttatgtttttaaaatgtggaataaggaacataaaactaggttaactttgagtatttggacaaaatagggcacaaacttttaaaaatataattaacaatataaacataattatggaccagtcttcatattcttatggtcttttttttcttatcaaggaacaataaagatactttatgacaaaataactggaggtgaaagaatgctagcatttaaataaattttagaaactttatttcaccattttatatcatttcatttatttattcattttatttattaattatgtcccaggtgcaattgctgggctgtatattatagggtgtatttgtgggtatgctcacataaattgaattacctccttcaagaaatttataaccaggaagaggtgatatgacacaaacatttatatccacagcatacaacatcatgttatgtatcatatatatggtagtttcaaagaataaggaaaacttttactcagggtaatcatgttagagaagaatcatatgctgggctttgaagagcagacagctaaaaatgaatagaaaaacaggagtttgagaccagcctggccaacatggtgaaatgccatctccacaaaaaatacaaaaaatttagttgggtgtggtggcacacacctgcagtcccagctactttggaggctgaggaggagaatcacttgaacccaggaggcagagattttagtgagctgagattgactactgcactccagcctgagtgacagggcaagactctgtctcaaaaaaaaaaattaaataaagaaatagataaataaataaataaggcaagcagtcattctcactcttggctatggcattagaatcatctggagagttttacaaattgtttatgctgaggccctctcctgcagaaactctgatttaattggcctgaggtatagccccagctttggagttttacaaactccccaggagataatgtgcagctagggttgaagaccattgaatttaagtgaactgatctcttccacccattgaagactttccagatttcagaaaagggaaacattagaaataaaaataaaaacagctaattatttaaactgcatgtattttgtgccaaagtctttacttgtacacgcttaatccttatatcttttattcttaacacacaacagtagttggtgttattcttcctttattggtgaaaatacagagactaacttacctaatatgattcaagattgagtttttttttttttttcctgaaacagtgggtctcaatgtacatgctcagcatagcagcatcagcatagcctgggaagttattaaaaatccaaattctgttgtcccattgagacagaaactctaggagtgggcccagcaatctgtggtttgacaagcgtaagtgattctgatgcattcaagactgagaaccagtgtttagggacctgattccttaaactgcaagagcgctacctaagaagagagctacgcagccagaatctcaccatatgcaggacaaagattaatagaaaatatcatttaagagcaatgatctaccctgtttttctttagtttttcacaattatttcttcctggatttaacgtccaactgttcatttctgaccttggatgttgctctagtaacaaatttacccttcaaggttaatgtttgatctgttttcattataggtggcatagtggggtgtgcatggaagttggaagaaaatatgtgtttaaattcaaattatccatattaaaatttgtattgaaatataacatacctataggagcttgcatatactatgaagatagcttgaacttctataaaccaaacacctgtatggtgccatcacccagataaagcagcaaaacattgctgttctccattctgttactacgagccacaagggagaacactgtctacatttgtaaagattaattctgcctgtttttgcactttaggtaaattcacacactatgtactgttttgtgtatctcttattttactcaataattagttcataaaatatatccgtagttttcaagtattgtataacagattgtacattcccactatgatataccattccattgcacatatcacaattgatccactctactgttgattagattgtaatacagatgtacatgagcaatgcattattgtatagattatttgtctgatcactctctatttcccatccattactctgcttcttctttgacacctatttcaaaaaaatattatttaagagggcacaaacattttttgggtgcttagatagtgcatctgccgtggaagtgtgtttatcaatgtaaacctcccaaagtcccgcttcttggctgtttatatcatattttacagaggagacagacttagagatattaactaacttcctcaagggccccagttcacagttgcagagctgggagtgaattttttttcttagctccaaagtccctagcttttcgattactttgtcattttcagaaagttcttatttatctttacagattaactgtgtattttcctatttatttgaaatcatatcaactaattcctaattaattaattggaaggcaagtgaaacatactacaatatgtatttaataaacatattacaatatcaaacaatatatgattttcaatactcagtacttaatatacttctccagacatagtggttagacattttatttttgtatttgcatctttacaactgtttctcaaaatagtcaatgaaataatcattctggaatgccttttaatgccataaaattaaaaccatacttttaaagaagatgaaagcattccaaagtatggcaaatcatgatatgttaaaaccttgatgatcagaatatttgtggttaatatttgtcatctagtattttgatagtcaacatatcagactaaattattttttcagcattctgagtcatgtatataaatagttttaatttaaccaataaatctatgtaattttatatattatccatatatatttggaattattggtccattggaattatttaacaattgtatttttaagccatccttaaaaagtcaagagtcctttaccgcatttttttaaggacaaacatgaagtaaggagaaatcaatttttttaaaatttttaaacaaatttatagttttatagttttcttgtttggatttaaaatacaccatgtcaagtagactagttaactattttacactgtcaaccactttcttaatacatcttatgtttgttatcagaaactttaattaaatttactcttgtttcagcagaattagagctgtcctctatacataatgggacataaatctgcataagaattagctttttccgaatgcaagagtaacagttgaatgaatcctttaaatcgtgtctactagagggaacaaatcaaccgtagctgggctacatctgctatgttagtagtatctgtcctctaaattcgatgctctgcaaaagatcagcattgttattttctacagttagatgcattcatttcagtttaggtctctactattttatagctctgggtacagaattatttttctggtaagtatctattttaactaagaagtaatcctgtaaaatgcatcctgcatgcactactgctttaagaagtaactcttctctagtgaattatctaattaaagtctggaccttaatacttcagtgctttacaattacagatacatatttaaaaattctgggggagtacataatctggttatagaattatctaggctgttaaaattcatacattcggggttcactaatatttcaaaaaatacaaactcaaagaaagcacagtctgggaaagttactgtgttcaaacatgtgggactctgagttcatcctgaaatcctcctgccttctagtgcccatagaatactcacctttcctcgtttgtagttgctgctgctgaactgccttcctatgtaaccttctccttactacacagagatattaaggcattaaaaataagttagtatcaattttggaatatttcttttgggttaaggcaaaaattgaaaagtccctaggaggtggacaaaaaggaaggaaagaagtaaacacaagaaatatttttggaagccagtatttacaacattttttggtgaaagttactaatgtatttatcaatttatcactaattaaacaacacacttttatttatttttttattttttatttttttttattattatacttcaagttttagggtacatgtgcacaatgtgcaggttagttacatacgtatacatgtgccatgctggtgtgctgcacccactaactcgtcatctagcattaggtatatctcccaatgctatccctccccactcccggcaccccacaacagtccctagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattttgaataatgccgcaataaacatacgtgtgcatgtgtctttatagcagcatgattcatagtcctttgggtatatacccagtaatgggatggctggatcaaatggtatttctagttctagatccctgaggaatcgccacactgagttccacaatggttgaactagtttacagtcccaccaacagtgtaaaagtgttcctatttctccacatcctctccagcacctgttgtttcctgacttttttaatgattgccattctaactagtgtgagatggtatctcattgtggttttgatttgcatttctctgatggccagtgatggtgagcgttttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttactttaattagatcccatttgtcaattttgccttttgttgccattgcttttggtgttttagacatgaagtcctcgcccatgcctatgtcctgaatggtattgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcagatttctcaaagatcagatagttgcagatatgtggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcgatttgtagttctccttgaagaggtccttcacctcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacaacaacatacttttaaatagcatctttttattttgaaataatataactgtattatagagaatctgaaaatacacacacaaaaaaagaagatagaaataatgcctctatccacctccgttttttagagaaaaccactgttaatgtactggtttatctcatctaattcttatttattgttattagtatgtaatattttttccacttatagacaaaattataaaaatagtataacacagtttactatcatgaacattccactatgaacattgttccttgtcttaaatatttctcaaaaacattattttaatggctttaccatcttttcatgtggtgatatcataatttattcaactcaatatctttaatatttatagatagttgacagattagcactctcactattacaaaaatctgtcctgcaacgaacactaataaatatctgtctttgtttattctcagttaaattaatgagactgaaattatgggattatatattttttacattaattagtgttcttgatgcatattgctaaaatgcccactagaaagcaaagtaaatgtatgcttccccagtaaagagaaataatttaaggttccttttggtttatgatgctattttataggacacgaatgctttttctaaggtaaatgaacaaacataaacaacaaaattatttatggataggagaatctgtgatatgttagcaatttctgattccttcttacactgaaagctctgtgattcatattcactctctaagtgcaaatatctaagctcaagtcattgagaaagtaaacctattttaaaaaaaataaacaccttcaatatcaaataattgccttcattactctggtaaaattacactaggattaatagatgagtagaattagcaagcgatggagtaaaagtaagtttctcctcataggagttatttagtgagacttattttaaaactgttactacacaagacagtccttaattgtaaaacataatggagtcatcatttgtatctattcacaggtagtttatttctatagaaataatatcatgttctcattttaaactgcaagatgcaggttccaaccttcttctttagctttgcattcatttacaacatacaggtaaatttgaaacatgtttttagaattggtacctatatatacttgtattaagattatggactcttctttagttcagtgggttcctgcatgtgcctgttatttatttttactatcatgagataagtatctaagacaataaagcaacctatttccttatggtgtgttgactggcaaagaatccccttgcacatggggaggccacaaagtagaaataggcttagcatggagaaaaagtaaagtgagtccctatatatttggcaaatattaggttgaatgtgagttaagcagttttctctattataaggctttagagagattttaataagttagtgtattataatttatcaaatggaagaaaacatagttattgcaccctgactttacttgagacacatcactgtttttttttttttttttctcatggatctgtgtatggtctagaacaaaaaaacatactttgggcagtagtatattaggaaaatactatgatactaagtaaaaagatcttattctggtcacctaataatgacgcacatctgccgaacttcatgtcataaagcagtaatttattgtgatcatagattctgcagatcagggtttctagaagggcttggctgtacatttcccactcgaaggcttaggtgattgatgccagatgtgggggctgcagtcatctgaaggcctggctgagctgggagctatactttcaaagtggctcattcacatggctggcaagttgataccagttgttgactgagaacctcagtttttccatgtgtagctgtccacagggctacttccatgtcgtcatgagagggcttaaggcttcccccagtctaggtaatccaagggagccaggcagagtctgcaacactgtagccttgaaacccataaaccatcactagcactctagtgtgtgtcacacaggcacagctgtgattacaggtgggaaggaagcaatgaggccatgaaattcaagagatgagaatgactgatggctctctcccttgacacagatcctgaaacaaaggaagtaaattgcatgaagacttggaaaatgcctcaggaaatcacgatagagttctgaatactagttaggtgtagtgaggttaggtggctttgaagctggctgaatagccatatccagagaactgtgattaattgatattacatgtgagagcctccatggatcgatcagaaacctatattattatgtattattaatattttcatgtctgtttcttgttctatacactttaatgagtttaaaataaatagataaaagtatacttatcatagttttgaatgagcaaggtagaatagagggttgatttacagataatctatataatcaagattacagataacctaggggtggcaatgctgactggagttcaaatgattaaacttaacagtgtttagagtgaatttaagcatgcattttataaaaatctggctcccaaaatgtagcgtgaaggatagtaatggacacactaacttaagtaacgttattggccacagctcagtataaattcaggctgtcacattaactttaaaaacactgataaatttttaggttggttaataaaattaaactacctagaaccgtgtgccaatactgcagtcaccagccacatgtgtctattgaggacttgaaatgtgagtagtccaaattgaggtaaaaattgtacttcccagattttgaagacttaataaaaaacagaaaaacataatattaattatgtatcatattcatgatatgtttaaataatatttgggatatactgggttaaataaaatatattagtaattgatttaaccagttactctttattttctatgaacatagctactgaaaataagcttacatatgctgggtttgggttacatttctgttgctcagtgctgctcggtggatacaggaggtggatatatcagtgttctaagggcttattggaaaacacctgggatactctagccaattagaggctgtataggagacagtcataattctcaaagatttagcaattgtgatgaaggaattatgtaattgtggaaaaggaaaactctggaaaatatgggaagaataatagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggtgagttatgttgaaatagttaaatttcactgttttccattaatccaagaaggataacagttttacttctgaaatacatcataccataaacacaggaaaaaagagatgtgactttccaactaatatgtcaagtttgaaatgttgcagcttatatggaccttgatttttcttgctacaaatttcaatcaaagcagtagactttgttccatgtaatcgtatcttttttgaaaagtatcaaatatggaataacttttcagagaaccgtaacagtaataattcttagtagaaacagaaaacttcaagttaaaaaaaaaaaccacaaccagatatacacacagagaagaaattcagaagtaatatttgctaatattttctaattataccaagacagcaatgttatgattcctagttggagtttatactaattaattttcaattgttttcacgctgcctattttaaaaaggaaaacagttaaaggttgtgtgttagtaaattaaccagctcaaagagagtgtatagtgtgggggtctctaaatagaaaggaccttagtgtttctgaggaaagaagaaatgtagaatataattagccatgaggtcaacacagttttaaaagaccttggccagaaaatgaccaaggctttatggtcaaaacatttatactttatttttcacagcaaatttttgttaagatataaaatataatctactgtacttgaaatagactgaagtattgcattatgatgcttaattctacttacttaaacttcatgatgtttaattaaaattcacacacatttttcttcccttttcctcttgggatcatttaaggctaaaactggaacttaatctgtgaggtaaatccaacaccaagtacagtgtatgtgcacattatagtcatttgtttgtttctttaataattgaataagtgggggaaacaaagcttgtctatattgggagaaaatatgcattttctgcatcttcctaattccttttcaagagacttgtttcaaaataagagataccttacaggctgaggaaaagctagtggtatttgtgtgaattttgatcttcataaagaaacattaaataatctaagttattcgtgcataattttgcaccttaaactagttttgcacctataattttgcacttaaacttgtgaatactgtcagacaatggttttcatcatattttctttctggataaaaaaattctgtccataatatttcaaatacaaaaacattagcaattttcaatccaaggatatcactttgttattattacttttctcttcataaagaatagaagagcacttttttgcagttgaatttcatttaatatgtatgcctgtatagtaacacattctgagggagagcattttattaataatttacattttctttgtttgcagattgaatgatgccatgagaacaattaatggcatagatgttcatttactctccctcataatttctaagcaaaagcatttttgtatttattgaagggatgcaaaatacaggcatcttgtaaaagatactgtgaaaggggaaattttctaaataatgaatgttgttaatagtcatgatgtttatgtagaatataaatttaaaacctataattaggttattgtggattatacctgtatttattagttattcacttataaaatgaattgtggtatttgttttcagaaaaatgttccaaattatggggcaacatcccatgccccaaaaaatatcctgtttcctgttattggagagttaggttaatttaaaatttcccactattataaacaatgttgcgatgatcatccttgcccttaaaactgtggctgcatttctgataaatcactgtatcaagtgatattaattttgtagaggttattgaggcatattactgcatttcattccaagaagtttcaaacagcacttcctctagctttgtgtttatgtgtgttggggtgtgtgtatctgtgtgtgtgtgcgagagagagagagagatttttaaaatttaaccttttatgcgttattagttttgtggatgagataattgcatagaaagttcagataatttgctaaagatctgctggataataacagagctgggatcagaatcaaaggctcatgatattagccataacgttaacatgatctttttatgttaaaatactaggttaattaatcataaattcattcaataactatccatggaaagcttactatgtaagctttctcctgcactatatgccatggatatagcacagaacaaaacaaatgataatcccttgcataatagtggggagagataaagataaaagaaaataaataagtaaattacgtagcatgttacatggtggtaagtgctagggagacttttattttacattttatttcacttttacttacttttaagtacagactcacacaaatttgcaaatgagtatagagacctttgtattccttacccatcagcaaaatccccccagtggtgacatcttgcatacaaatagtgcattatcaaaaccagacaattgactagcataacataattcatacaattatagatcttaaacctgtttttgcatatgctcattttctgacatgcctttgtgtgtgattctatgacattttttattatacgtaactaccgctaccatcacaactgagatacagaactgctctgtcaccacaacgaaaatctcttttgcttcccctttatactcacatctctggctacttatctaatttctggcaacccgttttccatttctataattttgtcatgttaggaatgatatataaacagaatcatgaagtatataattttttgaaattggcttattttatattgtccaacataatgcccttaagttccatccacattgttttgtgtgccaagattttgttcctttccattgctgagtagtagacagtgacatgtaaagcaaaaaggaagatgccattaaaaagggtgcagttttcaatgcagtggtgagcaaagaggcattccacaggaaatgacacctaagtgtcgacctaaggaagtgaagaaagattcttgtgcatatttgtgggaagagtgtcctaggtaaagggaatatcctgagtaaaattttggagcagccaggaagcccttttggcctgagcagtgagagagagcacaagcattaagagatgacattaaaaaaaaaaagagagagatgacattgagacccattttaaagccctgtagactctacagtttgtggtaactgcagtaactgtataactatggtgattgtattaggtgactcaaatttcccatgacgttacttctaaactctgaagagattgaaagaattatcccttccctacgtgtgtagcaaaatgaatattttataatagaaaaatagtttaattgcaattttatcttttaaaaagatttccattttaaaaaatggaatataaagaactttatattccatttacgaaatgttgtgtcagtgttgtcaaacctttaagtaactttggcatgagacgggaagcatatattctattacttttcatcatccatgatttttactttgtgaaaacctcagttgggggatgcaaaaggaatagaatttactggaagaacagagatagcacctcgtatgaatcagaggacattgcatcacagttggggtcctcagcccagcagagaatatcacagcaaacactaaatagacctgccagaaaattccggtcttccggtccatttgggcagttatgtgatctaagtcaagtctcagtctttcactctatcaaagaataaaaagggtataagtcattttgacaggtctcaaaagcatcttagtaaatgaacaaagctcaggacatcaaagttgacgatgttaatcaaagactgaattgaactggtgcttgggggactggcagtcctaatctgattttcacaaacatgccaatatcaataaacttgcaggtaaacacacagccaaataaatagaagtgcattcatttttgctaaatactagatatttgatttctttaattctgtactatgtaattggaagcttacattttggtgttttacatgtatttctaacaccgcatataaactctttaaaggcagacacatgctgggtttttttttgtctccctcacatgcctagaatatagaatcagtatgtcttcagtcactagctgtgaaaaaaattcatttatctgacatcgaaaaacacaagtcattgcttttggttatgtgtgaatgtcgctgttgctgtaaataaattcagacacagtcaatgagcgttaacatttgattgttattccttctgcttataacaaagaactatgagatgaaatctaactgccaagaatcagtaggggaaagtagtcattgtgttaatttcaatgctgcggtgtaaatttcattaatattaaatggatttttatttaacaattgtaacttcaaaggggacaaaaaattaattaccttaacaaattgaaaagtcttcccttccgctgtacaggtaaggaaaataattaaagaaaaaaaaaaacaatcctgaagaaacactgactctcacatgcttattttcttcctgaaaatgtgagatagtaaaaactgaggaataaattaaaatttgcttctaatgttataaaattttgtcacaaaaaccataataaaaatgaaaatttcttatgatatttgtagaatattcaataatccttgagaaagtgtcaatatagtcagctttctggaattacaggtgtatgctgttgttatagttttaatttcttgtttttacatataaacctcctgggctaccttcagcatatgtgtccatgattgacagtaaagagttgctatttctgcaagtcttttcatgccgagatcaattttcccatttagtccatattaattcctaagtattcacatcttacaaaattaagtgagagagtgtaatctcaattgaggccatgggaaatatgagcaacctggtcaaggttttaaacctgtcatcatggattattttgtatttgtccctgagttcattctggcccaaaatctaactgcccatcctacaactacttagttaagcctttcctcccatcaagagtataactctggttataggctttaagtctggcttattttaagggtcaaagctaaatcaggccacttgaatttagactggtgtcactcgctgttcttaagggcaacataacatatggcattcaagcatatcctcctgaaaagactgaactttacctacagaggggtataaactgttcctcactgctgctggtggtggtgaattgatttcaaatgtagggttgcttatagttggaggatgtttccttttgctttattttggttcgtattttctgtttgttaaatacagaaaagaggctgtttatcctcagaaagtttttcttgactgctgcctaagttgttttctttcttctgggttaaagaaggttttctgggatagttaccgagaaatgacagtgatttttatgtcagaggggatggtagaatacctcgatttattactgaggcccaaaaaagtcaagtgacaaaaaaatctaggcagcggcagagtctgacctagatgatatgtttccaaatgctcaataaaagactgttgtttaaaatactccatgtcaatggcaaaaggaaaaattttattctctccaaaaaagttggtaaaagacagacatatatcttgatctctttcaaatactaattaccttgcatttctttcacatatctactcattcatttttaaattattaaatatgaggaaatgcggtaggtaatagacataaaaatagttacatgtaattcctgcctttcatttgaagagttcacagtgtagttgggaaaatttgtataaatagaagaattacagaacattagagcaaggagcaaagaaaagctccaaaattccaagaagaaggcatcaaaactgttatgaagattgggtcggagttttccaatatttttttctttttaagtgggaagatgccttcaggcatgtacagaacagagccatgaaaggtcatagtgtgtttgcacaacagtgagagacttggtgtggtaggagagttgggaaataaagtctggaaatcagaagtttaattcatgtatttgctaattattttcaatccctgaagttagctgtgatgaaattaaatcacaaatccccaaatcctcaagggctcataaatcctcaaatcctcactggctcacaaagactatatgggatttttacatcaggaaagagctgcctatttgttggttgagaatgctgtttttatatggcacctccagtcctaatgagtttcacaagatcacaggaagctacagagtctcttgtgcaccctctgacctaggacttgcagtaaaagtagatgtcatggtcccccctttatttaatgttttcatccttgatgctcagggcttttccaacgcattcttgaccttgctagttccgtttctatttgagaatggacaaaaaaggcaagaggaagctctgagcaacgcctagatttaggaatgactgaccctcttagacttaaggtctaaatctgcattcggatttgggaacatctttttggttttccacatctacaagacaatgacactgatgagttccattctctccctttccaattggccactaaaacatctatcaaaggtagaacagccactacctacttgatcagcttccagccagatgaaatgtcttttgttgacactgaaataactgaattatttatcaagctctgttctaacccaaaattacgtatgtatacgtaagtgtatatacatctacatatatatgtactttttccttatgcatattctgcagttgtatttgccagttgtcctcaatctggagaaatcaaaacctatagctaatcaatgggttcctttacaatgggatagaaaatgtattttctttcttttccattcatttaggtttctctgtattatatctaccaatttttctcaacaattttattcctcatttattttcatgctgataatgataactaagaggattttctactctctttggaatgagttagataatcatggtcctgataaaatataggtgttagggtaggataaaaaggaagacattgataattaaacttatcaaagaccagcaatatcacatgcactcagcttctttctttgcagatagtcaagagcttagggagtgttatttgaggaactaaaggtgtaaattctgggaagactcatcaaagttggatgatatggtggacagcatgaaaatgtcaggtaccttgggaaaacagacattttccctgtttcactattgtgagacaggtctttccagctcctcccattcttgatgcagaattgctgctctatcacatataaaaatgcaatttaattcaaatgctaattattgggtacctactaatagaattaacatccgctgagcctgacaagaaatgatatggaatccttagaagctatgagcctggcctttgaaaagtttataactgatatttttttccttgacttatttttagttgtgcgtattcctctttatccctgacatgaaatgtcacctagtatccatttccatcccagtattgccctacagaaaactctgggctctaagcaagacatgaatgataacttaaaattcccagcgaggtcattcttcatctttcactttgctaaataattgtggaacagtattttaaaagctatctggcaataacatataaagtagctttagaatgatgcttttgcagtcacagcactaaaacctttttttatgaaaacttcaagatttgtgcaaaagtcactttgtaaatgagagtatttaagacttccgtgatacgatggcagcttctattaaaacgaaaacaaaatgctttatctcattttgcaattttaaagtttgtttcatagctccatatcagatacacttttcttaaaatggcttataggccaggcacagtggctcacgcctgtaatcccagcactttgggacactaaggcaggtgaactcttgggctcaggtgttcaacacctgcctgggcaacatggtgaaaccccgcctctacaaaagaattagctgggcattgtggtatgttcctgtagtcccagctactggggtggctgaagtgggtggatcacctgagcctggaggtccaggctacaataaactgtgattacgccactgaactccagcctaggcaacagagtgagatcctatctccaaaaaaaaaaaaaaaaagacataaataatttcattaaggcaaatgacagaagagcttgcatattttctatttctttacatgtaagatgagcacttatctaacagtcttaagtagagttggcatctttccttaagttagatcaaaatcgattttgtttgtgtttagatattcaaatgcattttgcttaataacccaattagacttgaaaatagtgctagaataagtatgtgattttaacttttgcacaataaaaccttgattagctagaagaaaactaacaagaaatatcaattaaccagaaggaacaaaattataaggcaagctcaaaagaatctagaatttagaaagccgtatagaaaatgtggaagaaattatgtgctgaaggttataagcaaacatctaatctgattcctctgttttttatggttacataatcactgtttagatatttaaatcttctgggatcatttaagcgagttttctcctatgcattagatccttcttaccaaccagaaaagtggaataaaattatgacagtatcatcaacaaagactgaaagaaaagtttctgatgattattcaagtaactcgagtccagcagaacctctaattttcctggcattatgctaaaaatacatgcatggaggaggtgatagtattaaagacgagtttcccaggcagacagtttaggacacagaagtacagacaaggcctcggcacacacaggagtattctacaaatatcagtatagaaagtcagtgatgcaatgaggagcttgtataataggctttagctatattatcaacagatttcaagacccattattacttcaaacaataaagactcagaaaaagatacagttccttgcctccatgaatttaccatctaatgatggatgaggaaggagttcagtaattagacacataaaacagccgttgataaacatcataatgatgtttgatatgtccatgatataaacacatgtgaaatttgagacagctgtatattcatttgaaaatagcattcgcctccatctcaaatacaaatagtcttgcttgattctgtggaaatgtggcagtggcatcatgtgacaaagtttaaatatctgtgtaattatcctcttctctcaccaaaatgtaatgttctcttgattcttctatttctcttaaaggtactactacctatctaacaaagcttgaagccccggttatctttgtagcaccatcaccatcacttacccaattttgttttgatatcaaggaacccagctaatggttccactgcaaatacttaatcaggcctcttagttccctcctttgctatgattccagaagccatgtctctattactgccaggtacattctatgaaataatggctttgttgtttggatacattgacttgctgaaaatcttaaatggtccagtgccttctgttaaataatgtacaaactagttaccctgatatcaaagtctatacggtaggcctggagctgcctttctgacattattttctatatctgtgctgtgtttcctttctaccccaactgtgtgtgatcagtcttctcccagtccaacaccctttgtcctttcttgtgaggttaactgcactcactcacagatgttccttccttgatctccgtccctttctatccaactttttctatccttcaatgtttagtccaaagatcttatcattcatgcattctttccctattctctcatttcaagatgactgtttctgtcactgcactcttttaccactcctttggtttattataaatattggtctgttcattccatttccacaccaccacactagttagaatctctatctttattcaccgggattgctacaatagactcctatttgatctctatagccaatgtatcttacttcctctctagtccattctctgcatagaaaccagaataacttgtttaaaaacacaaaccagtcactggcttaaaatcaatcattgacaccacatttagaataaggtctcaatcccttaaagctctacaatgatatgcaagctctggcttgtctccctctctagttttgtctttatccaccgtccatgctccaggaacatttgatggaatgcatttttgagtgtattttatgccttcttacccaaccttcacacataccattctcccaactgcaatgccctttttcccacatcacacacattcctgagccaagtcactgtgatgatgtgattctgcttctcagaatatacaaatcaactccatctatgcagctcaggtagaattaattccactcaaatcatttgagtcatacaaaaagggggagagacagcttcctaaagggaagtccaaatgctataagaaaatgaaagaataaatgctagtcaggcaagagtgaaaatccactacggtcagtaatggctcttataaaaatacatagttatagaatctttaatatgcatgtgaagtatcatgaattacatagtgaaatatgcatgaaaaatgaagaaaactcatcattgtacatggcatgcgtatcatccaatggctaatgtagctgagttttttttgtcaagttagaaattttcattctcataccaatccctgtaacattgctattgtcattgcatctctgaaacatgttttcagaatgacagctataatgaaatatctgatgcttacaaaatgtgctcaaaaccatgttcatgggaatatgcatagcacattatttaaacagatgaagtctccagtgcacctcacaacccagaaatatccccttcattttctaactactttttcatgcagaaactgaccctcgttcttagtttttgcatgaaatttacagtagccatctgcttaggctgtgacctattttctttctcaacttttctgttaaagagaatcaactataacgcttatttaaaggaatgtgaataagctaaatatggggttgcagctggttcagactctctattgaaattctcatggcctggtataatttaagatctatttatgtaattgctgtgaagtcggagaaacaatcaaagaaagctgtgtgttacatcattttgccaaaagagatattgtgtttgtctccttgtttaaagaactgaactccgtagtagtaatctggcccatccacagatgtgcttaggtttaccctcacaatgttaatgcaaataatgactaaaacattcaaaatataatttattgtcaatatttaaaaattggggaattttatattcaaaatcatattccttttttttctcttgaaaaattggaagatctggcaatattggcatatggagacattttcccatggtaaccattggttcactctcacagatggggcattctctcttcaggtaaccttagcactcacaatttttaatagtttattcttgcagacttcacttgcttgtagtacctgtcaagcttttgtagacatttcagattgtaataattgcttgtcacaatgggatcctctcaaacaaaagatttggccaaaatgaatagtataaggagtacattgtgcaatataattttaaaattaagaacaaattgctcttgtgggcttggctatggctatgatatgggtagcaagaacttcccaagactgggctgtagttaaggctctgggtgtggcagtgaccatgggtcaagctatggctgtggatacagctgtggctatggattctctctccaatgaccatcaaattctcaaagctgttgatcattttgctgctaatttttgactttcaaacttttcatgcctctccctagtattccatgatgaatttcaagatgctcatgttgatttttcttacatttctctttattccttatggacagtgaaagataacatgacattccagtttgatcttctgcctcttgggcagtttccaatattttggtacaatcgacatttaagcatttgctcatatactgtcaaactatgggaatccaatgtatctatttgtatatatattttatttatcatacttcctaatgaaatgtatttacatttatttttaaaaaaggacaaatcactcaagttacaacctacaacaactagaaatcttttcagctacaagtacaagaaaactcaaacacagttggttaaaaaaagctagttattaatttcaaattatatctattaagtaggcagctaatttcatttgttctgtggctctacaatagcagccactgcgtttctaattgcccttaatctttcactgatgcctgtgaccttgctgtaagttggctaccatagttccaggtgtgccacacctattccaagcaaaagagtagattgaattaaacggcaaagggttgcattagttttgtttgcaccctttttatcaatgaaacaaagtatttccatgaagtactacctaggtgactttaattaaagtaaatccctgtccaagaggaatgagattataatgattcatttaaaacaatcataatttatccccttggaataacacagcatttgtcctctctgagattaagttatctcccagagttttcttagcatagaatctgggaaggaggtgaagacatttgtgtaggcaaaggacaaagtctgtcacacaagcgtctatgctcccatttactttcaagcaattttactctgaattttgtcttgtacttcatgaaggctccttccagaataattattgcctcacacggaattattatcaaaccaatcaatatttctgataaatgaggctgctgagctgttcattctgtaggttttattcatctccccttttatcttggattgcagtctaccttggcatgtgataggtattttgaaggaggtggaagatgtttctcagacgaaattattttaggatgtgataaaacaggggcaaatttttaataatttttaaatgtgtttttgttgacataaagagcacaatgcaatatgtattatcaataaatattcatcaatattcatcaataaattaaatatttattaatgaaaaaccttactcagaaacctcaagatcatgatttaggctgggatagcattaaacatgtattaaccagagacataaggcagggaagaccaaatatctcaataatctcttccattgctttaagttattcttcattctttgattttagacaagaaaatattacacaatttatgcaaaagttacactttaaattcctagattttgaggtcttaagtttgaaactaggtttattcagctgtggtgactcaaaagaagataagagagtggaggactcagacaaaaacgtccctgtagttgtcatcgcctagcctgagaaatgattggatttaaaaggaatttactatgctgaaagcaactcagattaatttaatgtgaccatttcaatgtacactcttgcattattcatgtactatctagatattattattttttatgcaagtctacagtcatttgactttcaaagtatatcctgtagatatcctagacctgatacacttggtataaattatggaattacaccataacattaccataaatctttatattcaaatgcagattgtgtctttctccatagctattcttcttgctcatctaaataatatgaagccaatgtaaattagattcataaatgaaaattatcactattttcaggattaagaagtatattaacatatattaataagctgttttcaaatctgtcatttcatacattatagtttttctcaaaaaatgtgaaacttttttatttgaaccttgaatgaataaatataatgatatattaaattagcataaaatattctgattattgagtataatacgttttcatggtcttcctacaagaagaaaaaaggatcctaattagatcaggacattgattaaatgcattagtgagtaaactgaagctagtatttactgaacaaatggcatattatactttatctgcactatgatctttgtagcaaaataatctattgattgttttatatagaccacaccacaaccatgatttggattcatggctgtactgggaagatgcttatatagatgtttcttttggcactcaaaattatgctgagggttttttttttcttaaatgatttccttagataattcttattatactattcaaacaactttcaaaataagtcactgaattatttaaactgaattattcaatgtttcaggtgaagtgaatactggagagggccagattcaggttagcttctaagctccgacacctatctctctctctctctttcacacacacacacacacacacacacacacacacacacacaccaaattaacacctttctccaggcccataatcactgaaaaaccctatcttgctttaataccagtgattactaaagtgtctactcccaaaactactatgtgttctacctagaattttgaccctacattttacaagtttcaggcagttaaaattggtcataattgctgaaattatgtcacatgtgaaaaaatgggatgcaaatcacagatgtgtccttatacctgtttactgtaaggacagcaagcagagacaagagatagagacaagagaatcaagtttctatttttagttccattgtcactgtcccccaccaagacatccatttatcatttctgaggacaccagcagcaatgttattcctgggtttacaagtacatctgaagactaagaatttgttcttgggcaacatcactttgaccacctactgatttggggtagatgcactaaataaatcaaatgcattcattaaatcaaataaatcattaaatatattgattatagtagccccagtctatgctgtgttcacaaatccatgctggtatttcaggagatttacataatctcataccccaaaggtaacaattattaatggttgctcaggaatccttccgaaaacatctttcttcttaagcacacatacaccaacacacataagtcttttaaaaatacaaaaggtctgtatactctgttctgttctgcaggcagtcttaataattttcatgtaatatctttccatgacaaaacacaagtacagggctcttctttttcatcatatcactaaaaatatacatttccttggtttatattgtagtctcttccccttgtgcaacctctgcctgttttactgaacaaatcactcctgacacattgggttgagttatctgctgatgtcctttcccataaatgttcccttctaatacaggggcagctctaaatcttaagctcctgttgagtactgggagaaaatatctaacttctgcattaatatctaggttttcacacctctaaactagaaaggacatgactatagcctgatgtcaggatctcattacttttcttctcttactttggtatctgatgttccaaatggatattgatggggaaatttatttccaatttaagaatcaagagcaaaaattcatcttctagaatatattatttcctattttatatgctctttcctggaaacttagaacatgtgtagaggaggaaaaactttcctctgccctcttacgtttggagctgtggcatgtgaattaaagcatacaaattgtattaatgtttttaattttacatgcattggaaccacacagaaaagaagtgaaaaacctaacggagttattagactcaggggcttatatactactttaacaaaggattatatatttcggaaaatgactaggaaatatatgggaaaactacgatgagaagagttatttagtaaggtttgtttatgcagactcatctctcagtactatctttatttcccgtaacgagggtttttgtcttcctgagatgggagaagggaacatttccacaaggaaaactaatgtgatacttgtagtcagaaagtgggagggcagagagctcttactgtttctgatttctctcaattaccttcagttataaaaaatcattttccaaagtggtatattttggtgtggcatatttggtcccttcatatgattatgttccttttttctatctaaagatggtatcccctaagtacatccttgaccttttttaccttcttatattagcacttgaggaaataccaaaaataataaatcgtataacctattactgatgaaatgtgtatgtttctttttgtcatgtatgtgtggtggaggaggtgcatagaggatatttctctgtaacttctagcttctttattggcaagcaaatagattggcaagcaaatagatttatttctgtgtgtgttttcaagtcattgtgattagcatggactacctttgaaatagccatttgagggtccccagagtctataatttttgaaataggaaaatttcaggatattagtatttttctgagtttaaaagcataacctaaagttaacttgtaggctttttctttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgtatgtggcccaggatgactttgaatgcagcccaacacaaattcataaactttcttaaaacgttgtgagatttttttttggcaggttttttttttttttttttctcatcagctatcgttagtgttagtgtattttatgtgtggcccaaggcaattcttcttccaatgtggccaaggaaagtgaaaatattggacatccctggcctagattgtgagaaaagagatcccattacatttatgaatgggctgtgctgaaaattgacagcaacatcagaatcctaattgtgtgccagcagaaacagtgctattagattttctctgtgcttagcaaaggatttagttagggcattcactttcaagcacccgttctatgcattacacactctcatactgtcttaaccaataactatttctataaggacattctggtgaaattagtgtgtccaataatttaaactaaaatggtgacatctaatattttctcctccaaggtaacgtcagcatttcagagcactttcactatctgaaaacggccaaaaactgatagaagagctttctgtttacaactttatacaccatagtaaagttctaggatgcaaagcttgcacagctttgtaacataagcattttatgccaaattaggtgaggataataagatattgtgacatttgcccaaagtcacggaacagtacaaaactcaagatttgaacaataatttttctgactacaagaatcattccatttctgctggctaaatcaacaatgaaatacaatagttttgcattgcgacttagaggtaccccatgtattccactaaaataatttgtattttgttagaaattaaaatataaccacatgaaatatgtctgtgggtgtctctctctccctctctctctctgtacatactgaatttctaggtgtaataaaatgcggtcagaaagagttcctgcggtaccacattatttttttctttttgcaacatgacactacactacttctaagggctaacaaattttaaaactttcaaaaaacatgatgagaaaattgatgaaagcctaccatatagaagcaagaaggaggtttgaagtgcctttcaaaacagattaccagtctgtcattttgacaccacgtaagatggccgtagaattatccatcatcgagagtttcttcatcaagaaccctaccctccatctgtatagagcttgcaaactaaagcactgccttgttcagagtcttttctattgccttaaccctgtcttcttgtgactgcctttctaaattccacatgaaagtccctttctcaaggtataattttatgtaaacttttgagctgactttaagatttgtgggcatattgtggaaatactcagacatacccagcacatttttccagatgttccaggtgttccagaggtcacagctccatcatggattacaaggcttttggtaaagaaagatggatcaaggttagagagtaaaaaaagaaaggcctactcctatttgtcacttcctgtgaaatgcagaggctcctacctaggaagacatttttcaggtgctgagaggactcttgggattttatttattgtgaaagtttcatttattttgaagtatcattctaaaaacaagattaatgctcaaaatggataatcaacattatctggtacaaaacacatggacttacatgttaaaggtgttgttctttccttatcatctctgggaacttggacaagtcaggtaacgatgtatatattttataagacaatatattgtatacattacatgtacatttgtgtgtgtgtttatgtgtgttctctgagaagcagacccaaaatggtacttgtcctatttcaccctgaaaacaactcccaggagacacatggcctcagcatgaacctggcagtggattcagaggggcagctggatccaccatgcaactattggtcagccgctctccataacaggatctcttgaaggagatctaagtaatgcttttccatgtgccatagtgtatgaaatagaagatctgcacataatttagaactatgagagaaggtagctctgtacattgcaaggactcctgaagatctcattcaatgccgtcattgaacaatggcacgagcagttattaatgaaaaccattggtcagagactttaaaacttcagggtacccaagagtacatttcagcgtttgctaaaatgctattaccaatctcaggaattaggatttaatgaataagtaatgaggatgaattttaacaagcaatcaggggcatcctgaactgggtggtctctataccacagtctgaaaagtactgaccttcctaagcgatgtagaacatacaaaactgtactcattatagtatattctacttaagtggattatgtatgtcaggttttcatactaaaaaaaaattactctggggaattaagagttattttcatttattcagaaaatcatatatagtctatgatattatacaactgaggcatcaacaaataggtaatttttatgaaagttcagaaaggcagtagggacttgtaggcatttggagggcttcattttcccatgtcaattggtatctctctgttacagtaggtgccattatctactttaattgtaatgaatcactgggggaattgtatttgtgaatgacaggtactttcttatgcaaatgaattgcccgcagtgagctagtttagttgatcaagctttccaggtcaagtagggcatttcccagatatgataaataaatatcttgggagctaaagaggaaatcattacagcatatcattctatctgaatttcaaaaagtatttttatatttaatttgttccccaaatactttccagattgactatatatactatttcttgaaatattcactacattactgaacactatcatttttgtgtcattcagcctcacagaaatgttacccaaatgggatgagtgctccagtgaaaatatgaaagccatatgaaaggcaggttcagtataaatgcaaattgctttatcagaaacattgtgaaatcctccaaaaggtactaatttaaagttagtagaacacttttaaagtggcttttaatgtcaatatccctgtaattgtcagtatcctgaaaatagtaattatgacagaattataatttaacaacagtagctttcttagtttgatatatttgagtgacctaattaaagtcattcttaattgttttaccgtttgatttctatgttacaaacttgaatgagagactgctttcttggtgcttagttaatctaggataatattaataatattaaaataatagaatagaacattagacttcagttttgtttctattaataatcaaagttattagtttgtggtttgtatttttgttttcataactgtgtgaatcatacatttattttccaaattatgtgcaacctgattgaggaccccttttaactttacagccaaagtacccagatggcattctgaagtatatcttacaaataacaaggtcaaataaggaggatgcacaggccatttgacagatataatttgttaaaactttatgtttttgtggaaaaccttataggaaataatttctaatgttctaatgtaagcttatgttagatactctgttagacattgtctaccaagcttccatggttttagaatcctgattttactctaactgtgggtacttacatatgaatctacagagaaaagtcctttctcctgtgtgaactagtagggaccaacgactttaaattctctctctaagacttgaggtcgccgttcaaagaactaactgctgtcaaagagcccacagtgtgttcattacttttttaagatacgacaactttgggaggctgaggcgggtggatcacgaggtcaaaagatcgagaccatcctggctaacacggtgaaaccccgtctctactaataatacaaaaaaattagccaggtgtggtggctggtgcctgtagtcccagctactcgggaggctgaggcaggagaatggcgtgaacccgggaggcagagcttgcagtgagccgaggtggtgccactgcactccagcctgggcgacagagcaagactccttctcaaaaaaaaaaaaaaaaaaaaaaaaaaaaaaaaaatatatatatatatatatatatatatatatatatatatatatacgacaagctactgatttaagggcaaggaggagacgggggaagtatatttacaatcttcaaaaattatcttgtggatactgaatacctaaaaagaaaagctcacagtgatctattccccccacccccgacctcccacctaggtagtttggtagtttctgctgagatcagaaattttttttttattctgagacagggtctccttctcttgcccaggctggagtgcagtggcactatcatggctcacaacagccacaacctccagggctcaagctagcaaagtgatactgttagcattcaaaacaaagaacaaattagtaatgggtgttttaatattaaactcatcttactgtggtcattatgaccattaactcttccgtacgaaagtattttgaagtgaatcatcagggactctgagtcagtggtcttgtcttgatgtctcacaacatgggtgcctctatttatttagacatctatcttcaccactcactttcaagtgaaagtgaaagagcaggtcatcaaatttcagtattctgttattttttgcagtcgggagccgtatggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgagacaggagaattgcttgaacccaggaggtggaggtggcagtgaactgagatcacaccactgcactccagcctgggtggcagagcaagactccatcacaaaaaaaaaaaaaaaaaaaaaaaaaaggaatctcaaggattgaaagactgacccattgcggtgttatcacgtccaaaaaaagtaggcatattcacatactgttttgagagaattaggaaaattttatgagaaagttatttggaaaacatacaaaattaaatgtatttttccactcattttcaaaatgtactttagcacaagaggcctggtgcatagtatatatgagaagtatttaaatgaagggatacattttgtatgatttttcttacaaattcattaaagtatttcaagtaatatagaataattatttaaccagtgttgcaatggctattaattttccttatggaaggaaaatagacaaagacgtattattgattttcttcttaatctttttaagtttttttaaataaattggaaaaatacaagtttatatgtagatttacttatatttgggggtttaaataaatgttctgcatcgctttgccgcttctcaacttgccccaaagcaaaacgaacacttccatggtgtctcttggaactcctctcctttcatctcccaaactgtcctatatctttgaagtcgtttctgaatatatgcctcatctccttcctttctgtgaaatctgacagtttgtcaaaaacacaaccctggtagccttttataggtgatgacaatgttttattccatttcccacatgttatagagccagtatataaagtaggtgctttacttgttcctcattgctacttcaaagtcatatctcaccttttctgcttcaaaaacccagaatgtttgaagctcaaagtcatcgggctgtacaaatccttcccccttttcattgttataacccactgacatttgtcattctctgccattcatttaaggctgtagattctggctcgctctttctcttcatctctacctctgcctctattctagtcaccttccaaatccacgtggccttaaaaccacaggctttcaatcccttgtcttacttgtctccaatatattttccttcaccctaactcagatgatcatttaaaggttgagaccatatgctttttcatcactcttatcagcatccccctaagatcaatcatgattccaaaagttccacactcattttttctgtctcctgatccatggttaaaacaacctcacatttgtcaattgtttttatctctttttaccctctatcatctcctcctattataataaacatagattaccagtccaaaattataatcactttcttgcaaacaaccttaactattttacctttgtctttttgaatcatgcttatctatcaaatctgggttttattcagtcatttgcttatttttatctaaaacataatctccccaaaggtacacttatattactgaaaaacactatttcagtttcctactctgcatgattattttatatcttctattgtctacataagtttaagttggctttatcaaaagcctttctgatctccatagccaaggaagttccatagctattgatttcaactcattggtactgggtgatcacagggaatctcagtgatcagagattaggtaataatatcttcccggtcaggaaagtttgaagccagttggctatctttctttctatatgacagttattcatacacgaaggtgtgaaattttcaactacctttcctggaatataattcatgggtatgtatcagtaacaatgtatgtctccttttatgaacatcatgggcaaagtatgaaaacaaaacaatcacctcttaaacgtgtcaatcagttaccatagccaagtgcactgtgacattatgattgtttcagagcggggagcatttgctgtgcatcattttatcctgaatgtttttcctaaccctgactcatggtagtcgtcctcaatatgtatttatttgaaatgtatgttttattttcctgttagatctcgtaaatatcagacttccgaggacataaatctgttaaagccttgtctcatgtttattgtttttgtgtatctcttaaggaaatgatattttgtttttatattttctgatccgaaaagagcaaaagcccctgcactcgagagagctgttacaatcaaatgagaaaatggaaaggcaaataaagaagatgtgattccctacagctgtgaacagtgatgtggaaaatatagtggcttttaggtaatatagggattcacatcctgtctctaccacttactgcttgtgtagcattgtaaaaacaacactaaatctctctcagataattaagacacggaatctgaaacacagtgggcacttgatacatgttatccctttttatactcctacctcttcgtaaggaaatatttctgagacagaataaagttcagaatcaaagtaacaagatgcttaagccattttgacagaaaatagcaaatatgtggaaaacataacaaaatatcaaacacttatataggttaagggggatgtgcccaagagctggaagaagagagattttctctataaatgattcagctaagaaattatagaatgataatatgaagctattcatctgtattcaaatttttatctaaatgcctaagattgacatgcaatatatgtttgctcttaaccatttgtaggaccttgataacatttaaaaataggtttacattcattcatttcactctccaccacattctctttttgaatctctctctctgtgcccccttctggaagcctcttttaattacttttacagagtggaaattgtatttgttaaaatatgccagccctcgatattcaaataaacatattccaattatggaaaaatgtgagatggaatatatttaataaaatgaggtctctaattattttttcactgaaatttgatcatgtcttttttttttttttttggtcttagtttttaaatgttttatttttattttatttttatcctgactgtctgcatcctacttgctcaggtaaaaaagtaagacactaaaacttgtttaaagataaactattaacaagtgttaacttaaggaaacttctagaatattttccatttggaagtctatttttcacggaaatagagccatgttgtttatgttaatttgtacccagaattttctgcttactgaaacgtgatagaaagttctatttcaatacacatatatctaactacatcattcattttcaaagaccttgtggtattccaggatataaatgtaccataatttatttagctaatattcttgaaactttttgagatgattcaaaatcaaatgaatttttagtcataacaattctctgaacatttatcacacacagcctagtgttttcaattgttttactcaaaagagaaagtcttgaaaaaatacatcagatggtaaaatgtcaatttgaagcagtgttttccacattaaaaatattgacatttttctctttgccaaatttaactggcaatttaaataacatttctgtattcatttgtcttttattgatagaagaatcaatagtattagtcagttgggttagagtgggaagagctggaggtctggaggcaggtcctgggcttagacgtggcctttgatgcttgatgttcaaatgctaaaggcattttccctgttttcattgggagagggtgagtgattactggagtttctatattctggcaccaactggccttcttatttcctgtgacacggagagcaaaatcatgaaaatgttatataccagaagcagagaattctctcctacctccaaaaagcagaagttagcaaacactgagctttgtgcgtaagtatgtgtgtatatatgtatgtaggtgtccctgaagataatttacatttttgttttatatgttttgaaactgttgaatttgaaacaattttagtttataagaaagttgcaaaattatttaatgaaatactataaacccttcacccagattctctttcactatgttttatgtacatacacatttacatacattaatatatagctattttttctgaaccaactgagaataagttgcccacattatgcccttttagctccaagtacttttattgtttatttatcaatggcattcacttaaaaatcataatacattgataaaaaagaaaattaatgtacgtaaaatgttatcaccaagactagaggtcatattcatattttgccaattgttctaatgtcctcaaggataaaaaaaaatcctggtccttagtctaatctagattcacacagtacttttatatggcatgtctgttttgtctttgtacatctagaatatttccataatctttctttgtggacttgatatttttaaggagtacgggacaattattttatagatgctgctccatttaggtttgcctgatattatcttgtgattaggtagaggttatgggtttttttttttgtttgttttgtttttttttgtttttttttgttttttttttttctttgatggagtcttactctgtcacccaggctggattgcagcagcatgatcttggctcgttgcaacctccgcctcccgggttcaagtgattctcctgcctcagcctcccatgtagctgggattataggcatgcgccaccaagctcagctaatttttgtattttttggtagagacggggtttcaccatgttggccaggctggtcttgaattcctgacctcaggcgatcagcccgcctcggcctcccaaagtgctgtagttacaaacatgagccactgtgcctggtaaaggttatgtatttttgacaataatactatcgaagtgatattgtgtttttcaatgtgcaacaaaccaggagccacataatgtctaggggttccattaatgatagtagttacttagatcatttgattagggatagtgtgattttgtcatttaaaagtatttataattttctgtatataaatatatcttatatacgttttttcctaatgtttggcatccactgagttttcttgactgaaaaaatttatgatttttttctatatggtggtttttctcttcatttttttctatgctaattaattactgtaacaaagcattttccattctttcccatttattcattcatgtgtttatttatttatttatgttactatagactcgtggattcttattttatcctatgtcttataacatattactattaagattcgttttgatgatccaattttctagatttggccagtgggatccagttcaagctggctcctgtgtctttcaaaaaaagtcatcattctaggaacattgtcttattttttgttactgtaagtttttccaggctcattttgaacatatcctgctccaattcaagaatgaagtatttatccagtgtatttccttttagtaaagaattatattaaggcatcaggagctggtcttaggtatgctcattgctactgtaatgacgtgtacatacattttcaaaatatatttaaagacactttccagtatctgtctctagctctttattataatccattaattcataggatattcccattctcatttaatattacagggtttaattttgccatcatcctttctgtgtttttatattcctactttaacattgagaaacctggattccattacccataatgtatttactatttcctcagccttataagagacgtaagtagtttgaaattgctaaattgtgccattgtgaaaagcaaaccgactcattacatttcaattaaaaatttactttaatcagagagtatatgtcaaagtacagatttcaagtactatttggtgtcttttttttttcttttcagcacatcttgactattaatttgaaacacggtttttctcccatgcttgtagattccagggatttgtttttatatgtgaaatatcaatatataattctaaaatttaaaatgatacaaaaatgtataataaaggaattgtcaccgcttctcaccttttcaatccatttttaaactcttattcttctttccaattctcaccctctccttacagataaccagactccttagtttatctttccagtgtttctttttctcacatatctgcaaatacattatattgtatctccttctctgttacagaaaccttagcatccctttgattccttttgcactttgcatttttcacttaatgttgtagtctggatatcactccaaattacctcttaaagattttctcattttttttttttttacaactgcgtaggactacattttatggaaataggcaagtgtactcaacctctctaatggataagcacttcaattgctttcaagttttagcgattacaaacaatgccttcatggataaccttgtttatatttttgaagttggatcattaaggaaaatgtcgagacattcatttccgagtcaaaggtaaatgcatacatagttttatttatattgtcaaattctcccttataaatgttggaccaatttacattcacaatagcagtgtttgagtgtgctagtttcccttgaactttgccattgaaatgtgttgtcatacttttaaatttttgttaacgtgaaaggtaagaaatatttcagtggctcacgcctgtaatcccagcactttgggaggccaaggctggtggatcacctgaggtcaggagttccagacaagcctggccaacatggtgaaacccagtctgtacaaaaaatacaaaaaaattagccaggcatagtggcgcaagcctgtaatcccagctacttgggaggctgaggcaggacagccacttgaaccctggaggcagaggttgcagtgagccgagattgcaccactgcactccagcctgggtgacaagagagagactccgtctcaaaaaaaagaaaaaaaaaaaaaaagactgggagcagtggctctcgcctgtaatcccagcactgtgggagactgaggcgggcagatcacgaggtcaagagattgagaccaccctggccaatgtggtgaaaccccatgtctaggaaaaatacaaaagttagccaggggttttggtgtgcacctgtagtctcagctactcaggaggctgaggcaggagaatcgcttgaatccgggaggcagagcttgcagtgagccaagattgcgccactgcactccagcctggcgacagagcgagactccgtctaaaaaaaataaagaaagaaataatatctcagtatattttaatttgtatttttataattgcgatgaggttgatctttttttttttgtatttttaaagttcattttttgtctatttttgggggtgattttgtcttttgctcatttttctatcgcgtacttggtcgttattctaaatcccatcactctcaatttttttttctttcatgtttctgctcattcccatggagttaatctgggtatgttctccacttatgcttcgcccaggctaagctgtcagtcagtgcagctcattctgctacccttctgctagccctgtttccttgtcacctaaaatacactttttaagtttttaataatgttgagtcagcattaacagaataaattggccacattgggccaattagtgagaagtctcatttctatttttgtggcattttaatcctttcttattctgtgtttctgtttccttggtgtcaatattcttatatggatatgtgatagtcttccttagtgtctttctactgtccatgccataacaaagttcctttctttgctaaatgtgagatgtgtacaagtaatatcttacatggatactttgcaacaattgcatgctatatgtattttcaccaccccttagttcacagatgaaaaaccacgttacagagagataaataactgaattcatacagcaagtaattgatacaaccaaattttcaaaccaggcaacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagttcatatattaagtaattacaattctgtggtgtcattggtcttgaaaattaatttatatttaatttgttatatcagatattaattatacttggtagaaggacaagaattaatacagaattcattaataaaagagtgtgctggtttattttaaactatccttagattgtatctacgcaatcaagggatatttttggtctatttgatgcgagaattatatgatccaaactgaaatgatcactggggaagtacattttcacctgataacctttatttaactgacacaattatatcaggcatgaactagtacaagtatgcattcacagccacagccatgtgcatactgcataacatctgccagactggaggcaccatgagtcactggagtaaaccaggagcttagctgacattgtcacatggtcattatcctttattattgttaagaattaattttattacaaatgtgaactaaaactaatttgaaataaaacactaataaaatgctaattaaataaaacacatgccagtactagttattaaaattagataaaaataatcagaaaacaaatttttatatcatcaagtattgtttaaatcaagtttactgtgattgaaattaccttacggttatctgtgtgacacagagatgaaggctgatcgtcaaagaaaattctaggaaacatactttttctgacgttgaaaagttgctttctgaggagtctttattcctgcagagaaatcaacacaaccgggaaactcttgtctctcatgcctgctgtttgcttattttacacaagtgacattcatcatggcttagttgatggaaactgagcaatgcttgaagttttaagactacatctgcagagcccaaataagcagaaagccttaaaataatctcatgaactcaatatagtcaggatagaataagccaggaaaatcccaaatccccatttaacttaatcaccctaacagttttaatggcacacttgtaagaaagtaattctttactggtgcccaacaccttctgtatacttcattaagggtaaaatatatggttgagtctttcacatagtccacacttcagatcgcccagaatctcattctgtgctcacatgttttgtgtgaagtttggaatcagtagggttttcctttgaaagaactcactcctccacctgccatctcgctctgtcatcttcaggtgaatgccaaatattggttctgagttaatgctgtgtggtgttgttattctaacatcccaacaggaaagtgccaattaaagggaaaaagtgttgaaaataaagttattttgttaaaagaacatacgtaggaatgcttctctcttaaatatagttatggatcaaaatacagaaattaagtgtttgcataatggaagactagacaatttgaatgaacaaataatgtaactataaatataataataataacacagaattgttattcagtatacttgtattttacatactgccttgtagggttatttccagtgattaacgtatttcacctggcatttgttagcacacaactgactgccaccaccacaggacggagaggggagtcggtgggcattaaccacagtgtaaatcaggttgtggaaatgcagaggcagtcacttgccttggcactcacacatctaatgtctgaagaagccaggacgagttcctatgttgtacattctcagtctagtttttcttactggactcgataaggaagcagaataattagatctatggagatattaagtatgagtcaacacaatgcaaaaactatcaaagtagccaatcactctttgtctttgattgttgccaacatcttttttctccaactcttattttggattcagggagtacctgtgcaggtttgttacctgggtatattgcatgatgctgaggtttggggtaagaatggtcctgtcacccaggtactgaacatagtacctagtagttagtttttcaaaccttacctccctccctcccccatatagtagtcaccagtttctattgttgccatttttaaaatccctgagaatccaatgtttagctccctcttataaatgagaacatgtagtatttggttttctgatcctgcgttaattcacttagggtaattgttgccaacatctttaatcagagatgcaatgtgtagaaatatgttagcaatggaagcatattgaaaatggacattgatactgtgtcattttgttctctcttaatgacaaggacctatctaagagagttaagttctcctttgttccaaaacaacttgtagagttgttgttcctttttttttttttctgattttagaaaaaaatatgtgccattatggaaaacatgaaagtggagaaaaatattaaaagaacaaaaatcacccatagtctcaaaaccccaagtccattccctgaagcatttttattatactttcctccaatatcttgtgtgtgtgtgtgtgtgtgtgttttatgaagtaaaattatgcagtcctgaagggaatataaagcaaaccatttcacttttccaaactaaattattacggaccatttttctattgaacaattacatcactcaatttaaatacaaagtattttacccagctattgtctgaacaaatcaaagctgtctaattacagtattgtatattgtacttttttaaaagcttgatatattcaaagatcaaaagcatgtaacaccacacctgggttgccatagagatgtctacattttatcaagattaaaaaaaacttaacaataaatgcatttttataggtatgctaaagacttaccataacttaaacacccacaaacattttttttttttgcatcaatattctgggaaaaatacaggtgcaagatattatgtgccttttaaatagcttcattttctaaacttacgtctttttttcttctgatgcatcctttccactcacctattttttagtttagaattgtcagtgaaaaagttatgtttttcaaactctggaaatatggcctgccaaactgatagtgtgaagtatggagaaaaataatgtgtatacacacattgcacaacatgtacatgtacatacatgtatatatgcacatatgtaaacacagatatgctatatgtgtatgttatatgcatacaaatgtgttttttatatctgtttctactctatgtatatacttacaaacagagcacaagcatgagattcttaaaatgtacataggacagaataaaggtcatctgatctagataagagtcatcatacatattcatagctctgaaattatctgagagtttggggaggatatttctctagggacctttaaccttaatgtcagggtgttgatttgacaagcatctctaaagaatccatcactttattagaaaaagcaaagtgtaacattattatttttttaacaacccaaactttaaaaacctttggagtaactcttatgagaaatacctgacttttgtaagccatgactacagaatttcatgttggcagtggcagaaaagagagtgcagatggagaggagcctagctttccatctgtcatagcagcatgcagaagatacactgcttattgcttcagctgtttctaaatgctgagatagagtcttgaaaaggaacaaactccaaactcatggttctttaagcagaatttgtcagctggattcaaaagaagcaaaaatgttagcatgatgaaataatatgcaggtagagcctgagaaaacctattaatatcaagtaggaaatagaacagtcagagcatggtatagtcatgttattgaacagagatgtaaaggggagaactataaattcttactgctgaagtactagccctgcaggacatacagactgcatgaagcccaggcttcctgggattttttttttttttttttttttttgagaaggagtcttgctctgtcgcccaggctggagtgcagttgtaggatcttggctcactgcaagttccgcctcccgggttcacgccattctcctgcctcagcctcccgagtagctgggactacaggcgcccgccaccacgcccggctaattttttgtatttttagtagaggcggggtttcaccgtgttagccaggttggtctcgatctcctgacctcgtgatccgcccacctcggcctcccaaagttctgggattacaggcgtgagccactgcgcccggccttttttttttttttttttttttttgagacagagtctcactctgtcacccaggctggagtgcagtagcgcaatcttggctcactgcaacctccgcctcctgggtttaagcaattagaggtgtgtgccaccatgcccagctgatctttgtacttttagtagagacggggtttggccgtgttggcaggctgttcttgaactcctgtcctcaactgatctgcccgccttgacctctcaaaatgctggaatgacaggtgtgagtcatcacgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccccatctccaccctagaccctgtctttccacctcattttcaggattaattagccctcttcctccttaatagtaccctctcagtatagtcatatctcttccctgaactaccatgaaatcttggaaactgtttttctcctaccagtcttgtttctttatcattccccacatttaattctgagtaattaatgagacataagaggactttttgtttttctgattaaaggtctatcccaagtttctcatcatcttgtagtaagttctccatggcttggttctctctacttcagctttagctcctgcaacacttcctgcctctgattcagttgctttccccatgtttaaattcttgtgcacctccctcttgttcttcaacacttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagaataaacagacacagctcagagatgcctagaaagaaagctctgtagaataagtgggactcctgcatggtttccctgagaactggttttgctaagatcatcttttgcccttcagttttattgtacagcaccttcaacattaccttcctgtgattgaccatacatttagaagaatccttcagttgccctgctttaagaacacaatcagttattttagaaaggtaagattgataccaacatgaaaggctgagcagctgtaccgagtgcagagaaataagagtcacctcaggcatcaaactgttcatagtcagatttagaggaaatcaataaataaacttgctcatactttactatatttagttttgattcattggataaaatatatctttaaatatcatcataagaaagtgagtgtttggtaccattttagagtttgaatttgaaaaggatttcaagtgtgaggagtcgttctcctctggagatatttcacaggcaccatcattagtgtcaagtggagcagcctaggggggcccctttacatttattgtctttgttcctaaaagatcaaacgtagtttttccttgtacgtacagaagctaggagcttgccactttctcaggaggtgctagctctggctgaattcaatttgtgttcagaactgcccgaagcagaatttcatacatcaccagctcaggatctcacccttgcaattatccatgttgaaagactgtggcaggcagaataatgatcccccaaaatgtccacaacccccagaacttgtgagtctgccaccttttatggcaaaggggaattgaggctggaagtcagttgagagagcatactggattatccaggtgggcctaatgtaatcatatggacccttaaaggcataagaggaagaagaaaagccattctaagagatgtaataaagctagaggaagtgacgcatgagctcaagaacgtgagcaccctctagaagctgggaaataccttcagtcacagtcagcaacaaaacatagacctcagccctacaactacctgcaaagaactgaattttaccagtaatctgaataaacaaggagatggatttttccttagagcccctagaaggcctcctcactgtcatctttattttattcttctgaaactcatgttggacttgtgacctatgaaactgtaagataatacatttgtattgtttgaagctactgactttgtggtgatttgttactgcagcatggaaaagcaatacaatgagctatcaaaaacattgatcaccttatccttgatagggccaggaatgccttaaagaatatcacaatctaattgccaagaaaagataaaaataaatggaaatttcaacaatgataaaggaacaagacagtattttgagacggtaattggttgaatggtgtatagcagtgcatgataaattggcaaataaattctgctaagttttcagcaaagtcttaatgaaaagtcagaaataaatgagtctcaggttcctaatctcaagaatattttagacgctaagcacagagttgctagatagtcttatgaaaattgcttcatttaagagaaaatggcatatcattaagttgaatatttcatgatattgaaatgtagggactccagttgaatttgtcaggaaaatgggaagaaggagactgcatgagaaccaaacttaaatgtacagattggaggatttgaaaacggttgagatggagaggctttccagaagagaacaaattgatgagcatttcagagttgacaatgtctacattacctcctgagacatcaaggtcaatgcacatgtgccgaaagccactcacaaaattgaagtccatcctccaactccaggcccacacttactcacaagcataacttcctcacctcaacagtgggcagtacataatttctgaaaatgagacaatacagagtaatctctcatgcatctttctttgatgtaacagagaccagcctgagttgtaataaatttagggaaagcattcactattattttggtttctaactcttctcaatctgggacaaaatgaatgccactgaaaggcaagaaaaatactcagataatctctcttttccagccaaatatgggagtattgaaggaacaaggagatgacagataaagatgcttttagagcagctcctaatgctctctctctctgttcctaaatgaatatggccaaggctgaggaggtttctacttatgagaaattgtccctgaaagtactccagctgctcactgactcccaggcctaaggatagtcagtctagaggaagatgctgcgtctaatatctcttcctgcctagggttccgtagagtctagtttctgtggaaagccatgtatggcgataaaatgagtgtgatcctcttagcaagaaggcatgggtggaatttctgccttccgtgtttgctaataaggggacttcatgccaattacctaacctctctgggttttagttttttcatttgtcgatggcactgatgatattaatggagcctctctcagagtaagcacttatggatttttgtatgatttttaatgcgatgagataaatcttcagtaaaatttgaagtattataaaatgttagtattcttgtagttattattgcattaattttctagggcttctataataaagtactgtcgattgggtggcttaaacagcaaaagcttatttcctgtggttctggaagctggaagtttaaggtcaaggtgcccacagggttggtgtcttttcaaggtgcccacaggattggtgtcttttgaggcctttctctcgggcttgtagatggccattttctccttatatgctcacatggtgttccctttttgcaggtatgtgtccaatatttctcatatgagaactccagtcacattagattagggctcaccctaatgatttcattttaacttacttttctctttaaagaccctgtatctaaatgcagtcacattctgaaaaactggctgttaggacttcagcatacataattctagggggacacaattcagctcataacattattacaattattaattccagttcagtggttaaaataatatttttgcattatgacagtcataactttatctattaaaaaactgaatacctatttcacgttcctttgaggctttataatcacaaagtcaccacttctcagaaacaaaagcaagctggcagccttgctccactgtctctcctttgctcaaatggccactgaaaccagtgccttggcctctgtgggctttatcacctttgacatgaaatactctcttcacagtataatctcattttttgtgcaccataagggaatccatttgaaatgtagaagttgactccaatgacaaaatacatatgaaaaatagtaactttctgtagtaactctaaatttccttctgggaaaacacacaaacgtacacgtgtacacatacacacacacaaccccccacccctccaactgctaaaattttcatgcctaattgatattttccagaaaaccatttaagctgctttcttctattatggcttctctcctaccaggcacagaaactgtactgaatattagggataagtttcagtagccccatttgcattcagtcctcagacaagcgaagacatggacagtgagtaacatttatcctggggaaactgatcaagaaagagaagccacctggataaaacaagtcaaggaaatttgcatactcagaaccatgatttgagatgctaatcattacagaagcatgttttattggtccatttaatttgatttggagagaaatctccctaaaggatttggggattttgcagacctaaggcactgacatacagagtaaagttggattttactatattacttgtccctatggaatcagttcatcaaggctgctaataactaaagcagtggctttcaaacttgaatggctttaagaattatctggagagcttgttaaaatgccacaggctcaaggaattctaactcattcagtcctgagtgggatctggaaacctacacaatatcaagcccgcttcctcaccccaagtgattttaatttttctaaccaacactcacatagtgtttattatatgtcagacactgttataagcattttataaatgttaacttatttcaagtcacacaatttttacattttttttcccattttttacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagcaaataaaaataataaatgaaaaagttggttagagtgtaatatatccacttgtcacaatcattttagcagctttagaaatgctattactgaaattatttatctggaatcagttatttcatcatatcatttaatttccaattgatcattataatcaacattattatcataactgtttttattgagcacttgttatgggcaaaaggctttttgcattatcttattaatccacccaatattataatattataataatcctctctgtctctgtgacagtaattcttcctatcttcctcttcacatgtgctcctgcaggcacgctggcttccctgtggatctatgaacattccaggcacatttcggtctcatggcctttgcatctgctgttctatctactggaatattattaatcatgatattaataaatgaattcttgcattttcttcaatgattcactcaaatatcaacactttagtgaatccttccttttccatatcatttaaaatttcaacacttccctaatattttctttcccccttcattgttgcctcattcccatcttacatatgtcaattacattttttttcccttaaacattagtttcaagaggccaagatatttttctattgggtgtattcctgtttagcaacccagagaagtgtgtcagccatactgaggcctcctttaaatatttgttgaataaacacccattgttaaggtacggaaaatgaggcctagagaggttagatcacttagccaaagacaagtttcgggaaagtgtcaaagcaaatatggtatcaggaaattgcctgtagggcctaaattctccgtacgtctagtcagctgggagaaacctgaggaacataattgagtttcgtcttttagagttttacattctagagcttctatgctcttggtggagaagctgatgcacacacttaatggctctgatttttgttgtcacttgtgcccagcttaactatggaaaagaatttgatttcataagaataagtgctcttagtagtagtactagagacacacctcccatttgcaaatatacttgctattttcctagtatttttacatacattgtttcattttacttcataatgggacagtaaatccaggttcattatcacctttgtgtggatgaggaattggaagcccttttgggttagtgattttctcgaggtcatacagcaaaaatgtggttgtatcagaactagggccaaggttcccaatctctgacctgatttttcaccaacaattttcttgctcagccgctcatgctactatactctgttatacaaaataactcttctaaataaataaaccaatgctggccctataaaattataggtatggtaagaacagtagtctcagtggtatctgcaaattcctgtattacttcattaattttactcagcagtaccaaagggttttaggaagttgagcaagaagaccccctggtcatttggggacagacatttaacaataaattgagcctgaatcttatagtccccaaacctgacttcctgagtgaccaagcagagatggaatttaaggaacaagcatcttccctgtaagtcccatcattgtgttcaccacaaattacaaatacttatatatgaaatatgcatctagaggcgttaccagtggcaactccatatgggtctgggtctgtagcaactctattcttgccttctttgaggaaagaatttggctgagggacagaaggcagagtgagagactgaggcaagttttagagcaggagtgtaagtttattaaaaagttttagagcaggagcaaaaggaagtaaataaagtacacttggaagaggggcaagcgggtgccttgcgagatccaagtgccccatctgacccttgacttgggtctttaatatattggtatgttccaaggtttgggtttcttctcccctgatttttccttgtggcaggctgtccgcacgcacagtggcctgccagcgtgtcggaggtgctgcatgctcagtgtgtttactgaagttgtgcccatgatcacttggcatttttcccttaccagtcgagtgctgcaagaagaaggtcataaaccagttaaactctgccattttgcctgttactgcacatgcttgagctccacttacccagctcctgcgatctcatcaggaagctgctcatcaccagcttcaggtgtttcccatctattgggagactgcctttccctggcaccagctgcaaccaattattattttagagcaagtttgacatctgcccaaccgtctgctaatggtcacctgacatttctgggagtgatgctctcttgccctgctcatgtatgcctagatacctactctaacagaggtattcagttccgtaaaataatagatttgttgtcattgtcagtagccatcagttatgttttatatttccaagcagtttttaacttcatcacatctcttaagagcaacagccgtatgtaacttttattattaataacccagtgatgttagtataagtaataatctccttaattaccacattccaaaaaaatgtctcggggttgttaatggcttatctaacatctcacagttaatatcacttattctcttgaatgcaagtctgtgcttttgtcaccacattgcagtggggcaggagaaatatctggcatctactaggaacttagttgacatcagctttctctttctaattctctcttccctataattaaattatcttatcatcttgcaactttgtgagatgattgcgtattttaatctccgttttgatgaataagaaagcctttgtaatggatctcaagaagaggaatttaaatccaacaaacaaagagaaaatagtgcactgaatatttgcattgggttttatatgttccaggtcacatttcaaagttgcctttctgttagacttcatagttgtcagggctactaggaaacaagttccttgacggctcttttagaattatttgcactcagaattctttggttctattccagttatttactgttgcacaacaaatctatgtctaaggttagtagcataaaaccacaggattgcattctatatcatagttttcttgggttagaaatttgaataaggagattattgtcttccactggatattaacggagattgcttgatagtgttcagttgcaaacgtgctggtctggaaagcccaagaaggcctcttggtgccttggaaaggataggaccctcgagtagatggtgcctggatgagatggctgggagcctgggttcaccggggactgttgaccaaatgacacatgtggcctttgtgatatgatgatttcaaagtggttggatttcttacatggtatctcagggctcccatagagcgttttccaagagacaggaaacaggtagtgtagcaaaattagtaacaccacttccactatattctactgatcaaatagtcacatgcctgttcagattcagaggaaagaaggaaagaggtatagacacaacctctcagggagaaaaacatcaccaaatttgtggccatctttaatattcacatttcatgtagttctactctatgaggataagcatgctggtatctgatctggtcacagtctgaactgtacagcaaaggatgagggtagtgaaatgtggagtgatgagcattagaagatgctttttgcctctgaggaggatttccctaggcaaaaagtggaaagtagttaaaattgatctttgctgttctgtttgctattaatcttgaggtgaaggttctggcaaacatgttgaataactgaattctgctctagcaaacaacgcccgccatccccatatctactaagtttcctaagaccatgtttcccaaactgctgcaattctgtatcatgttgaccatttttaccatatcagggtccttcttgaagtattgtttaacttctttttctaacttaatttactccattttatttaagttttaagatacatttttcatcactcttataaatggaaagccattatcacttgtcataagtagagatacttctgaaaataaaaccattatctacagcagaggtgagcaaacgtagtggtcattggctaaatccagactttggcttgtttttgcacaatctgcaagcaataaaataaagaagggagggatggattatggacaagaaggagagaaacacagagggagaaaggaaagaggaggaaaggaagttgggaagaagggaaaaatggaggaagaaagaaagaagaatgtagcaaagaccatacatggcctgcgaaagctaaaatatttactgtctgtctcttcacagaaaaagtttgatgaccctttctctagagctatgcttttcttcttgcttgtccttccaatgcaatattatgtgcttgtgtttgctgcctgcttagaaagctgcatttgatgctgtgtggtgaccaacaaatcaatcatgcctcctttccatggtctagagttgttgctgagcagcagctgtccaggcgagggattacaattctgagccatggcatctagtggagccatgagaatggttcttactaatggtacataaacaaaagtgatgggtgtcattttgggttccaggtggttaaatactggttgcatgatccttcacaatctctgtcctctcatgcctttgtctgccagttgaaagatgctttgtttaaggaaataagatattttgcaatttacactatgggatctgatgaacagttgtcagccttaaaaacacatacccattaatttttattgtgtcccattggccataattataccaaaaatacatatgctggcgaagttatagtagcaataaccttattacagggtaactattatgtgggcctgtatgtgacagaaattggtagttaagaaataatactgattttcaggctatgagggcaaaatattgcttgtcaaattcattcagggatattttctgagtcccaaaagtagatgtgagctaagaagtaaattaatcagtttaggatttctattaactgaaattccaaaggtcttaatattaacaaattacaatgattaactcagacataatttcagttgcaggcatgggtaatccagataatggcatgttgaagacatataatagaataaaacccatgcagtactaaaaaataaataaatacataaaagtaggttttatttagtcaatttatcaaggttactatttgttgttgctaattgcagtacttttcatgtgcaaaacactgcagtttcttaaatgtgatgtcaattagcctcacattgaataaaaaaggtaaataagttttatcaagttttcttcctcctctttcccttccttcctttcttttttcctttttcctcaaagaaacaaagataccatacagtcaagtagcttgtccacagttatgtgagcttttctataatccattggtatcttccctaccatttccattttctcctcaagcagtaagccctttaattcatttttagtttatatttctagtttagtgattttttttaacataagcaaatacatatgtggacatctatctatctatccacgtcgccacttcctcacacaaaaggcagcaccctatacatagttctacactggtttttttgcttattttctatttaacgtatatcctggaaattgccatagcaatgtataaagatacctttaagctttcttacaatcacataataatccaatgtgaggatataatatagtttatgtaacttgtcctttttgatatgtatttggaggtgtttctagtcatttgttcttaaaaataatatcaaaggccaggtgtggtggctcacgcctgtaatcccagcactttgggaggccgaggcaggtggatcacctgaggtcaggagttcaagaccagcctgatcaacatggcgaaaccccgtctctactaaaaaaaatacaaaaattagtggagtatggtattgcatgcctgtaatcccaactactaggaggggctgaggcaggagaattgtttgaactcaggaggtggaggttgcaatgagctgagatcgtgccattgcactccagcctgggcaacagagcgagactctatctcgataataataatgataatatcaaaaaactgagaaaatatgacagcaaatgttcttagaaaaacttagaatgtatgataaaataccattgtcatacattctctcatatttggctacatactttggaaaagattctgagatgtaggattactgggtcaaaaagcaaatgcatgtacaattttgttgaaaaaatgccttattacactctctatgatgtttcttctgtatttcattcccaacagtaatggaagaaaatgcctgttttcccacaggctcaccttctttcccaagacaggattttggctgttttcttctgggaataaaatacttctcagtgtgatgctttttgttttgtttttgtttttgttttttttccattttacttgtttgccaatcctattatttatgcaaaaactacacaactttttttaagtttatattcccactaatcatagtagcattatattcttacttgagttttcattgcactgttctcataaggaacttgagtatcttttcatatgtttaaaacttttttcattttttattttaaaatttttgactgacaaattaaaactgcatgtattctaagtatatatgtgatgatttgatatacatatgtaatgtgcagtgattagcacaatcaaattcacacattcactagcagccatgctgcacattagacctccaggacttgttttataactgaaagtttataacctttgaccaacattgtccttttttcttttcttttttttctctttctttttttttttttttttttttcttttgagacggattctcactaagtcgctcaggctggagtccagtggcacgatcttggctcactgcaagctccgcctcccgggttcacgccattctcctgcctcagcttcccgagtagctgggacaacaggctcccgcgaccacgcccagctaatttttttgtatgtttagtagagactgggtttcaccacgttagccagggtggtctcgatctcctgacctcatgatccgcccgcctcggcctcccaaagtgaacattgtcctttttcctactccttagcctctggtaaacaccattctactctctgcttctatgaatttgaacttttaagattccacatgtaagtgagattatacagtatttgtctttttgtgtcaggcttatttcatttaacgtaatatcctccagttcatcaatgttgtcaaaataaaatcggtatcttgaagatacacttcgtgcacccccatgttctttgcaatctcatatttattgcagcattgttaataatagccaagatatagaaacaagattagtgtccactgatggatgaatagctaaacaaaatgtagtctatgtatatacaatggaaaattattcagccatagaaaagaatgaaatcctgccacttgtgacatatttgaagacattttaatgtctttccataaagtgtttgatcacatgttgtgtccatttttctttcagcttgctagttttattcttcaacattctttgaagctttaaatattaggcatactaagtttttatcagtgatagaatttacagtatctgagatataatttacaattaatctaagatccaagtaacaattattacaattattactctaagatccaaaacacaaatatttattgtagttggtcatattttgcttaggtatttttggcatgtaaactattatactttttaaaaacttatgtaaaaaatctattgaccttttccataatgcttttggaaaaggaatatatcatctctaggtaggtgtataaagaaaataaactgttctctttaatacttgaataatttctgcttatttgcatctcttacccattgggtatttgttgtggtatctgtgtgtaagaaatatttacaggctttttaaaacttttatgtttggtgatctagttcctcatatgccatgtatttaaaagttaatcttttcattaatgacttggaaaagcatattttcatttattcatatagcatatctttccttttagtgtttctctcagtttcaaaaatcattcagtctattcattaaccaatatttatttaataaaatttgtaatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatggaatcatgtgttgcacacacaggaaacaaagggtgtttttaaatgtcagtcccacatcaaaagatgcaaaggcaaatgcttttagtagcagaatttgatttgtaattgagctttttctcccaaacacaattctttttgtttggggtggggaatgaatttcagcaactccatatatgtttgttgaacaaatgaatgaattaaagaatgaactccatgaactaaaggcaggaatttccatgctcaagtttgtaaaatattcttctatacaattatagttagggcaaataacaatacaaaaatatattcaggtatgcctagaccataagaatggctcagactggattgtactggaaaaatgtatggatctgattattgaataaaataaattattacttgtaaaacgaaaaattggaaaagagccttagcagttgaatataaaatattaaagagtattaaaaatgacataggcattcattcacttgaccagtgttcgttttatgcctactacatagctagcaaaaatctatgatgaattactaaagtgaacagtgtttgtacacttaagataaagcatttagtaaccacgaaactcctgcttgaagtccttaaaaccatgaaatgtcaaaccaaacccagattctcagttgacagattgttgtattaatccattcaccaaaatgcaaatattaatagagaatgcatttttattttatcaatacatgctttaatgttgtctgaaatgtttggggaataaagaagagaagtaatggctttaaaagagttaagttcatgtttacccaggtggacaatcacagtctaaatgctgattaaaattttaggtcaacttggagggaaagaacctgagatcactcacagaattctgctcaagtgccttcctactttccgtcaataacgtcaattgatgtagagaggattttttacaaatataacttatgaacaatttaaatctggaagagcaagcaattatggtgaattctagaatcaatgctcagaatcaaaaggctgaaatgacacatcaaagctagcaaaatgaaatcaactggaatctaacaggttgacattccatgttttaaaaacataattataaaggtaattgtgcaagaagtcatggaataccaaagctcagaaacaaaagtttaaacaaaactttaacttgagttgacattaaaatttaaagtataagtaatatcctaagactggcattcataattgtgcagatattttccagtattacaatggatagtttctgccaaataactcatctaacagacagtcatgcatatcggtatctatactttcagatacacattttttcagcaaaccaggtactgtaaagtataaggccctataatgttcttttcattatctaaccctctaacactttgaagcacattaattctttttatctccctgctttttgtttccctctcattctgacttacattggttagccaaaggagcagcagagtattgcagtctgagattaaagtgaacctgctttccttttcttttttttttttcccccatatggtatttgttttctttattattattattattattattattattattatactttaagttctagggtacatgtgcacaacgtgcaggttagttacatatgtatacatgtgccatgttggtgtgccgcacctgttacctcgtcatttacattaggtatatctcctaatgctatccctcccccttacccccacctcacgacaggctccagtgtttgatgttccccaccctgtgtccaagtgttctcattgttcaagtcccacctatgagtgagaacatgcggtgtttggttttctgtccttgcgatagtttgctgagaatgatggtttccagcttcatccatgtccctacaaaggacatgaactcatccttttttatagctgcgtagtattccatggtgtatatgtgccacattttcttaatccagtctatcattgatggacatttgggttggttccaagtctttgctattgcaaatagtgccacaataaacatacgtgtgaatgtgtctttatagcagcatgatttacagtcctttgggtatatacccagtaatgggatggttgggtcaaatggtatttctagttctagatccttgaggaatcgccacactgtcttccgcaatggttgaattagtttaaagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagtattgtttcatgtgtctgttggctgcataaatgtcttcttttgagaattgtctgttcatatcctttgcccacttcttgatggggttgattttttcttgtttaagttctttgtagattctggatattagccctttgtcagatgggtggattgtaaaaattttctcccattctgtaggttgcctgttcactctgatggtagtttcttttgctgtgcaaaagctctttagtttaattagatcccatttgtcaattctggcttttgttgtcattgcttttggtgttttagtcatgaagtccttgcctatgcctatgtcctgaatggtactgcctaggttttcttctagagtttttatggttttaggtctaacatataagtgtttaatccatcttgaattaatttttgtaaggtgtaagggagggatccagtttcagctgtctacatatggctagccagttttcccagcaccatttattaaatagggaattctttcctcatttcttgtttttgtcaggtttttcaaagatcagatggttgtagatgtgtggtattatttctgcagactctgttctgttgcattggtctatatctctgttttggtaccagtaccgtgctgttttggttactgtagccttgtagtatagtttgaagtcaggtagtgtgatgcctccagctttgttcttttggcttaggattgtcttggcaatgtggactcttttttggttccatatgaactttaaagtagttttttccaattctgtgaagaaagtcattggtagcttgatggggatggcattgaatctataaattatcttgggcagtatggccattttcacgatattaattcttcctatccatgagcatagaacattcttccatttgtttgtgttctgttttattttgttgagcagtggtttgtagttctccttgaagaggtccttcacatcccttgtaagttggattcctatcctatcctattttattctctttgaagcaattgtgaatgggagttcactcatgatttggctctctgtttgtctgttattgctttccttttcattcctgacaggcaaggtgagcgccctgaacaacacagctcccctgatcttttccccctacctactaaagggggttgtcctcctaaaggggcactgaaaaatcactgacatgaggcagattgattgataggagaaaagatgtacaaatttatttaatgtgtacacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgctaaaaaaaaacaaaaaaaacaaaaaaaaaaacaaaaattagctgggcgtggtggcttgtgcctgtagtcccagctactagcgaggctgaggccagagaatcgcttgaacccaggaggcagaggttgcagtgagtcgagattgtgccactgcactccagcctggtgacagagtgacactcggtctcaaaaacaaaaaaagaaagaaagaaaaaagaaagaaaggaaaaaaactgaaaagtcctgggtatattaatggaaattctctacagaggcaaaatttttccccaaaaaagatacctttgcaaggccacttctgtttgctggcactgcagcaggcattttataatatgtgaaataaatatatttttggataaaatatatttatgtcttttggtacctactttgaaacttaaaacaatttttacacattaaaagccaagctgattgctttggtagaatttgtgttaagggtcgttagttagagatagccaaaaaagtagaaagataaattggtatatacagaaaagaacaaatttaaacatattgtttaaatcttctttagtctgttagtcatgaaaatatatcagttcagttaaacaattgtgtctcattccaagaggtggcattgcagatgggctttgcctttacgtgtgatgcaggcaaccagctctctaataaagcatttctatggaaacagaaggaaaacaaaggttgatgcatggcacggtgcctctatagactagcttttctagagtttctagggcatcctcagattgcaagggcaacctgacagattcttctggattgtaatttggaccaagagttcaagtgaactttctgagaaatccacacatcagcagggaggcatgaaggttgttcatatataagttgctattatttttttactgacgtttaagttgtctagcttcaatttgcagggctttaagaaaagcacagttttaatttctaataattccaagccagaaaaatggaagaaaaaatgggaaataaaaaaatgttagtttggagacttgtaacaagtaaagaattcagaattcagactaaaatgtagagaaaaaatgaaaactcaaaactaatggacaaggctagaatctaataataggtatatgactgtctcttttgaaacataatttttctctctctattcccccattttttaccaaagacaaatcatagcaggaccaatttatttgcaacacaagttttagtcttattatacttggcttgattaattgcttaaagttcaacaggaatcattgttcatataggcttttagacgttggctttgctggaacttttttcataaggaatctcagattggacttttaaaaacctttcaagcccagccaataacttacctctgcctgcagatacctattatgaagtgggtaaattcctctcttcttgaagtcctcaaaaaacttgagattcttaggcctgtcagaaagtggcattctttacttaccataggtcaggaaccctgcaaagtaaccatgtagacaagagaccagtcattccaaggggctattattggctctataaaatcaatcttaattcctcaaagcattctggtcatatctaaaggtatgcccttccagctgaagccatgctaaattaaccactatctctatttatgtcctgttaaaaatgaaacagattcttactcaacttacacaaataactatattgccatgaattaagaatacttacaaataatttccaaattctggagaaatcagacagaaagaaatatgcttctaagtttgtttacaagagtatatttactcagttgttaaaagctataaatagctcaaaagaaaaaagttttcttgactctgaaaaacaaaacataaagaatcagcaatgttttaaacaaaaaaagtcataaaaaattatttcagtatctaatagtccagtcccatgcaattaactcctgttcttcccgatattacactaacaatcctcattaacactttagctctccagtgaaagttctggaagttttttctctagtccaatggcacaatctccaaaattaacagaaacctgctttcaagcatgcctatccaggtcctttctatgaactccccataagaagcaagttttgtactctagctgatgataaaccactttttgaggagaatcaaagcaaaacaactgtggatgacaaaagtcttagcacagccatggtgaaagacacaattgacaaggaaatttggttacttctgtggcatacaaaaatttatcataatagatataattattactgacaacatactgagacatatcagaattatagaaatcccatactattttggaacacacactaataacacatttatataaatataacccaaataaagttaaacattattttatatttcacaatgctttctatatgattttaacataccaaataagctgaatatgtctttcaggggacctaatatctaaaaagctaatgaggtcaaaaagacagaatttgaaatttgattttggaaagtttgtcaaatatgtaagattttaaacatctgatgtcaaaaattaggcaaatattttagaaagcaaaaacatttatgctttgagaggagactcagtttcttaaacaataaggcataataaagatacgaagacaactgaatctgtctttctcttccctttttttgcagtttactcaacaggttaaaaaaaatctgttactatctcttactattaactgaaaactttatccaaaagagaaaacaaaattttacttttcaatagcatattattaatgctaaagcttatttcaatgaaatcttatgaacaaactcatccaatctcaaacagtttgaccataaagtaagatttttatagacccttttataaaccttaataattttctattaaagagcagatcaatgttccaagaaaaccattactgcaacacaaaggccctgattctggccctgtgtcagtgtgcttttgatattaatgtttaatttatagaaaaaatgaaataattccctttaaattttagccaacttgatcacaaacaaaattccttttttaacattaatctgccataaaccttctataacttacttaaaccttcagtttttttctaatattttactttaggacaaatatttcctttcctccccaattttctatatccgtttagttttatccatcatttttttctttaatttaaaacaattcttataaacctttaaatgagtcagaattactttttctttaacaaaaaccacatttccatgttttttataacctttttacacgtcctactttattatatgctttgtatatagaattgtttcttttatatctagtagttttaattttatttattacagtgttgactgtaactcttgtttttagtggaaaacctaggaggtaagcaattttaattatgtattagattcagagcccagaacaaaggacagagctgcagataatgccttaccctttcctgcatagccaggaggcatagctaggccaagaagaactcatgtctatttgtttagagcctagaatctaatagttgtaaaacaggcaagtcaaatatttgtcaaaaatatcacacataaatatcacaatttatgaccttaaaacacctagcaaaggcagtatctgacctgcctgtgtaattcagactgaatttctaaattaaagtctgaagatgtttccattttatcttaccagtaactttcaaaaactcttaatttaccaaagattagtcacatgaactatgaaactatgtgaggtaaaatttttatttttctgtttaaatatttgatttaagtattttttttccttaagacaagtaattagagctcttttacatattttagtaatgaaacatcatatgtgcttataaatgtgtataaacacacagacatacaggcagagaaacaaatcttcacttgtcatatttcaaagtttctctccagtattttagactatcagtctcttgattacctgttttcttctctaagcaattattagctaggcaaccccaaatgtgcaattctaaagggacagctcttgtaaaacaaagtagaaaatttatatcttagagtacaaaggtaaaacatttggcctaaatattgtatcatcatctgctcaaaccacgggaaaaaattatgtgagtaaaattcagttaagatgaccagagaaagcaccttaaacaaagagatgacttgtaaattttaaacaatggtaaacacttttaatgtacacaggtaggcaccctttcaaatggagatttccttaaatatgtaaatttcttttacaaaagagtgtcaggatagctagctaaatgctagaaagttgtattttggctattttacttaactcgtttcataattagatgactagcttcagagtggagccccttggtgaatatgggaagaaaagcatacagtttttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatccaaaaagagaaaaaacataaaggtcatatatacatatatatacacacacatttatatacattatatattaatatatattttatatgcattatatatatttcatttacatatataaataaaatgtgtgtgtgtagcttagatatcagcttttaattaagcagatttctaactgtagtgctcactcctcaaaaataaaaaaactttcaaaatcttattactggatttcagctgggacaaatagcttgtcttggcttttgaactcctttaccaaaggtctaaagcagtcctcataagatctagaaatatcaaatcaaaagagactaagtgattccttcatcagaccaactcttctgtcaatggttgagagaaagtgttactctcaaactatgattgtaaagttgtctatttctcccttgaaatctttcagatttttgaaaattctaaacttcagttattaggtatataaacatgtatgattgttgtgacttcctctcccttttatcattatgaaatatgtctctatgtttggtaatactaattattttgaagtctattttatttgatattattattgctacttcagccttctgacacttgtagatctttttccatccttttactctcaatttctctgtgtctttgtatttaaatctttcccttttggatagcatatattggggtcttatgggccttttttttaatatttgaacataatctttgccttttaacttgagtgcttagcccataaacatttactataagatacattcagatttagttctactattttattactggtttctatgatggtcatcttttattttctggtccttatgttggccatctttcattttttggtcctctgatctcccttccctgccttcttcttaattacttgaatatatttttagaattcaattatttctttactagctttttacctatacctctttgtatcattgttaagtggctgttctatggcttacaatttatatcctttataatgaacaatatataacagtatacttcaatttttgtagcattttgtgtaaaatatagaaaacttgcaatcatataacaggtcactatcctgtaattacagttgccatctgaattaatatacacacagattaaaaatccataaataattttataatatttgctttaaagggtaaattatattttgaagaaatttttaaaatagggcttttttatatttactcataatttaacatttttaatgcggtttgtttatgatgaaagattcaagcttttcatctggtataatttcctagtttctcttcagcctgaagagcttttttttttttcattaataacatgttttttggagtgtaggtttgacagaaataaatttccttagtttttcatttaaatatgtatttattcgatattaatttttgaaacacgtctcactcattttaaattatgagatgagaactttatttatttattttttacctctgtaaaggtttctttttcttccctgctctcttttgttcttcatgggtttctgatgggaagtctgtttttattccaattattacacctctaaaatcatatgttattttcactgagtagtttaaaattttctcatgcttttgactttgaacattttgagtatgattatctacaaaatatattctgaatttgtcttatttggcatttgctcaactattaaatttaacatcttgttcatttaccaaaaatggtagttatagtcattatttcttcaagcagctcttctgctccattttctttctctccccttctgggactcaattacctatatgttaaaacttttgacattgtctcatagacttcttaggccctgttaggttggttagaatttttaaaatctctctcatcttttggtttagtgaaatttattgacagattttcaagttcactggccattttctctttcatctcctttctcttattaagcttactcagtgattttatttcagatgtttatttatttcagttctaacatttcactttcttttttatattgtctgtatctttgctaagattttatactctaccttgaagaacaaagttataagaggtgctttactagcctcatacgataattctagcctctgcaccatcctgattggcatctgttcattattaatacctcgatattgggtcacatttgcagcctttctatattgagtaattttgaattgcatcctggatatcgtgagtgttagttatgctgaatatattctggattctgttctattttacctccaacagattattgaaggtgtttattttggcaggcaatttacttactgtcacacatatagtgcattgtagctcacatctcacttttttttgtaatttttagttgtaagttgctttaattttgcccaccatcctccattcaccttatgaatggtcccagtggtcaaccaggaacttaccttgagtttatgcactgaattaagggttcctttttcctggtctctcctttctgtctttgactctttgggagccattgttaccccagagcgccgtcacctgttttttttgtttgtttgtttgtttttgtttttttgatgagaagtcatttttaacctatctccactgcagcagcagctatcttaaggataaatcaccaataaaatagggattttacgctatgctgccccaagttttgattcccctttagaaactccctgcttgcttcatcctccaaagccctcagctagttgtgtttttgattttatccagcatttagttatttgtgtaaggattgtttttttaagagcttactcttcaatttcaaacacccaaacttcctgttcaataatttttgaaaacctaagatgataatgtaataactttctctcagatgaataagtattttaatagattttctaaaatccagtaaaacatactttggaaaaggacaataaaagtttttcttaaaatttttatttacatatcaacttaattaaacgtgttagctgatttccatgtatatatggaagatcagagaactaaattcttcaggtaatctatttttgcacatctttgggaaaaagatttctgtttgattgcctctaaagcgtagctcattcacatttaattatcttaagaataggccacttgtaacattaatccacaaagctgaatttataatttgtaagagatggcacctttgaagttgacatttcttttatatcaatgagattgcagctgcagatgaagtgcaaatggcaaattatgcaaaataaaataatcacgaggggaaacttcagttgaatatttctgtttgattaataatctatcagcagataccatctaatttaaatttgcacaaaagcataactgctgttgaaaaattgctgctgtttaacggggacacaaattcacatttctttccctcctcctctttgtgtagccaacgattgcagttacttggttttgaattgggctttttagagttaatgccttgaaaatagaaaaataataaaaagctttccttcatcctatttatgcctattcacctgcttatcatcttcaagtcttttctaggtcctatgagactagaatcattattcagttttgcccagttacctacttcttaaaagagaaatgtcattcagattctttaaactatagcggatagtcattgttctggtttgtcaaagaccaccttaaagtggtgactagaattgaaaagagaatttatttaagtaagcgtgatgaatctaacttttctcattatctggactataaaatgtcattaaggtttcctaagattcaattaggtttctttgttttttaaggggttggtttctttatgcgttttgtttctgtagcaaccctatcactcttgtaacagcacaacacaaacaccagttacccaaatataaaaacataattaaaagctatgcctttttcacatcagataatgccaagtctgggatatattacctgattctgtaacgtagataaataccttaaatgcattgttattaaaattgaccacagtgataaaatttgaccacttgacagaaattctaccctattaaagactaatctttagagagaaaagaaaaaaaatattacttgggttaatgagcttggatgtggatttagaaggtctaattcccaactagttgaataacaataattgtatcactttctttttttaaatggagacggagtctttctctgttgccggctggagtgcagtggcacgacctcagctcactgcaatctccgcctcccgggttcaagcgattcccctgcctcagcctcccaggtagctggtattgcaggtacgcacaaccatgcctggctattttttttttttttttgtactttaatagagacggggtttcaccatattagccaagatggtctcaatcttctgaccttgtgatccgcctgccttggcctcccaaagtgctgggattacaggtgtgagccaccgcgcccggccaattgtgtaactttcaacaactcatttgacctctaaaatttctgtttctttaattgtaaaactagatttttaaattaaatcacctgtatcttctcttttattctaaaaatggacattttcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctcgaacacatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgaggaaaaaaatacacctgtttgcaaggtgacatttctttgagggctcactcatggcacagcctggggatacacagaccacgggccaacatctgtggggaactcagagctttgctaattgcattcatcatattttctggggattcacttagtgctctgaaaaagccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaaggatctgtgaattgtgacttggaacaggtgggcgcacacccaccccccgccccgccacccccccaaaaagaaacaaaacccaactctagtcttcatgacagtggcagtgaccaggaaaataggacagatctgttttctcagctttctctgcactccccagtgtctagagaggaaggtaagcaagggtgtaagctcaggccctggtgtaacgtttgggcataacagagctgggctggaacttggcctctccactactgtgtgttttcgttgttgttgtttttttttgttttttttttttttggatttcttgacagctctaaccacgtaaacctaatagcagagaaaaggagtaagtgtcagccctgccatgtacaacgctgacatattttaaaagcaaacctttgttcaaaataaatcttaaccattttagagcactgctatttcttcactggaatttggatcagagaacaaatccagtccactgacaagatgtgagagaaacacaagagtttctttattctgtaagataaaatatttatgagatgatttttatcagaaggcacttattatgtagcaatctttacagactctatgcttgctgcagagttatctatgcaaaatttaaactaaaggaaacctaggtgtttacatcttaagaaagacatacatttcaaccaacagaacatgtgttatagagttgtgttttataaaggtagagtggtaaacataccttaggctaaaggaagaaaaatgatagggatatgctgcaagctgaataaacctcccttctagctgtttttttttttttttttttttttttttaagatggtagcttttgagacagtgctatctttcaggatattcagattccctttcaaacaaatgaatattctgtgccctgattgcatgttttgttaagttgggtgatgacagtggattcttagggttgtcctcctgagagagtagccccaactctattttcggagtttttctattctctagtctttgtatatgccacagacatttggtctctgagtcctcagtcttataacaatagatcttaagctttgttatctaaaaaactatccagcttctgatttaaaaccaagctgcctaactgtaattctcatatctgttatttcttctaagatctcagaggaatgctctcaacctggactattttagctcattcaatagaacataacagcagtctctgagcctgagctggttagccaccatagttctgttctgtcagggtaattgctatcatgattcacaactagtgtctcttttcttcaagaaactgtcactcagatttaccctaccttcttcacctaaatccaattctttagatcataacctaaatctaagcctttttcatttcacaaccctacatctgcaaggttcttttaattattctctgactgtctttcagttttctaacatcgacagtatagccttgcatacttttcatgaggtcatttgctttttgaaaacataagtagccacctccttcttaccatactgcaaaaactcctgtgtaagactgtttaggtcatttaaagtctgcacatctccaatttcttctcttgtacttaccacaagaatttaagaaaacattaattaccgaatgatttatgatattttcagttgcattttactctaatttgatatatctttataagccattgctaatttgttataacttactgcataaagagagtttgatagagggtttcatgatctctcaacaaaatacgaagataggtagatgatagtaaagttacagagaaaacaatctccaatattcacctgctctataggactaggtcatggaatacctttacaaaataaagaaatttggagattgtcttttttggcaaataatgattaacatgcatttttttggatagaatcaatttttgggatgtcacaagggttatataatttaatgctgataagaaacataatagtatcactgtttctctcattttgaaaatgagaagactgtgagctagagagaatacatatatcataatttttctaagatgaacaaaaagatcaaaattttaaactcttatcaccccaggctatctctgtaaatgatctttttaatttattacctgcttttggtatatatttccccagttttgtatgatttgcagctttttaaaatattctgattctttccattctaagcaaagaagaagtgcatttttctccagaatgtaagggaagtactcggcatttgatcttaatttcgctttttttacagtgtagaatgaactacagataagaggggtggaaagaaagaaaagggagagaaagccaacatgagcaaatttctattaattgtcagatcatgacacattccagccaagaatgttcctatcttcttatcaacaaaagtaaaatttactctctctctctcttttttttctcttgtaaaaatagaaacttctgacttgccttttaagctcaaaatcaaacatttctggagcacctagtatgtgagaggatcattttctctatcaaacatcttcccaacaatattatgaatgcaaagtattatgcagaattgtcaaataaactttaacaagttatgtatctgatccagattcacaaagaaatccaaactccaagttatcatgacttcaaacttctatgcctttgatattttatgtatcactagatgatattgtgtctttcaaattcctaatgtagaattgttggtaaaatgaagctctctagccaaatttaaattgacctacgagttaataaaaatgtgctaatttctaatgcaaaatcttatttagcatttttaataactaaaacattcctattgatatttgctcacaaaattattttattgtctaaaaataaattgctcagtaatgtttgtttttaagcattgataataatttgaggtggagtcttaattcttgagagaaaaacctgttcttaaaatcctgcagggcaaactcaagcattagacctttatttctcaatatgttctttcgctttttttaaatgaaattgccaaaaaaagaatagattcaaatttaaactaaaagtctagaagctaaaaccaagctaaacaaaataacactacattaaaaatataagtagatgaaaatgtgctatattttcttgtccacttcatcctgtgtaacttgtcactgagcacccattaatttcttttaaattgtttccttcactttcctcttgagagctggagtgttgaatctagcagcagatcacagctacttataaacacttggctgaaggactctcaaattctctgcaagattttgagtaaagtgaacctaggaattctgaagggacaccctttagtcagtaaggaaagagcgttcatctattccttagacttgttgctgctatcacagaagtcaaagttaaaaacacagggtatgaataccagtactaatttcctggactgattatcaaggagctgtcctctttcatggtcagaggctaatataagcactcctacaacaaaagcaggaagctttgtttctattttcttacccataacaatctttgtcctttattgatatgggagataaaaagtggtgacaatatcagacaaaaggaaagaaaagaatgcgagctttcatttttcctctcctgccttgatgagaagcagtcaaatgcaaccaaatgcccttggccatgtgaggttgggatagctcttaattagtctgcaactccaaactatcaaaaggtagggaaggcaaggatcctaggaagaaaaaccaaatactcacagacaattaaaaactaaagcctaatagttgattaatgaaatgatgtcagcctgcatgaagtgcccttatgactttgtacgaatcccttacgctgtcttaataacttggatactgatgtcaaagaaggtgtgcttatcatttttggcaaaggcataactatgagagacagagttaatatatttgaaaaaataatgcaaatttaattcaaacatttaataataatataagaaattagatgttttctcacaagataaatttaacatagatagggataaaagcccacatttagtaaaagggaacatatgaaagcacacatatttacacagatatatagggagagatgctacttaacaactgtttatgtacaaaaaatacatgagcgttttagttatttttagcacaacacgagtcaatagcattatgtggctactgaaagcattctcctataatttcagttagcacttttagaaattgtgctaaagtaaaacaagaaaattgttctattgcattctttgtcatatcctttagcatttattataactcagtatcattaattcattttttacttatttaatgtgaatctgttccattagattgtatgcttcatatcacacttgttttattcactaatccttgttcaacctatgcctactacagtacatggtccaagatgtatgtccttggtgtcttatatatagtatatgaggaaaatttggtggggtaatgtaaaggaagtagacgcctgggtggaaacgacatacattatatcccaggaaacaggcccagaatcaatatgtagaaaccagagaatgattaacttaaagtcttaaagattaattttagaatacttagaatatcatatgttgtaactattctaaagtttataagtagtccaaaatggagtagactagacttctgtttaaacatggtggaataataatacttttctttctatggcctaagagacaccaagtcagctgagggcacaagcactaacaaaacaggaagacagtgatgattaaatccttattctggctgggcgcaatggctcctgcctgtaatctgagcactttgagaggcagaggcgggcagatcacttgaggtcaggagtttaagagcagtctggccaacatggtaaaaccccatctctactaaaaatacaaaaatattagacaggcatggtggtgtgggcctataatcccagctattcaggaggcggaggcgtgagaattgcttgtatctgggaagcagaagctgtagtgagccaagattgcattgctatactccaccctgggcaacagaacaagacaccgtctcaaacaacaacaataataacaataacaacaaaaaacagacaaaaaaaataccctgcctgccaaacgtactctgtcatgaagaaaattggaaggcttttatccaaaagtgggacaaaccaagagaaaagatgcgacattgccatgtagttgttccaaataaaatggggacaattatttggaacaactaatgttgttctggtcactctacagcaaggatcatcattcctcaaactatgtgataagaagttccaacaagcctttagcatctctttcttaaatattaatggatattcagtgatgatcagatatgtgagcagagcttctaacatgaaaggaacaatagtaagaaaactaaagaaatagaacatgaaagtggggagtataagaagaaaaatattaatatccaaaatgaaattttaaaaattcttttgttaatgacaagatgatatcaaaaggaacatagaatccatataaattatgttagacaaagttgaagacattgaaaaagaacaagaaaacttaggcatataatataaaaggagaaatataaaacaaataaaagatcaattcataaagatcaagacaaattccaggaagaaagaaccgagaaaatgggaaagaaacaatctatgaacaatagatggagaaaaagaaaatgatttctgctagggcacatcattatgaaattcccaaatgtagaaaataaactattccaaagaagaaacagcagatttgaaaacagaggatggaatctcagaaagggtcttcataatggcagtattagacattagaagacattaaataagcatcttcaaaatactgaggcaaaataattagcaagctagtgatccatatctggccagcagagcttattagaatgaagacatcttcagacacacaagatctcaaaacaataactttctcaggaaactactagacaatatgttgcgggaaaaaaaaggatgaaaatcacaaagaaagttgatatgagattgatgtctaggaatcagaggatccatcacaggagagatgaaaaaagagtcatcaggaagatagtgaagggatattccaggattccattttttagcagtcccagagagtaactaacccagataaaaagaagagaatcgtaagctctcacagtgaagtgttcaagctaaaaataagtgtaaataaataaataaatacctctcttctcccccaccaaaaacaaaaaaaacaaaaaaaccctgctaaaataccagaccctactgtgacatttccattctactagtagagtttggggataaattcgttgtcattacagagaatagtaagaaaaaatttcaggaagaatgagtcattaaccttagtgaaaccaatattgtatcaagtaaaacaatgtaattaatggctcagctgtgaataatatttataaggtcatgaatagtgaaacgactgaaaactgattaattttaaaaactgaaatatgccatattgaatggttggaatgaatagttaagagctacaccatcatttccattaatcagaaattaatacagaatatctaaaattacaaaatcaagaaatgatgtacaacagttatcaattgcagaatattcaaacgttttgtagcttaaaacattaagtatttattatcttacatagtttctgtggtcaaaaacatggtactggcttcagtgtgtgaactgagtctctcataaggttaaggttaggatgccagccaagcctgcagtcagtaaggcttgactggtactcaaggatctgtttacaaagtgactcagtcacatggatggcaagcacatactactgttggcatgaggcctcagttcccctcacccccccatggacctcacctgcataagactcaagatatggcggctgcatttccccagagtaaatgattcaagaaagggcctgtaatagggaaatgtcttctatgactagtcttagagggtacaagttgttatattcacagtatactattagttactgagatcaaccctattcatcatgggagaggacttcatgtgggtaacttaccatggggaacagaggatgatatgggccagcttgaaggctatgtaccacaagcagtatgagtgtgtgtgtgtgtgtgtgtgtgttttcaacatgaagtgaagtttaaaacgatttgcattacaaacataaaagagctacatgggcagagatcctagtacttttaaaagaactgttttataattatccatgtgaatgaaactacaggtctgggaccttcttttcctgaaatgcttgtatatattgggcagcttaatttgtttactttgttattattgtaagagatcttgagtaacctgacaataagctatatgtgctctttaaattctatatatctgctctccagtaccactaccttggtgcaggcagaagtgagtacttggaattggctttttgtattattattttgaaaagaaagaagaagaaaatcagtaaacaatagtgtcctaaatgaatatctttagaaataacccttcttagtagaccattgatattcttcggcatttcaggaaattaatccacccacttgataatggttgaaaattggtatcttaagacacagttgtttctcccaacatatcgatattatatcagactgatgtatcttgcattctcccagtaaaaaggaaatagaattttaataaaagccagattgtgcaactaatactctggaattgtagtgcattttttaaaatcttcatgcaggaaatgaaagagaaaaaaagaatccagatcctaacttttcagtagaagagtgaaatgtaaaatgattttagaaaatagattattttcaaatttgtattcttcacttttgaagaagagcgtattttcctcctggatacataatttggaaacatatttcaaaaaccgaatcttaatctatgcaatgaacatatcaaaaagtaaattactatcttcaagggaatgaaatatcatattagagaagcacactctagcaccacagtaattatggctttgccaacatttctgtgcaaagtctgattctgaaacagttttttcttaccccacacagccttgtttatgtaagaatttagtgtttaccccaaccttcaaatacaagttgacctattgttttacttctttaagtgaaactttttgggactatatgactttctaacttcctccagaaatatgtatggttctggatttcctccgtgcttcatctactgtagcttacagaagagaatgttatagaattattgcattttagaatcgaactttgaagcatgttactgaagccatatcatgatgggggagcagtccagaaatatttttaaagcactagtcttggagtcagaagctctgtgttagcctacctacttattagtagggttgccttgatgaagtcacttgattttctgaaatatttctctctctctctctcaaaaatctgtaaaatggaagcaacaaactcaatggcttttaagatctttgtaacctccagtgttactcaagtttgaatagagagagaaggtgagaaacaaatctagaatacacatctcctaactcccagtttggcatattcacaaatgttagatttatgatgattagtgagaaaatataactattccaaatacatttctaggtatgtgagatatattacaatatggaaggaaaatgataccaaattgtggctcttctctatggccctcatcagggaactattctgaaataataggacatgtgtctaaccaaatccatatttttatatgctcatcagcttctaactatgtacttgacttgatctattcttaatgtcaccaaattaacatcttgaggaagcatgaaattttccaaaaagaatctatgagcatttggtggctatttgccagaaatatttctcctggacaaaagatggaaagccattctggaaagcaagagtgttttattagaatacagcagtgctttagtttaatgtgatcattacccttgtaagtttctaatcaactatttgcaggatggttttacaaatatggtttgactaacctcaagccttattttttgcatgcgaaatctactaaaaaatgcaacattatcattattgcatttacatatttcttccacatgtataacaaagtagaatgtatctccctcgttcttaccaaaaacctctaatatagtgacgtgttctgccaaaatgtaataaatgagaaagcatatgctttgcaggcagacatactgggtatttggaatctcatttctgcacttcttagctattatgttcctgggcaagatatttaatgtctctgagcctcagttccttcctctgtgaaatgagactaataatactgctctcataaagctgtattaatatatattctaactatatatgtgaaattacataaaattatgaaatagagagagtggtatatttagctccgttagatgcattaaaatgctaaacatctgtatcttttttttttttaaccagttttctttcaatcacgataaagtcatgacaactggtaactttaggaataatcttaccactaggcagggttgataaatcaattgtataaaatggtacataaatcaaagcctatgtttctctttttaatgtgtgtagccacaactactacatgaccttcatgctttactgctgagagaatacatatttagacaaaagctcaaggagttgcattctactacataacatgcagtggtttgtttctgtgactcgctgtggaagtgatttctaggagcgccagatgcttggatgctatttttatatagatagaaagggaatcccttcatttattggatgttcttggcatggtattgtgtgatttggtgcttgaccaggtgggagtctcttatttatgaagttcagaaaattccagtgcttagccaagtctctactgaatgcccaggatatacttgaaggttaacagtggcataaagtattagtgtttcctgatttttatatgtggatagaatatcttttggctcttggtttatacagattcttgcattattctctcatgagctcagttcttggccttaatgcccttgagttctttagggctacttcctccagcctttttgtctgacatcactactgcctctccacgatgtaaaatctgcactgtgattcaaagagatcccctgcatatagcagagtcattcttccaatggtttcctctttctttttcatttcaattcccacaagcctccatcttcagcaagtctgttgctgacaggttgaacaaatactgctaagatatatttattctctgagaccctttttcacttagagtaaatatgttactgtctcagttcatgttccagcaaaacgcagactctaaggtatggatttcagtacaaagagattacttggcaggtgatcttaagaaataccaatgagaaagtgggataaggaagaaaaggtacaataaaggatcctttgggaagcctgctagcactgtgggcaactgagattgaatcctttggggagcactggagaatacttaactgagagtgactcccatgcctctccacaggagggaaaatagtatactcagtccctgatttaaagctgatcccaaaggcattaattaccaataattctgtagactgctgatggagagatccaaaaaagctttggggcagagcaacacagctgttcagctggaattcagggcatgcactgaaatggtaagagacaatgggataggagcagataaccaaagtgtctaccataatcacctttaaaacatgctttatgcaattatagaattggaaattattttagagaccagctctcagcttatgagtcacaacaaggttattgataatatcgtaggtgggataattctttattgggcagagttagctccgtacattgcaggatctaccactaagcaccagtcagacacccagttattttgactgcacaaataaccatttatattttcaagtgcccctctgttggtcaacattttctctgagcaccacagttttataggggaaggaattttttttgtttttggtttttgggactgagtctcactttcttgcccaggctggagtgcaatggcgccatctcagctcactgcaacttccgcctcctgggttcaagcaactctcctgcctcagcctcccgagtagctggtattataggcatacgccaccacaccagctaatttttgtatttttagtagaaacgggttttcgttatgttggccaggctggtctgaaactcctgacctcaggtgatcctcccacctcggccaggcgtaagcaaccgtgccaggctagggggaggaattctaacttggcaaggctaagagacctgctaaaaggcaattggcaaccagtgtccacgtctccagaattatcatagagagaaaacagaaaccttctttttgagggagatcatctctgagatatttttacctgggtagcagtgaatcctggatacacagaaatataatataatatttgagtgaaataagtattaaattattatgggagctaaacaaattgccctcaattccctatctgtgcatttttatctgcttttaaataatataaattattattacctatgtccacatgcagaggcagaggaaaagagaatccctttaaaatgattacaagccaacaaaatatttgcaagtgaaaacatatattttgggggaactgccttgttattttaagtttacattatacctactttaattccagaatgtcattacagaggaaaaaaaaaagcttgattagctgagtaacatcacttttttaaccaatgcactctcctactgcttagttccttacagctggataagtgggtaacctttgtgtccatagattcttaggtagatggaatctattgggaaaggaaatcaattttacacatatacatacacatatttttaaatttcagactgtttttatctaaaatagaagcacggattttgagtccccccaaaatggatattatttgtctcattcgatggacttactataaattctagaatggcgggatgttatgaacggcatcgcacatgctacacaaacacaaattctgctcttacgattacaccattacaagataaatgtattctcaagtagctgcagtattctattaaaatgtagacacaagcagaatcatttttattaagaaaaaaagcagagcaaagcatttaaaatataaataaaatataaaaacaattgctttcctattaaatacaaaactagagagcactgtttcaaattggtaagtcatatctgtttaatatgattgcaattatttatggggattaggaaaattaatgtcaaatctaatattttcgaaaaatggaagactcaattaattaaccagacatttcatcctggaatcctatttctttttctttccagagggaacctaaatggagattatattagagaattaagtttgacagttaatttatgaagaactaatattataagtatcaattaaatagaggtgagggatatatggaattagtttgagttgttaaactgaccatttcaaaaattagaagtattttatcactaatacagatttgagaaattattagcaattctaaattattcagatttgcttaaattcaatgattatgatttagatgaattaagaaagttactcagtttgtttaaactgtggaagttaactttagtgtcccaaacctgggacattagcttcattttatttcggctatgccaggatatatttgaagctcgtattctgtacaacagtgtatactattgtagagaatggggatggataataataataaaatatcactttgtcagtaaataaatattcactgaatgataattgtgtgctaaggaatttatatgtatattatctcattcaattctcataaaatctgtgtgatagggcccagtatagttttctgttttccaattgaggtaactgggtcacagagaatgaagcctcgcaaccatggttatgccgctactatgtaaggaatttgctttaatcccccagtatccctactctaatctaagtcagaatctagacatgcagatcaatacaaatacatttcagcctaaaaaaaaaaaactctgaaagcacatttccaattttgccagcagttagttattcatctacagaagctattagtcccagtttgtaacattagcaaaaattaattttcagtctttttcttatagtttgtcttggtagcttttgacaaagttggccataacctctctctggataggtgacaaggtgcagtagtgcaccttgtctttcagaacagcaatactcttctggttgacctcttattcctttgacagtgacttctctgattcctttagaggtgtctcttttaatttctaaaaaatgctgatggttttaatgtgttatttttatgacacatatcccccttgggaaattgctcttgttcaaccaccgtctcatgctactgactgcagtgtagactgctctatgttcaatcatctactggaaaccaccgttgaaagcttgaggtgcataacttagacttatattttctcaaacctgctctcatactcacttaccctcactagaagtcctctttactcctccctcttttttacatgtccccatgttaaatttcattattcagtcttgattcattgattaattatttataatttataattttatattttagaatttttttcaggtgctggggatacaattatagacatgattaagtactagtttcatgaggcttatacagtagttacccccttaaccatggagggtacattccaagacccccagtaatgcttaaaaccatggatagtaccaaaccctgtatgtatgtatgggtatatatatattttttatatatatatatatatacacacatagcatatatgtatatgctatgaatacatgtatacatatatgctatgaaaacatgtatacatatatatttatgcataacacgaatgaagaatgcataacaagaatggagcaatgcatttaaaatataaataaaatataaaaacattactttcatattaaatacatatatgtatgcataacaatattttggtaaactatagactacataaagacagtagccctataagattataataagatatttttactatatcttttctatgtttagatatgtttagatacacaaatatttaccattttgttacaattgattacagcttttaggacattaacatactgtcctaggagcctaggatcaataggctatactacatagcctaggtgtgtaggaggctagaccacctaggtttgtgtaagtacactctatgatgtttgcaaaacaaaatcacctgaaaactaacttctcagaatgtacccccatcattaagtaatgcatgactgtgctgttttttcctttatgtccatacctatgataaaatttaagatataaattacacacagtaggaaattaatcacaataactaataataaaatagaactattgtaacaatatactgtaataaaagccatgtcattgtggtctctctctctaattttattgtactttactcacccttcttcagatgacatgaaattacaagacacctatgtgataagatgaagtgaggtgaatgctttgggcattgtgacataacatttaaaacttgaattatttctggacttttccatttaatattaagctgctgttgaccttaggtaactgaaactgcggaaagcaaaaccaaggataaggatggtctcctgatgagttagggttgagaaaacaaatctgtaaagaaacaaataatatgctttctactagggatgagtgttttgaaaaaacataaaacagatgagtaaataaagagtgaaaaggcatagcattttatctaaaatatacattgagtgcaatgtgtcagttgagtgaactatcttggttgcaaaagtcattaaggctcttaggagtcgtgaaagccttctgtgagaaggtgattttggtcacagtaatgaatgatgaaatggtggaattaatgaagagttggtgaaagagacaaataagaaggaaagcaagtttaaaggttctgaggagtgaacaatttggcacttcccatggtttcatttaactgtaagatttgcttccgaaaatatttctgtctttggtatcacttgtcttactaggtactgtaggctttgggctttttctaaatccagtattcactaagcagtcagagtttctggtttatctacacatacaaatccgtttatatgatttcagtgcttatacctttctagatttccatgtacaactgtgcactgcaaaacactaaggaatagcattcacttagactaggatgtaagcattactccatggagttgtgtgacatgctggccctaaattccgtgccatcgatagcgggaggaagtagaaatcctttgacaattattttcctcttgatctaggatacaccctttgctggagtctgatttcttataattttctactactacatgctacattgtggtagtttatggttctgttaccctaattcccttcctcctccctgtagtgacttccttttctggttaacacgttttcattctttgaacttcagctcagataaaacatatgtggagcagacttgccaagtctagattaaatacctgtggtgcaacactgccaaattgagagacatttgtctctcaatttttcatatcatttgtagtttttttttttttaagacagtctagctctgtcccccaggctggagtgcagtagcgtgatctcggctcactgcctcagcctccccagtagctgggactacaggtgcgtgccaccacgtctggctaattttgtatttttggtagagatgggatttcaccatgttagccaggatagtcttgatctcctgacctcatgatccgcccgcgtcggcatcccaaagtgctgggattacagacgtgagccatcgtgcctggccccgtttgtagttctaaaattcaagtctggatatattagttccccgcttaaaatgcctcatgtcttcccactttctataataaaaagtctactatccttcgcatgacattgcctttattttaaatctccttacaattctcgcatctttttcttgagagtcccattgtcaagtatacacttacggtttcctgactaggccaagtggttcccagcatagctctgtgtaaccctctggaattctacagtcacctgtccatctccaaaggctcagtcaagtgtcacatacactgtcaggttttttctgacccaggcatagaactgcccttctcagtgtctctgcttttctctgtgtggacttctatcacaacacctattatcatttactgagtttagtcgtttgtttttctgtcttcttttgtaaactcatggaggatgagactttatttctgaacagtggagacagctggcacctgagagttgcttatttgagtagatgaacgagtgatttaaaaaatttgggaaggatattgaaatgaacctaattgtggtaatcatattcttaataaatacaaactgagacaaaagatttattctgtgaattttgttttgccctcaaaataaagtagtatctcatttcatacgtagtatgttggaatgttttgccatggctgctatactgattggcattgctcactgctgttcgttgcaatatacaccagctgtttttcagcagaatgagtggtacaccttaaaagccaagtctttctccccgaacagagcgctgggccaggctcaaatctgtcatctaatcactcactgtgtgctgaacactagtctgactttccacgtgatctttctacactttttacacacacgcccacacattatttatgctcaaaagaatgatctgttatgagagtacagtgaatgtgttagtttcaagagataagattgtccagattcagaaacttgtagctgtcatcttctagtttcctcactgcaagtgtggagtaagattggtataacattagttcatcattcttttcagattagaaaatcttacatggtcatctgggagaacagggcaaaacaaaggtcaaatgttatggctagaaatcaagcctgcaaagcaccatcaatggaaaatttgtcatattttatggagaaactataattcttacaaatctctactaacagttctggttgtgttgatgctttggactgtctagagagtcacactcttctgtccattaacttaaaagcatgactttttagtatgttcatttccccatatggggtacaagattagtaatatcgtcttttaccaggtactttctctatgatcatggacatttgcctattctaatcagatccctgcatagttatttaggtaacttccttgaagaatatagtactaaggcagaatgaccatataatttattattgaagttagataactttttgagagcgaagaaagcagtacccatagttaccccaggatgacaggcataaattgaaatacgtggtcaacgtagtatatgggagacatgacttttaggagaaaatatttccaaataactcaaatcttaaaaacctccagagacttcaaacccattctgaaaacataatttgctgttcatatctcaaaataacatggttatcacctggggatagaaagatcatgacaacactgatgtgtgccatgaaattctttccatacttacatgaggttgtcaggtccaaactccaaatgcagaaaaacatgcagagaattgtagttcttgagcatctcttcttgaattagagcataacaattaacttttaaatcatttttggatactattgccaatgctttttattttgggtatctttttaacttaagtgctagctttcagaagtggaaagaaggataaatactgtaattatccttctattataaaatattacatttttaattacagcaattatttctagctacaaatctttaaatgtatgatgttttacttatgtttgataataaataggcaatactttgtgatacacagttgacacaagacaaatctaaataaaaaatgagaacatgagcccccttaattttatggattgttttttaaactgactttgcttctatgcaggcctttcactttctgtaaacacttaagggatattttttaatactctgtaaagtaaatttcagaatggaaaacataactccgaggtgtattttcaatccgcacaattttttttcacagaggtgtagaaaacattctacctgttattaaaaaaaattctatgtatttttggtttgtttgtttgtttgtttgagagggagtttcgctcttcgtgcccaggctggagggcaatgttgcgatctcggctcactgcaacctccgcctcccaggttcaagcaattctcccctcagattcccaagtagctgggattacaggtgcctgccaccacgcctggctaatttttgtatttttggtaaagacaaggtttctgcatgttggccaggctggtctcaaactcctgacctcaggtggtccgcctgtctcagcctcctaaagtgctgggattacaggcatgagccaccacgcccagccacaaattctgtgtttttaatagctttattgagatataatttacctgctataaagttactcatttgaagtataaaatttaatagttttagtccatttatagagttgtgcatcatcgtcctaatcttgttatagaacattttaaccatcttctccccaaaaaaccttgatcacattagcaatctctccccattccctctgctgtccacccctcatgcagcccccagccatagacaagaactcatcaactctctgtctctatatatttgcctctttggaacatttcacaaaaaatggtattatacaatatattgtcttttatatctggcttccttcatttagtatgtttttgagattcataggtgttgtagcatctatcagtgcttcatttctttcactgtctaatagtgttccatttcttggatatactacattttatttagtcattcctcagtgggatctttgggttgtttccatttttgactcttaatgctgccatccacgcaaaaggtttttcagtgtttcattttattgtcttttttttttttttttttttttaacgtatgttttcttttctcttgggtagaattccacctaggagtacagttgctgagtcatatggtaactctctgtttaaccttttgaaaaattgccaaactattttcaaaatttgctgtaccatttcacattcccatcagcaatatctgaggatcccaatttctcttcatactttctaatacttctacatcttttttaatataggcatttcagtggatccctaatgataataggcacttctgattgtttttgtaaataaaatgttattagaacacagccacccccattcgtttattctttttttttttttttttgttttttgttttttgagatggagtctcgctctgtcgcccaggctggagtgcagtggctctatctctgctcactgcaagctctgcctcccgggttcatgccattctcctgcctcagcctcccatgtagctgggactacaggcgcccgcccccacgcctgactaacttggttttgtatttttagtagagacgggctttcaccgtgttagccaggatggtctcgatctcctgacctcgtgatccgcccgcctcggcctcccaaagtgctgggattacaggcgtgagccaccgtgcccggctccattcatttattcttattgtctatgggtatttttgtggtatgatggcagagttgaaccacagagacaacatggctcacaaatcctaaaatatttattttctgaccctttacagaaaaagttcaccagcctctgctttagcgaatcaaaaatttacgtcctcaatcatgttttatttacaagtgattggcgtatgtcaggatgtttagtgagcgatacaggagtatttcattgtatttggagggaatgattgaaatgattttatacagataatcttctgaatttgtgattggtgttatatttcaatttatcaatttattcatatttatttaacaagttattacatatatatttattcggtatagttgtgaaagtcttattatatgccagtggctgtgttagaatttaaggataatgcagtgaggagcaacaagacccctgctttaacagagcttacaatttatggaaagactgcctcttactctgaggaaggtgggagtcatccagtctacagtggagctgagggcctgagggaaagaactgttagaacagatcactggtacaagatctgtagttctgaggaggagactctcctctttgtataatttctcagagcctttaccgtatgaaatatgcattgcatatctctagcaagatttccaaggtacctgagcaccagatctcttagtttgatgaagtatttagggctccacgaaacattttctgaaaaaaaaattacatagaacattgttggtcaagaattgtcagatgaaaagattcttaaaagaccctagaaacaaaacgagatcatttactcaacatctttctttttctagtgctacgtgaccttttaatcttgaaatttttcttgtgtagatgttaggcctgtaaattagttatggtaatgtcaattcaaagcgtctttgaagtttagtttgtcctttattggattcctgtctttcatatttgtctttctaaagcactttaaaatcttggagaagaaagttcaaggaaagatgatataatagattattcttccttgggctgcaatacttttaaaaggattattccttatctttttgttaaattgacttctataaatttttcaaagtgaagtgttttggttctcaaaggctaggagtatccttttatcttctttttctattctctcatattttccttccttgacaaattcatggctgaataacagtatcgaaatgttatcataattctttggctaattatttttgtcaagccccccaaaaggcaaaaacaagcactgtttaaaatgtttagtttggcagcatgagataaattagaagtgcagagaatgagcaacctatgagatcatctgtctgctgctacgtgcagcccatcacaattctagactgttagaaactcaagctcaattacccactttgctattcagttcctgcatactttgcgtgaataactgccccactctgtaactcagattcctcagctgtataatcaatggagttaataatacttatttcagttattgtgaagcaccgagtagatggttggcatgcaataaatatagttaccaacctataacattggtctaaggaatgaagaaacatctgttagaaagacagctttttaaatgaaaatactaatagtgccctgaagaaagatttatctttcttagtatgtcacagttaccagatggaaaaatcagcaaaatacaaaacacttaatgaatataggtatcatgatatcattatgatcataaggaaaaaagtggaacagttagatggggttataactggtaaatccatacttgaacgagatgtctaacatttagagtggagttcccctgggtttattaaaggttagtgttctctatcttccccagggagaattttataaatatataaataacgatatgaattacctctttggataaatatataaatgctatttaataaaaaaaaaatgtgtctgacctaaagctggaagggattgataatacgttgaatagcagaatgatgaccataccatatggataggtgatgtggtaaacctaatttgtgagctaattttttttgaagaaatgtgagaaagatcttttttggattcacaatattatcttcacaaatctttgaaagggaaaatgtaagtgtggaaaagacttcagtatttaaaattactgtaattgcaaaataagagttatagtgtgctaaggagatacttctgacaaaaacagtcccatgtaactatagccagatcaaattgatatgaagtatctgcaacagtggagattattgacctattcagttttagacttcattatgacagtgttagtttcagtggagctactccattctgagggacaaagataaacgttaaggtattcaagaaaagttaaatagttgtgggcagttgttgataaaaggattaagacattaagaatagccatgtagtttggaaaatcaactacaaaaaattatatctggaaatatctttccaaaactagctttgacatttttgtttctacaactccatgtttaggcatgtaacatgaaggaatctctcctcacgtaaaagaaatgcctagggttttaaattccagcatagttgtataatattgaaaactacctaaggtgctcattgaataatttatgtataaccactgagtagaatagtatttggccataaaaaagaatgaagaaagttttctctgaactgatataaagtgattaagaagatatatgttgtaaagtataattacagtattttaacttttgtttcacaaataaggaaaaataagaatgtatgatattttttctctctcttgagatatctctatatctgtttgtctatttgtctgaatctgtctgtctgcttgggtatactttcctggccaaaaagaaaaaaaaaaacaaaaaacagaagtataaacagaaactaaaaaatagttacctctgtagagtaggtgaaaatgggatagagggaataagaatcggaatgtaagttccttgaaagcaagaaacttgctttatatagtaaactctttatgtagttgacgttttaattataaaaatatcctatatatttaaacaaacaaaattaaaaggatgaaaaaatcagttgaatcaatcagacatacatgatcttaaccaaatatcaaattatttactaccatactgagaaaataataatttaagtaacttttacttgattaattaatttgtcaattaacgtactaattcatcaacaaattaagattataaattcaggtaacattattcctaaaaaactccatcttaaattcatctgacttttctatatttcaatattaccatttccccatgatttatacatgcttagaaagataaattctaaagtccaatacaactgcaaaaatatcattagctcttgttttttattatagttgtattggtgtggtcattctcacattgttttctgtatatattgtatgaaagaattagtgagtaaatgcattagcatggttggaagaaaggaggcacaaatatggaatgggtatgtgtggaagaatgctttagtgttggattttctttagaagtatcagtataaccctgttagacatagacacatacacatatttaatacaaacttcaagcacattttcatccatcttaaatttatctgactattctatgtttcaatattaccatttcttcttgattgaaggatgtcattatgcctgtttgtgcatataatgaacagatattgatttctaaataccactcactaaacacacattgaaaactgggaaacttaaatggctgatttcaggtctgcaacaagaaagaacaaattgggttatgccagaaagcaatggcatactcaatggttaataggataaggttgaaaaggcacagatgctctgtatagggaatttattgaccacatttggggtatgtagcttcagtaagaaaaatatagaataacatgttgaattacaaaaaaaatccaagagtacatagtaatacaagagataaaaagaaagacaaaaatggcagttcttttaaaaaagaattatgtgattttattagcccttcttcaccctattgctgatagagggattcctactctagtgttatatggatgacagaatataacacctgacactgggcagatgagatcacctgcagttcatacacattcatactcacatatggcatacatatatatactctcagctaggggaggagagcaccccatgccacagaggcccacacaggttgcacttgggaacaaagtgaataaccagggactgtggacagcaagatttatagtgtcaacagagggaaaggccccagtactcatgggaggatgtggttggtttagttatttttttattttaaaatgtaatgtaaattaattttaagttctgggatacatgtgcaggatgtgcaggtttgttacataggtaaacgtgtgctatggtggtttgctgcacctatcaacctatcacataggtattaagtcctgtaagaattagctgtttgtcttaatgctctccctcccctcaccccctcaaagggccctagtgagtgttgttcccctccctgtgtcaatatgttctcattgttcagctcccacttagaaatgagaagaggcagtgttttgttttctgttcctgtgttagtttgctgaggataatggctcccggctccatccatgtctctgcaaagacatgatctccttcctttttatggctgtataacaatccatgatgtattttctttatccagtctattattgatgggcatttgggttgatttcatatctttgctattgtgaatagtgctgcaataaacatgcacatgcatgtatcccagtaatgggattgctagtcaaatggcatttctggttctagaaatgccatttctggttctagaaatgccatttctggttctaggtctttgaagaattgccatgctgtcttccacagtggttgaactgatttacattttcaccaacagtgtaaaagcattcctatctctccacagcttcaccagctctgttctttcttaaatttttaataatcaccattctgactggcgtgagatgcttctcattgtggttctgatttacgtttctcaattgatcagtgatgttgagctttttttcatgcttcttggccatataaatgtcttcttttgagaagtgtctgttcatgtcctttgcccactttttaatggtgttgtttgttttgtttcttgtaaattaatttaagttccttgtaaattttggatattagacccttgtcagatggataaattggaaaaattttctcccattctgtaggttgtctgttcaactgatgatagtctcttttgctgtgcagaagctctttagtttaattagatcccatttgttaattttttcttttgttgtaattgttttggctgctttcatcatgaaatttttgcctatgcctatgtactgaatggcattgcctgcatattgttctaaggttttcacagttttgggctatacctttaaatctttaatctgtcttgagttaatttttgtataaggtgtaaggaggggttcagtttcaattttctacatgtggctagccagttctcccagcaccatttattttacatttatttatttatttagtttttgttttttttctaggtcaagtttttttttattattattattatactttaagttttagggtacatgtgcacaacgtgcaggtttgttacatatgtatacatgtgccatgttggtgtgctgcacccattaactcgtcatttacattaggtatatctcctaatgctatccttcccccttccccctaccccacgacaggccccagtgtgtgatgttccccaccctgtgacccagtgttctcattgttcaattcccacctatgagtgagaacatgcggtgtttggttttctgtacttgcgatagtttgctgagaatgatagtttcccgcttcatccatgtccctacagaggacacgaactcatccttttttatggctgcatagtattccatggtgtatatgtgccacattttcttaatccagtctatcattggtggacatttgggttggttccaagtctttgctattgcgaatagtgctgcaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttctttcctgactttttaatgattgccattctaactggtgtgagatggtatctcattgtggttgatttgtatttctctgatggccagtgatgataagcattttttcatgtgttttttggctgcataaatgtcttcttttgagacgtgtctgttcatatccagcaccatttattaaatagggaatcctttcctcattgcttgtttttgtcaggtttgttgaagatcaaatggttgtagatgtgtggtgttatttctgaggcctctgctctgttccattggtctatatatccgttttggtaccagtaccatgctgttttggttactgtagccttgtagtatgatttgaagtcaggtagcatgatgcctccagctttgttcttgcccagaattgtcttggctatgcgggctcttttttggttccatgtgaagtttaaagtagtttttttccaattctgtgaagaatgccaatggtagtttaatgggagggaataacatcgaatgtataaattattttgggctgtatggccattttcataatattgattatacctatcattgaacatggaatgtttttccatttgtctgtgtcctatcttatttccttgagccatggtttgtagttttccttgaagaggtccttcacctcccttgttagctgtattcctaggtattttactccttttgtagcaattgtgaatgggagttcatttatgattttgctctctgcttgtctattattagtgtataggaaagtttatgatttttgctcattgattttgtatcctgagactttggtgaagttgcttatgagcttaagaagtttttagactgagacagttggggttttctagatataggatcatgtcatctgcaaatagagacagtttgacttcctctcttcctacctgaataccctttattttttctcttgcctgattgccctggccagaacttcaaatactatgttaaatagtagttgtgaaacaggacatccttgtcttgtgctgatttgcaagaggagtgtttccagcttttgccctttcaatatgatattggctgtgggtttgtaataaatggctcttatttttttgaggtatgttccttcaatacctagtttattgagaatttttaacatgaagcgatgttgaattttatcaaaggccttttctgcatctattgagaatcatgtggtttttatatttagttctgtttatgtgatgaattacatttattgatttgcatatgttgaactagccttgtatcccagggatgaagtgacttgatcatggtggataagctttttgatatgttgctggatccagtttgccagtattttgttgaggatttttgcattgatgtttgtcaggcattgatattggcctgaaatattctttgtggtatctctgccaggttttggtatcaggatgatgctggctgcataagatgaattaaagagaagtccctctttttcaattgtttgcaatagtttcagaagaagtggcaccagctcctctttgtacttctggtagaattcagctgtaaatacatctgatcctgggcttttttttttttttttttttttttgtggtttgtaggctattaattagtgtctcaatttcagaacttgttattggactattcaaggattcaacttcttcctcgttcagtcttgggagggtgtatgtgtccagtaatttgtccatttcttatagattttatagtttatttgcataggggtatttatagcattctctgatgattgtttgtatttctttagggtctgtggtgatatcccctttatcattttttattgtgtctatatgattcttttttcttctttattagtccagctagtggtctattttattaattttttcaaaaacaaactggattcattgattttttgaagggttttttgggtccctttctccttcagttctgctctgatcttggttatttcttgtcttctgccagttttggggtttgtttactgttggttctctaattcttttagttgtgattttaggatattgatttgagctctttctagctttttgatgtggacattttagtgctacaaattttcctcttaacactgctttagctgcatcccagtgattttgatacattgtctctttgttctcattggtttcaaagaacttcttgatgtatgccttaatttcattatttacccaggagtcattcaggagcaggttgttcaattttcatgtagttgtgtgcttttgagtgagtttcttgatcctaagttctaatttgatggcactgtggtctgagagactggttgttatgatttcagttcttttgcatttgctgaggattattttacttccaattatgggatcaattttagagtaagtgccatgtagcactcagaagaatttatattctgttgttttggggtggagagttctgtaggtatctatcaggtacacttgctgcagaactgagttcaagtcccgtatatccctgttaattttcaattgtgatgatctgtcttatattgacagtggggtgttgaagtctcacactgttactatgtgggaatctaagtctctttgtaggtctctaagaacatgttttatgaatctgggttcttctgtattgggtacatatatatttctgatagctagctcttcttgttgaattgaaccctttagcattatgcaatgcccttctttgtcttttttgatctgtgttggtttaaagtctgttttgtcagaaaactaggattgcaacccttgctatattctgctttccatttgcttgttaaattttcccccatccctttcttttgtgtctttgtacgtgagatgggtttcttgaatgcagcacactgatgggtcttgactctatccagcttgccattctctgtcttttgatcagggcatttagcatgtttacatttaaggttaatattattatgtttgatttgtgtgtccttggtctttgttcttcagtgtgtttttgtaatggctgttaacgatttttcccttccatatttagcccttcctacaatagctcttacaaggcaggcatgatggtgacgaattccctcagcatttacttttctgaaaaagatgttatttctcctttgcttttgaaacttagtttggccagatgtgaaattctgggttggaaattcttttctttaagaatgggagaaaatttttacaatctacccatctgacaaagggctaatgtccagaatctataaaaaacttaaataaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacaatgttggtgggactgtaaactaattcaaccattgtggaagacagtgtggtgattcctcaaggatctagaactagaaataccatttgacccagccatcccattactgggtatatatccaaaggattataaatcatgctgctataaagacacatgcacacgtatgtttattatggcactattcacaatagcaaagacttggaaccaacccaaatgtccaccaatgatagactggattaagacaatgtggcacatatacaccatggaatactatgcagctataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaacatcacacaccagggtctgttgtggggtgggggtaagggggaaggatagcattaggagatatacctaatgtaaatgacgagttaatgggtgcagcacaccaacatggcacatgtatacatatgtaacaaacctgcacgttgtacacatgtaccctagaacttaaagtataaaaaaaaagaaaagaatgttgaatattggccctcaatctcttctggaatatagggtttctgctgagaggtccactgttagtctgacaggcttccctttataggtgacctgacctttttctctggctgcctttaacattttttccttcatttcaaccttggagaatctgatgattatgtgtcttggggttgatcttctcatggagtatcttactggggttctctggatttcctgaatttgaatgttcacctgtcttggtaggttgaaaaagttctcctggatgatatcctgacgtatgttttacaacttggtttcattctgcctgtctctttcagctacccctatcagtcataggttcagtctttttacataatctcatagttcttggaggttttgttcattccttttcattctttttttttcctaatcttctcttcctgttttatttcagcaagatagtcttcaagctctgaaattctttcctctgcttgatctcttcagttattgatacttgtatttgcattgtgaagttattgtgttgtgtttttcagctccatccggtcatttatgttcctctctaaactggttattctgtttaacagctccttctgaagactacttccgtcagtttatccatctcagcctctgcctagttctgtgctcttgctggagaggtgctgcaatcatttggaggagaagaggcactctggctttttgagttttcaacattttttcattgattctttctcatcttcaggagtttatccagctttgatcacagaagctgctgacctttggatgggtttttttgtggggacttttttgttgacgttattgttattgttgctttctgtttgtttatttttcttttaagagtcaggctcttctttcataggcgtgctgcagtttgcttggggtccactccagactctatttacctggttcctttccacacctggaagtgtcaccagtggaggctatagaacagtaaagatggctgccttttctttcctctgggatctctgtaccagaggggcactgacctgatgccaacagaaatgctactgtataatgtgtctggcaaccctaattgagggttctcctccagtcaggaggcaccggatgtgggactcactaactgaggcatgttggctgctccttggtggaggaggtgcactgtgctgggaggaatcccacttgtctagactgcccagattcctcaaagccagcaggggcaaagactaagtctactgatttgcgaagactgcggccacccctccttctaggggctcagtcccagagagattagagttctgttgctaaaaccctggctggagtttctgaaattcttgtagggagggcttgcctagggaaatggtgtgggtaaggatccagcctaaagaggcaatctggccacactctgccacagccacggtgctgcactatggggaattcctccagggtccaaaccatccattttccctggcattgcaggggaaagatggcaaactggagctgcagtgatggcggccacccctcctcccggaactcagtcatcttatgcagcaggcagccacagtgatggctgccgcccttccccttgaaagctcagccatcttaggcagcatgcagccacagtgatgatggccacccctccctctgggaactcggtagtcttaggcagtctccagccgagtagccgctgagaatctgcacaactctgcggttcagacccaaggctctggtggcgtgggctgacaagggggatctcctgatctatgggttgcacagatctgtggaaaaagtgtggtttcccaggcagagtagcaccatcactcaccgcctccctcggctgaaggtggtagctccccttgccctgtctgactcctaggtgggctgtggcaccactctgcttttccttactctccgtaggtcacaccaaccacctactcagtcccattaagaagacctggatacctcagttcagtctgtttaaataattcttcaagtttgcaggcaactgaaactcaccagttaatgattaagtagtagccgcacctgttccatttgataagaaaggttatttggagaggatcttagctctagaagcccaatggggagggaagcttgtggttaagttattggaggccctgtgatttcaccagatatccagtcagcacataattttagacattagttcttaggctttatatcatataataaatatggctggaatgatagactagaaaactcttgatgtttctgtcctaatattataatttattaatgaaagaattatcaatacattctaaaatcattgggcaaaaagtgtttaagaatagaatattcatgttttcaaagcatcattgcacatattacttgaaaggtggaacatgtccctttaaaatggaaagatcatacagtgacaatcttaaccaagtggctaagtttggcattactgatggtgtaaagcctaactttttgtttcttctgatgacatgcaatgggagattcactacaccagttttgtggtattcttaccaaaaatgttgacctcagtctaatcgcaaaaaaaaaaaaacaaaaaacagacaaatctatgatggtatgctttgcgagacagctaccctgggcttctcaaaaagttaatactttaatattaaatcaaaatatgtaataatgaataataggggaaaacatcaactattttaaattagataagactaaagtaacgtaacagtgaaatgcaatgcatgaagttgcatgacagaccgaaaagatataaagaacatttacgtgactattgatgaaatgtaacgtaggttgcatgttgtataattttattaaactgtttatttttctcaggtgtggtaatggtgttgtggttatatattcttgggaggcccatacttaaatataattgtgcaatctcctttggatcattcaacaaaacagttgtgtgtatgtttatgttaaaagagagaaggagacagagagagagaaaaggagagagacagaaaaagagagagagtgagagaaggagagaaggagaaaaagtgagagaaatgaagtatatatggaaagatgttgagaattagtgattctaagtgaggattatgcagatctttattgtactgttctttcaacttttcttcaagtttgaggtttttaaaagtaaaaaaaaaaattaccacatagctgaaggtgaaaacataccaattatggtggataaataacttaaacagggagtcagacttctgctcacatcccttatcataataaaattgcagaatctaagaggaagtggaatcttaagagattttagaagaaaggcagtctacagaagacaagcaatttaaacaggcctctcagcaacagccattagaaacctaaatacaatggaatgtaacttcagtgagctgaaatagcttaaaattctgtacctagccaatacacttttcctgagggtaaaatatatgtttgaacagataatctgggataagccaaaaacaaatactcagtaaaataaatgttaaaggtataatgtaaacagaaaaaaaaatccagatgtgaaagtaatgatacaaaaagaaattatgagcaattatattggcaaaaatgtgactaaatcaaagcaaattatgactatataaagccaaagtaatttgaaattttgtgaagaggaaaaatatctttcaaaaaactgattaaaaaattatatacacaataggaaggggagtaaagtaactgtatactatggcttttgagtagtttgaagaggggtaagttaattgtttttaaattagcataatcacaaaaaatatagatgcaaagtacaaatttctaaaaatagaggagaaaaatagaataagaaaataggaggcacagaattgagactccaagaatatgaaaaatacaatccaggtgatagagtaagattgggcaacagtgacagaataaagattgaggaataggtaaaccaatgaaatatattgttaggagagcatttccaagaccacaaagaaacttagcagctctcaattataaataaaagttattttatgataatactaaaactcttattgaatttatgagtgagccccgaaatagaacatgtttcataggcataagacttgattaaatcactattttctctaggagggaggcccctgtgacctggggggaagcctacacacagctctcactgatggacaagaacagtggccatcccagtcaaactaaacttgtgtgaagaaaaattaagcctagacatcaccagtctgtgacctctagtaccacccttgtacctgtatcacattctactggtataactcaaatataagttcagagtgaaagcactgaatcatgaaactaagagggtaacctgtagaagaagagccagagatctgattgcatgttaggcttcactctagactgtagcctctgaggattaataaaatctttggaatgcaaagatcacttttcctctgaataagatttgtgaaatctctagaattatgcactttcatatacatctgtggttctgcctaattttaatgggtactgccttctgattctgtgggaagaaaatatcatgggactttgaaatccgtcagttgattgcacatttcttgttcagtcaaaatttacttagaattccaagtgtgcatttactaaaactgtgcttgaagggttggtagtgggtgattttaattctctagtattatatgtgattgcagtctggaaggctgaactattttggtgatggccaaccatgcagtaagaaggttaacacaatttgcaatggtaatctctctttcatctacacatttcagtcaaccttggcattatctctaaggccgaatccaagtgcctgtaagccagaagccttcaggaaagagcagctgtttttgtgctctctcacatcttgaattctaggtcaaaatgtcatgtaaaagttttttcactaaaatatctatattgatttctaggaataaaatagaaatgcctggaggattctgtgtattttccctgtaagtcactgaaatatcctggtaggccatcaagaaataaaatggattttgtctccattgtatgattgagtcctcccttgaaatccttgctattatctggaccaacaaatgtgtagagtccagactaagagtggagttgattcagtgtatgtatccatgggattttggtcaacaaaacaggactacttaaagccttgttgggtaggggtttattataggaatcagaccttacacaaacacggaagcactaactgaagagaaagtgtttaagggggactgggatgatcagagaaagaatcactggctggttttcctgaagcgctgactcaggtagacaagaagccaagcatgctctactgccaaagtaggactctgaagggggcacttcagcaaggtctgtaggaagatgttgtctttggtggccactaccactgtgagtccacagccaaatgcccagtggtaggtttggggccaccattagtcagcagggccagctactgaaaaggtggactagattcagagaagaggagaataaggatacactgagtcttgctgggtacccctctacgtatcttaggcatctatcttatgaaaaccttctgaaagtagtagcttctgtttctcttcttccttccatatctcactgaacgtctctcttctggccaattctaatgtagaaatatcaggaaagggtattgggaaatgtaatactccatatttgcctgacataagcaagataatctagttagaagctggcaatttccttataacctaggacaattaggaagtagaaattagagtctaaagcagtctgcaaactaggaagacagtggcaaacaggagtaacaggaaacgaagtcaggtgcagtagacaaacatctgtcctggtgttataggttgtgccagtatatgggaggctgagggtcagaaggtttatgcaaagaaccaaagcgaagcaagatttacctctgaaatgacaggaggtcacaggtacatgaaactcaaatgcattacaggtttttttttttctttgttatccaaatataaagagcaggagataaatttcatcaccttttgaggtgtttgttaaaacatgtagatttctgaaacctccttgcagacctaggaaccggaatctctagggttttgattcaggaatctgcattttaaatacaatcctcagatggttcttctgtgcagtctagttgggaaatatatgattcgcagagtgacagattcatgctaacgtcatgtcaggtacttactgatctgcttcagcactgagaacagagactgaattagaggaccagatatataagtgatttttttttaactgactcatacagtagattttttttttttttttagagaagataaaattcaggctggagatggcaaataaattattcatgtcacctacctagtaagtgactgggcctatactctaatttagatctacttgactccaaagtgtaccctttgagtgttgaatggagtaaaaggcttcaggcttgcagaattactgacttgcttgctaaacattcatcagtgagacccctcagggaaggaaaagtaatactggtctcctattaaactaagtctgtgtggatttctaagaaaagtcctggaggccaacattcccccaaataaaagaactagtaatggaggaaggcaggtcctgaaaaaatcactcccaagaaaaatgagaacttcacactcgctttgttttctgccccctcctcctccctctctgtggacccagcacttacaactactatgacctcttccatctttatgtgtcttcatcataccaagtattcccctttcttatctgaaaaagaaaaaaaaagaagaaaggaaaaaaaaaaacgacatcttgatctcgtttatatggaattaattttacagttaataagtaaaacctaatattttttgtctacttttttgggagcaatatggtgaactcatattggcaaagttatttaatggttttatgaaggaatagataagtgtgagtgagaaagtgtggaatcagatcgcagctgtaaagataagctgaactatggcagcgcaatgtgacccctagtccttgcattctaatttaggttctgctgggaagctttacgagattattgaatacctttctagcaattagagctggcctggatggttccggttgccttgggaatttggaaattcttctatgtgaaagatgtttctgcaggagctgatcattatacaccgatgttacaaacaattaatttataaagtacaaagtttcaatttcacagtgtttattttgtttttttctgttagctatctgttcaccagataactatcattctttccatatcttgtggaattcctgctaggactaataagataggaactggaaaatagctttgaaaatagaataattactttgaaaatagaataatatgtattatatgatatacatacaggaaagtactcctgcaacagcaacaattgtactgattctaatatcccaaatccagcggctgctcttcaccctctctcctagcccaagccatcatttctaccagtttactaccacagtctcttaaatgatctgcctgtgttctgtctgcttccacaagagtccatcgtctactcaaagttgttcagatcctgtcatttccttgccataagaggagaatcaggacaagttttgccacggcatcaaggccccgcgtgatttgtcctcacctgttttcccagtgtcatctcctcacagtcttccttggttatctgcatttcagcatcacagacttgctttctagtccccaaatgtgcccacctcatttccatctttgtctctgctcttcccgttcatttccaatactacctcttcagagagacctctttaaaccagcctacataaatgaaccccactctctccctctatcctagtatcctgtttagtctttttattaccgtacttatcactgtctgaagttatctacttatgagtctctatgtgtattattagttttctgctattataccgaagtgcaagctcaataagggtaacgtctttgtcttatatcctcagttcctagaagaatgcctgtcagatactgggttcaatgtgcatgtggaataaatgaatggataaatggaaggaattcaattatatttgacatttggtaggcagccagattcagtgaaattatggaatactggtgcctcaaaacaaaaccttttcttatgtcatttcatatacgatagtgttaccaagtatcaaccttttcagccacacagcctgaaataatgaaatggaacatagtagttggacttggaaccaacttctgccttaagcagaaagctcatgcagaatttaaagcgattattaaggaaagaaaatcctcttcaacacccacagaaagatagggcattgcttttcaagtcataagattttcagtaattagataggagaattataaatatattatttgcatgttacacattcctgtaactctaaccatccaaatatggtttctatattcaaaataggtagcaatttaaatataaatgagacaatgcctcatacatacaatataatatttaacttaaaacaccgagatggttaattccgtgtgtcagttttgctagctacagtgcccagatatttggtcaaacattcctctggatgtctctgtgacagtgcttttttggatgagattaacattcaaatcagtggactttgaataaagaagattaccctcccacaaggtgggtgggctcatccattagtttaaggtcttatcagaaaaaaattgaccttccttaagcaagaaggaatgctgccagccaactacctttgtacttgaactgcaattcttttccgcgtctccagcctgctaatctgtgccattagattttggactctgcagtctccagggacaatagcatggcacagtccctaaaataaatttcccaatcttcctctctctccttctcttcttatttctcttaaattccctttctctttcaatctctctatctccctctctcctttccctatctctctatctctctctctccctctcagtatctcatacacacatacgtacaaatatatgtgtgtttacatatatgcatatgcattatatatatatttatacacacacatcttgtcctgtttctctggagcattctgatacagacacatttctgattatagatttaatatatactatattgtagtttaaacatatagatatatagagagagatttaaaatatactatgttgtagttcaaaatatactattgaaaaaatttacataacctgtccaaatgtttatttggctattaattcaattaaacagattgacctcatctatcatttctgatagattacttctaagaaacagaagatggtaagtaatatctcatgcattatgaagtcatttaaattatttaacatgcattaaaggagaaattcaatgtagctcatttcttcaggtttactaattaaagtcagtcttgactctagaaataaaaaaaaaaatgcgtaagaagagcaactgtgacagcattaatattcagtgaaattgatgaccttagtgggttagttttatataaactgttacggtacgtacaacttgtcactgtagttcaaagttatgttcaacacaatggttcttcttaattgctcaagacactccactgtgacattggctacttcggctgcaatagagagattaaagaatcaagtcattgtattttacagttaacaggattgctaataaagaatagtagcagcatgaaaaattgtagagaggcagtaaaactgaaagctcaagggtctacctgtatagactgcgaaatccatatactgcaccaagattacaaatggtgattaaagaggagcccacgatataatagattaaaacaaaaggttaggtgtctaacagaacactggatgattctgggaggatggggcacataagacgttataaaaacagagttatattccaaggccctttttaaattacaagaattacttgtacttttactggcattagtttttgcctgcaaatgttgctagattcatcatacttttagaaagctgattacaaggttttggtctgttcccatgaaattccatccccagattttgtgacagtagcccttcatttagcaaaaactcatgagtttcttctctgtaccagttgctgatgagcttagtcagttattttttatgctgtcactgtttagggcaaatcaaaccattgtctaaacagttcactttggaatattgtgaaaaaaataaagtagagatccacttaaaaatgttgaatgtggttcttgtctttatctttgttggtactttcctgtcattgccataatcattggctccattagcacctgactggccaatcaggtcagttgactttgttcatctgagccactgaacatttctaaatccagtctcatactgcacatcaactgtggttccccatttgtaaattaaaaaaacttaaccatgtctaacccacaggaaaataatagtttctttttttaaatatatatatatttttattatactttaagttctagggtacatgtgcacaacgtgcaggtttgttacgtatgtatacatgtgccatgttggtgtgctgcacccattaacttgtcatttacgttaggtatatctcctaatgctatccctcccccctccgcccactccgcaacaggccccggtgtgtgatgttccccttcttgtgtccaagtgttctcattgttcaattcccacctatgagtgagaacatgcggtgtttggttttttgtccttgcgatagtttgctgagaatgatggtaataatagtttcttagtttacttgttcactgaaggactggatgcaatggctcatacctataaacccaacactttggaaggccaagatgggaggattacttgaggctaggagttccagaccagcctgggcagcgtagagacactccgtctctataaggtatttgaaaaaaaaaaaaaatagctaggcatggtggcgtgcaccacctgtagtcctagctacttgggaggctgaggcaggaggatcccttgagcccaggagtttggggctgcagcaagctatgattgagccactgcactccagccaaggtgacagagtgagaccttgtctctaaaaataaaaatttaaaaagttattaattgaataggagtttggtgtgggtggagttaacagtcagtaccactaatctccatattttaatgtggtttatataaactataccaccaaagatataattatttatattgaaatatcagcatgcctaacaacataattggattctatgtttatttgcaatatgagtaagtcagaggaaaactgatagagtaggaaagtcagatttcaaaggtgaactgtataggaacttgccctttggtcttacagtgctgtctcctattattttaagcattcaccttaatgataccatgaaaagtattctcaaatgggatcatataggaagccaagacacagactgttttagcttaaagggccctgagaattgagattgttttgaattcctaaacactttccttatgttataggccaagcccaagtcccaaatgtgctttactctgttccactgagttttaaaactttgtatcagttaccaacattgaatattgagagttttgatatagagatagtaattttcaatttatttagaagattagaaaatgtggtacacatccctgcatgactatgataagctggagctgagaagctacaccctctttcagatgagtcctgtgatactcagggcttcccaatccccaccagccactttattttttacatcacctgcctagaaactatatcaaatgacttctcagtcccttagtctgaatccttcatttttcccatgtaataatttgagttatgaatagaaatagtaatttgcctgaaattgaggaaaatgaaactcccccttactaagccatcatgttatatccccttcttccttattataaaaaaaattatgctgttcagggtggatgcacgtttaagtcaaaatatagaaagtaaacaaaaccattaagttcttaggcacatttgcaaaaatgactcattatataacatgctatgttccaatattaaaaagcagaaatcagttggggatttctgggaaatgtttgctctacttcctctttttattccaactctatttccttctctgtcttcctatataaaacattaagatgaagctgaagcatttatatcatgatgacgaggtaacaattattgggacaaagcacaacataaatatcatagacaggaaagacagaagagtctaaatatcataaggcgttatgttttgttttttgttaaatatgatcctgactgacataatcctgactgatacacatatatatttcacttcccatcacacacacacacgcacatgcacatacacatgcacacacatgcacgtgcgtgcgcgcacacacacacacacacttctttgccctctttgcctcctcctatttattattttattcaacagagagtgactagtgcttactctatgtcaccatattactgcactggccctgcttctacctggcagtgatggagatcagactgtcacatattgcttctaaacttagtaggctcatagaaattaaaaatagcatgttctacctagagctttaaagatcattacagtggggctattagcactgtgaatgggaacacagcctgactctgggtaaaaaaaaagaaattgaagagattatatatgggagattctataattactttaacaaaattaagagataaggcaacaaagatctaatactgtaagtcccacctgcattatttgtgctgaaacaccatgtctgtacattggctgtgacatgtaataccactgaaacacagggtgtttagcaaacatttagttatttccttaagccacctgggctaacaggcaagggattcctacgtagatggctatactgaaagattttgacaccatttaaaaacattcttaggacttttgagtgaattatgttttcagattatttagtttgggcaggttaaacagactgtttttatacaaattctaaaaaagttgacaaccctgagcctcaatttccttctctttaaattgatgattttgatgattctgaattgtaccactattaagttcctgctagatctaccatgtttagaagtctgtaacgtcactctctaacgctgtttatttttttcttctttgcccctgtgtgcacactgctagctcttctattaatctcagcagatgagggaggtaatttcgtttgaggtcaccaaaactgtaggctataaataggaagtaagatagtcattctatagtaaccataaaaatagttctcatcacattgggatgaaacaaaagtcatgtcacctcactctggagacaagagatttatctagttatttgtaattcctatgggctccagatgcatggacagaaagaaggaagatggaaacatggaaggttaaagacacatcagggcctatcctttgcttagtgtgacacaatcaaaggaagaagaccggctccctttgggtttaaccgctttatcaagtgccgctctatacattacccagagaaatgccttctgaattctagaatttcaggcattgcagtaggcagttgaagttgtggcagcagcacataggaagctttttaaacctctccatgcagctctacgatgattatactcattcattagcctttttcaacaaacaatggtttagcagctggtatgtactaaacactctgctaggccttcaaatatggcattgcacaaggcaagatctttgctatgaaaagtgcaaatgtttaaacaataacaaggtagatgttgtattagaaatagtacatggtaaaaaaaaaattaacaaacaaaggactgggtaacatgactgagggtacatcttagtctgtttgtacactacaacaaaatacctgatactgggtaatttatataaaacagaaattaatttttcacagttctgggggctgggaagtccaagatcaaggcactgtcatgtgatctgatgagggctttttttgctgagtcctcacatggtaggaagagaaagggcaactagggcaagcctccctaacactgagtgaagccccttttaaaagggccttaattccattcatgaggcaacagctctcattgcttaagcatttcttaaaggcttcccttcttaatgctaccgcattgaaaacacatgaattttggaggtgatttacgttcatcgtgaattttggagggagcaaacacattcaaaccatagaaggatgtgactaatgcagtaaagattcatatcacttttattctgtgcaaagaaggaaaaacttattttatgttgttactttagtttgcatgtctgagagagggcaagtgatccctcacatctagcttactaagatttattcacttaaggtaccagaagaattctccaccagagcaaaaaaaaaatagtgagaacctaagaattccttcatttagaattaatcctctatatgggaaatatatgtttttaaaaactgaactcatagaagcagagtagaatcgtagttaccagggtctgtttagggtcagggtgggggcattggtgcgatgttggtcaaaggatacaacattatagttaaataggaggagtaagttcaagagatctgttgtacaacatggtgacgatagttcatatcaatgtatgatattcttgaaaatccctaagagagcagattttaagtgttctcaacacaaaaatatatgtgatataatgcatatattaattggctcaatttggcccttccaaaatgaatacgtatttcaaataatcatctcttacccaggtgatgggttcttaggtgcagcaaaccaccatggcacatgtttacccatgtaacaaacctgcaaatcctgcacatgtaccccggaacttaaaaaaaaaaaaaagaaacattaaaaagtagacaatttttgtcaattgaaaaaatttaataaaacttagcctagggtattctaggtaatttacatagattatcccaagggaggaaggataggtagtgtgaacctcttaaagcaaaggtggagtgaagtgagagttcagattagtggcgtggagagtccaacccagttggaaagcaaagcagtaataggagtcatatggaggattctcaatattcacctttgttgccttaacacctagcaggggtagaaggagccaagacttaatagattaatggagtagggacaccaacccagttggaaagcaaagcagtaataaagaccaggtggcaggactggcacaggtgagtactggaaacaaactgagtgagtccacattactttcattatcctctttaaaatgtgtctttccagcatttctgggaagagaaaaacaaaaccagagaaaattcatgcttctagggaaaaggagaggaaatagatagtgcaatagcaagaatgagagtattaatgacaggaagtaatgtaatcctaaagggattagtgaactaatgcttataaatggctcaagtgcctgggccaaatgttctatgtgagaggagctactcttctgttactttctctgagctcattaacaaccaaatggattataatgggcttcaacaggattaagtgacaatcaacaatcaaagtaagacaagagtttattatgaagaatattgtgttcaaagattaacattaaactcgtgaaatatattgtagaaacttcagattacattttgctatgattttctttttatatgtcagtcttcattcctccttcagaatgctctttttatgatgatttgtacataattatttttaggaacccattgatcaatgtcctagtaatatttcattcttttatatcatcttttacaataaaattaagttgctttcagactaatttaaaaataatctttggggttaatgttttgtttccaaattatgaaaaaggaaggaattcaatcaaatattgcattctattaccaagtggattttaagtaccatatgctgtgttttatgccctatattatgtagtcagaatgaaaatgtgctccatgttttcagaatatgtactaccttcatctttcacattatttcaaatagtgagaaaataaatatacatccattcttcctcctactttctttccttatatttatctcccaactagccaccagacattctctctacatttaatacctacaaagagggctggctgctattcaggtcatctggcaagtatcatgttttctccagtatggaaaaactaagacatatgtgttttgtttacagtgtgccaaatgtgccaattcaatgagtttttggatttgttggcaaaaaaaaagagagagactgaaaaatagggaacagcattttttcctgtggccagtggtcatttgttggcacaaggaatttctgtattataaatgacactcaattctctctttgatggcctcactttgagaacagattttgaataaacagatcttaggcacacagaatttcaatcgtcgaggtgtatctgcagaagtaattagatacttgcaagtgacttttaatcacttcaacttgaatccatgtgttgcaaaaagatgtactagctaatgtgattattccaggaacatctaaaagttttcactgagtaacttttttttgacatgacaacttcttatcgtctcgatcttgaagcattggcatccagataaaggcacatgctggcatggggaaagggggggggggataatccacttgacaactggtaaagataatcatatttttataatttttgataaataaattaacttacaagccttattatgactctagtttcttctccctttaatcagttacatctattactgccagagtaattgttctatttcatatattttgtcatataatccacctcctaagaaagactgttattgtttacagattatttctcttcttaggatgacacacaggtcctttcacatgtggtctctacttggtctcccagactcagctagcctccatgagtatttcctagtgtagccatattcaacacactccctgctccctgaggtgcccatgcatttttgcccatggtctttgtcttccagtagcattgaaggagaaagaggaggaggaggagcggaaaaggagtggggagggatgaaaagaggaggcccagagaagaaatgagaggaaagaaatgtccaacgaagggaagagaaagaaaggaagaaagagagtgagagacagaatttctccacatttctcaagactcacctcaagtgatctctcctcttcaagccttccctaaatcccctgacagagagccccatgccaccataccttatgctgtgtcaccctctagcaaatttacatggtataacaaagcatgcttatctttttctccattatagattatcagaaacttgagagaagggtctgagtcttgctgtctctgtgtttcccatcacctagtagtaactagtccaaaactatttttttgaaagaaggaatgaatgaaacctgcaaattaattaaaagcgagagaacaaacaaaataaaatagatttgttcaactctgtttgtataatatgaatagacttctaaattagtctttctagttggtaaattggaggaaaattaatgaacctgaaaaaatgaaaagtaggtgtcacattataagctttctgagaaaatgacttgaaccttttatccttgtgttatcctcctttcccggcgctgaattatcttctaaaatggtttgctcaagtagaaagttaattaatttttattaagcaattagaagaaggaaagcaattttcattttcaagtaaaagaattcgaaagaaacagaggagatgactaatcattaggaatggcttagacgccgaatggtttcccacatataccaagataaaaagaatgcgcaggaggaggatgatccatggagtaatataatactgtcagtcagggtacagacaggaatgtctgccctgtcagctttgatcataccatatggggactggaaaaggaaaagatggtgcttttttacacatattctctagcttccgtttatactgaaaagttattgtaaagagaataagcagatagtttccatggttggacagcctttgtaagttttgcagatttttattgtttttaccaacagtgacatgcttaattcttcaagttgccacactcaactgaattgaattttagtgttctgttaactataaaatataatgattcatttttcaaagtttccctgaagcacatcagttcaatgacatctgtaggttaagaggatgccttatgattcagatatatgagaattcgaattcagactctataattgaccttatctgtgatgttggacaaattaaattttatctttaaagactgtttttctcagatataatatagaggtgaataacaaaaatttaaaaatagctggaatagttggatacatgatatatgccagacattctttcaagtactttatagaaatcaattcatttaattataccaataagtttatggtttaagtacaatgattgcacccattttacagaggacagaagtgagaactagtaaattatgaattatttggtaaatgaagtgtatagcacagtgtcttgtgtacagtaggcagtcactagctggaaacagatattgcttatttcttcatgtattagtctggattctccagagaaagaaaaccaataggatatatatgtgtgtgtgtgtgtgtgtgtgtgtgtgtgtgtattcctttaatatatgtattctctaatacctttatatattatatatataatgtagatagatataggaattagcatatgaagttatagaggcggagaagtttcaggatctgtagttggcaagctggagactcaggagagccgatggtacagttctagtgtgagtctaaagtcctgagaaccaggaaagacaatgatttaagtttatagactgagtgcaaatatgacagcaggggaagactgatgtaccatttcgagaacagttgggcagagaaagcgaatcatctcttattctgcattttgtttgattcaagcctccatggattggatgaggcccactcacactggggagggctgtctgtattactcagtctgttgattcaaatgctagtctcattcagatacaccctgaaagatgcactcagacataatgcttaaccacgtgactggacaccctgtggtccagtcaagctgacatgtaaaactaaccatcacaattcattatggcaatttcaaagaaggaaaacattggcgaaattgtttacaaatgaattctcaaaataaatgttctaattatattttacagagacacagggggaaagcacaaatgatgatggagtctggtttatacttcacacacagaaaacattcattcaatgaataattgagatcatcagttaattagaggtggatatacaaaatttaaaatattgtgacaggtaattgaaaagacaaagtataagaagcattaaaatgagaagacaatttaggaaaagtaaagccggggatatgagggcaaagaatgtaaaatcagacaaatagacaaaacatacattaaaatttgtttaatacaagttaaaaaagaataaaaaattattcttagagtaataaatgatgactgcacagaagaaatatctaacgctagcattttatattttacccaatttcaatccattctcagtagcaccagtagttcacttttaaaacaacaaatctgccatctacattaaaaatgtcttagataatctccgctgtctaaatgaaatcctaattcctttgtactttatttaatgctcctaaaagtttttcttactcttcatttgcagcctcatttctggacacagttttcccaatatacaataaattctatccacaatcaacttctcataattttccggaaacacaatgtgtatgttctttctttctttatatttcttgtcttttctagatgattccattcccctttttccaactagtgaatcctcttccctagaaggcaagttgatgttgatgtgataataaaaggaatgataatgtcatgggaaagaagaggagaatgttggggattatagctctcttttattagttattttggccaatccctgtagaggatatcttaactgagtattttatttaattcttacagcaaacctcctttttgttatccatgttttattgttgtgaatgctatagcttaaagagattaaatgacttatccaaggtcacccagttaataagactattttactcagttcaaataccaaactgactttcctaagaactcttttattaagaataaaaattttaaaattcgtaaagccctacaacgttctttttatattgtatctaattatatcagaaatatttacacatcagtctactcaatttgattttgattttcttgaatctaggaatgagtttcatccaccctgcttcccccatcccctgcagtgttagcttcatcacaagcagtttataatcttttatttaacataaacaaatataaaaaataaattctaagtatacacgagtgaaggcaacatactcaatagtacaaacaagaaatcaaagcgaattgcctttgtcatttaaaaaatttggaggaattaaaccttattaaaattccattaataacgttttctattaataattcccttattaaaatactggaatgtcaatagatacaggtattgaataaaactaagcacataatttaatgatttttcctaattattattcagggaatgtctttgaaaagagaagtgcaaaatatacaaaaacagaaagatcaagaagcatgccaaattggcattgtgattgccaaagcaaacagaacagtctgtaaattattatttagggattggggtggctcttgcatcagtcacaaaaagtgtggaaattaaataatatgctttaagaaatcttgtcataagagaacacagcatacttcttcctacatctatttttaaatgaatttcttatatgattgctcatgaagaggaccaatagtagtctttattgtttataaaccaatcaatatctctcagtctcaatgtgtaacctctctgtcaccattaagacagcagacggcaaaggaggggcaataaattttagcatgtaacagatgaagtagctgatagggtcattagagtaactatcagggatagagaaagctgtctcccaatatcagttcccacaactttgacttttaggttgcatttcttcataaaattcagcctgatttttctaatttccaaaattctacacttattttctattttatcttgtctctttttggatgcttttaaaaattattcctctaagtgtatacttggaaaaaaaattaatgtttctttgcaacttcaccctttgattgttatatatgcattcaactggagatgaagttgggttgaaatctggaattcaagattattttataccaaagtatatattgttttcaggtaatttttataatgtcccaaatacgtaactttttaggctttatttaattatagatatttggccgaataagcacaatcgaaagtttcaattaagagtctaggacacaaagtttggggaaaaaaaatcatagtattctaataatatgtattgctttgatgctgtatgtctaaaagcactcatgaatacctagtgcacatgtgtcaaaataaaacttttttttagagtataacaagttctttagaaaactttttgcatcaaatggtgtaaaaatgaaatcattttatataaatttagaatctgtaaaaggtacaaattatgctttgctcatcaattgtatttatttacatctaatcaaccccatcttctgtttcctactcaatattagctctattatttgattggtttggatatataggggcgtgttatcaaattatacgcacccttgtccttttcctcctttcataagtttccttcaaatttataattcttattacttatttaaatgaataatgatggagaattaataaatagaataaatataaaaagatattaatcatataatcgctcaacacattcctactgaattgattttaatttttgaagaattatcatattatattgaataaagaattagctctcaaataaatacaaataatttcttaggggaaggctgaggaggaagactgaatgagaaggagctttggcaattgggtgttaaataccatgggaaatagtcaaactcatagtagataagaatagaatgaatgatggttgccagggactgcgtgaggagaaaatggaaaattatttttcaatgggtataaagtttctgttatgcataataaataagttctaaatatctgatgtgtaacatagtatctatattaataagacagtattgtgcactttaaaatatgataagagtatacatctcatgttatgttcttaccaaacacacacacacacacacacacacacacacacacacatttattaccttgattttggtgatgatataatgggtatatgcatatttttaaactaatcaaattgtatatatttaatatgtgcagttcatgtgtatcaattatatatcaataaagctaaataatacaatggaaaattcagaataagacagagatggattgtgaaataatgttcatacattgtgttagtttttcttaggctcaaattggtgctaatttttttttattctgagagataaaaagctgaaggtttcagaatatcactaatgttttatatgtagttctgaagatttgtacaaacctctcttccccctttttaactttatataaaaaaggagaaagatcaatctgtcggtatgagaaaggaaaattataagttctatctggggatttactcgtcattaagtttgtatttcaatattgcaaaaaactcttggctatgattagagatattcatattaaaaattcagataatgtagactgttatgaagaagaagtttcaaattagctgaaataagtttcaaagtcagttaatttgttaccagcgggagaaagtcaccattatatttggcgtgtattcctgaagagcatacataagatagacataaacacaactacaatattggaaggtttgcttatttattttatagaaataatcattctgtataaaatttgagaagtgcttctttcttacagtttatcatgaccatttttctattatgatggttgccagggactgcgtgaggagaaaaatggaaaattatttttcaatgggtataaagtttctgttatgcataataaataagttctgaatatctgatgtgtaacatagtatctatattaataagacagtattgtgcactttaaaatcatggtagacatgatttattgtagattatacattttcccatcctaagaaatgcatagtttttgcttccattggcattaaataataattatgtataaggaataaatttaacataaacctcttttatttgcttattcaaatttatttaaaaatttgaatgtttgtacaaacctaaaagtagataaagtgagaagaatagcagccataaattttctcagaaaattacatgaaaacctaattaacagctggtgataacaatggtgaaactaacttcccaagattttaaaatcagtcatttaaaacttacactgtcaaacatcaagttcaatattcattttagtatgcgactctgcaatcgacaaaaatacatttcttttaatttatgaaacagaaaatatggttgttttctctatttcttctcttaagacattatttaatcatctgtatctttcttttattgatctcttccttttaaaatcttcattactcttgtcttttctcccagctagtccacttgctctgctttatcctgttatgatcttcttctaatgctcaaccaccattccaaaagggcttcttcataatttaaattaataatgtgagtgtgtgtagaaaaaaaagcgtagaagttttattttaatgtttttgagcaacctaaatgcgtggaagatgcatcatcacgcaattttaaaaataaaaatgatagattgatatattttaatttgtattacatgctatctgcttatgttcttcacatgttaatggctactgaaaataaaaaccattacaaaattctcttgaagcctttaaacagaagaaacaaccttgtaaaaataaatatttgtctatgtgtctgaagagaaccttcttccacagctgtgtggaagaaccttccacagagcataggtacatgttgcccttttttcaatatttaagatgttatatgtcatatttaaattgttgtagtattccaagacagtaaaactagtgatatatttaatgtgacaataatgtgttaatttttatttcaagacatcttgtatgaactactatttttgggaagaattcacctgccctggattgctatgctctatttggaagtacatatccaaatatcagtcatttatctctattcctaaagtctagtaaatgcaacaagcaatctgaaaaagagaactgcagctgcataaaatgagcataattgattactaattgatatgcatctaatagagacttctttctacccctttagtatctttttatttattttgaataatgttttcatgtttggcccatttccttgttctttctccaccccaatctcccttatttatttaggtcaacttgacaaccccttttttttttgagaatgaattcgatgtcttaaaatctctctctctttttatatttattttagtttggcagcaaacattagttctcgcttgctatattttactcatcaaagtgttaacatcattcataaattattaccaatggtaggcactggttgttatcaatcaccagggaataattgatgctgattgaatcaaataaatgtggtgtttgtgaaactatgaccttgtcattcaacttgggtacaaaaatctattagatctatgagaactgaatcttaaagataactgaagaaggcagctttctattgacttaaacaaataaaaatgtctttttatttgaatatttctttctttacaatacatgatagtctaaagctctgaaaaacaacaataaaatcactactaatctcccttatgtgagactaaatgaagggtcctgggaatattaattctgaaagaaagcttgtccagcctcccattttataataaactatatcaattcaaggactacacagagtaaattttttcaagttgtatagttctctggtttgaaagtgtcccccaaagtttatgtgttggaaacttaatcccgaagcaccagtgttgagaagtgggacctttcagaggcagagccctcatgaatggcaggattaatgccattattattgagtgggttagttatcatgagagcagattcctgataaaacggtaagttcagcctccttccctctctcactcttgtcttctcttgcctttccacctaaagccaggagatgacttagcaagaaggcctgcatcagatgctggcaccatgctctcatacttcccaacctccataaccataagtcaatacatttctgttctttataaattacctagtctcagatattctggtatagcagcacaagtgaactaagacacatagtgagcctttagcagaaccccattttcctaccaacctctcatgtcacctcccacaatgtgcattttcttttatttatactaaaagtgaccaaaaaaaaaagtttagaattgaaactatttccagttggtatcaagatccagatagagttaaccttaatatatatgtgtaaaaagctacaattcaaccgagtctctaaggcttcaaatatgaaaagaaataaaatgtgtttgttgttttgatttagccacaaatcagtgatttaatttagctactcttttccaaatgactatgaatttgatactgagtcagtgctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccaactatggtaattgttgctcctttttttccccctctctgtttcacctgctcaatgtttaacataatcaaggtgaacttttttagagaggcttgcttcatttttcacattgctatgaccattcctacagtcattgtcaaatgcagtcataaatcaaatatctggacataggagtttaggctaagtaagttacaaagttgttttggcgtccaaaacttaattgtataaatatctccaggggatggagatttctcccctgaaaatagagcacttggaacagaaattcagattgcttatttcatataatacaaattccttataaaacaactctttaatctacttaaaatccaatagcccattaaaattatcatcttatcttagaccccattataattcttgtctcattccttcctttcattctctctgtctggcttttttttttttttttttttttttgctaatttttattttcttaattgcattgcatggatgtgtacattttgtttattctgttttgctttgctctgatcatgagggtctttatacttggaaataacaaagtgtaacttaaaaatacaaatatactttttgtgccacatttagagaccaaattcttgattaattattggatcaacatgagttctgggataattcttaaaaacttagtgtgtcatcatgagaaaatcaaggataaccattatcagaagtaaatgtgcaaccagttaaaaattcatatattataggccctaattttatttctctgtccacccaggctggagtgcagtggcgtgatctcggctcactgcaaactctgcctcctgggttcaagtaattctctgcctcagcctcccgagtagctgggattacaggtgcccaccaccccacccagctaattttttgtatttttagtagggaccaggtttcaccatcttggccaggctgatcttgaactcctgaccttgtgatccacccgcctcagcctcccaaagcactgggattacaggcgtgagccaccgcgaccagcctgaaatatattttaatttggttttgcacatcattaaattggtttcccatcatctttgactagcctttctatagttcctgtatttctaagttctcaacatggaaatcaactagttaggatacaggccggtcacctagactaccaatcatctgaacttgatttggaattgatcagtaagaaaaagcaggctccctgcagtgcttctaagttttgttaggtgaatggtcacaggatattttgttttcgctggcatcagttgttgtgagtgaagttcctagcatagaagtggcttttgtagtcctgaagcaggtagacattttctataaaggctctatggagtagaagttattgtttcaacagccagtttcatggtgtggtttcagccaacattcctagaagcttagccctgatctgggttttttagttctcccaataaatttatcagctgcccacacctttcattttttgccttcagttttattgtgctataattgacaattaaaatttcatatatttaagatgtgcaagttaatgatttgatggacattatgaaacactcaattaccacaattaagcttattaacttctatcacctcctgtagttactatcatctatttttgtgtgataagaatagttaagatctatcctcttagcacatttcaagtatataaaacagtatcaactatagtcatagtgttgtgcattaggtctctagaacttacccatctcacagaattaaaattttatgccctctgactgagagcttctcatttccccctcccctcagctccttggcaaccaccattctactttctgcttctatatgtttgatgattttagtctccatatataagtgagatcctagagtatttttctttgtgtgtttggtttattttactaagcttaatgaccttcaggtttatccattttgttgcaaatgaaattatgttcttcttttttaaaaattaacattttgttgcatttataaaccacaccttctttatccatccatccactgcaagacattttagttgtttccatattgtggctacttagtgaataatgctgaaatgaacacagttgtgcatagatctcttaaggaccctgattttgtatcctttgaaaatgtgccaagaatcaaggttgttgtatcataagatagctctatttttatttttgttttttattttttttttttagcaacttctgtattgttttctataatggtcataccaattcacatttctcaaaagaaacatacaaatagcaaacgggtatatgaaaaggagctaaaatgaactaatcatcaggaaaatgcaaatcaaaaccacactgaaatatcacctcatacctgttagcttggtcattatgagaaagaaaaaaggtaagtgttagcaaggatatggagaaaaggaaacccttgtacactgttggtagaaatgtaaattgttacacccagtatcttttttaatacactccctttagctttaattaggtaaaatccaatattgttgcttgtagtcaagaattctggtatggccttcctcaaactgttattcaattaaaggacacccgaagatatatgaacatagaatgatgtatgtaatatatatagaagtcaagaaattctagcttaggtcctggctccaatgtgttcttactgtatttgagcaaatcaattaaattttggcacttcacttttcttgcatgtagaattgttttgagaagagaaatttttattttttattttatctttttttacaatttttgtgggtacatactaggtgtatatatttggggggcacatgagatgttttgatacaagcatgcggtgtgaaataagcacatcatggaaaattgagcatccatcccctcaagcatttatcctttgagttacaaacaatccaattacattatttattttaaaataatgaaaaaaatgcaatgttttaaatttctttttgttcttctcagtattttttaaaattcttgagccaaggatatatatttcatatttaaaagatgacttcttattcttgatgcctatattcttcagcaatgtataataagatcaaatgaaaaccaataattaaatgtcactactgttcttgtgtgcctaatgcatatgcattccattgtttcatggtattcgggtctgttttccttgcacaacttttcattgcgctagtcttgacttttttctgtcaaggaagacatctttaaaaggtacatagacactttataaaaagttgttccttctgggcacttatgtccataggcgaactgcttagcaaaggctcagtggcttgctgtattctggtagaatacagccctgtgcaagaatatagccagagtatagattgacattcggccacctcttattctctaagctgagttgttttgtgtagagaacaaatcacacaatcatatgaagaaggcttcttatatctacatataatacatacaggctgggcgcggtggctcacgcctgtaatcccagcactttgggaggctgaggcaggcggatcacgaggtcgggaggtccagagcagcctgatcaacatggtgaaaacccgtctccactcaaaatacaaaaattagccgggtgtggtggcgtgcacctgcaatcccagctactcgggaggctgaggcaggagaattgcttgaacccgggaggcagaggttgcagtgagccgagatcgtgccattgcactccagcctgtgtgacagagcgagactccatctcaataataataataataataataatattacatacatatatgtatttatctacattcacactttatatcagtgatgatattaaaattagacatttaaattaagtttggtaagtcatttcattttactagaatttaaattactgcctacttcttacaatttaaatatgttaagagactttggaaataattggaattcactaataactttatactgaaaaacattttcaatttgcccaaattgtatactaatgaatataatacataaggtaccaaaaaagtatacttaagaattacaaataattaccaatgttataaaatactatcaaatattgattacaaatttttcaaatttttggttcatcagcagggaaaatttttatcctctggaaaatctaagtatggatatgggttaaggtcctgaattttattattattctcactatcagttgttgtaatatttagaaactataattaacaataatgcttaatgtatatctcccacttttttattgttcctagtactatattgagaaaaaaaaaactaataataaaatgggggcaagtactggggatttctctgtcaagcaaggaaatgcttttctcaagaaaaatctggaagcttgtcagtagaatgtgagaaaggaaagacagttggtatttagctgctgagctcaccacctcctgtgcttattacattcttaattgtttctctcttaccccaactgggttcatgatgcaggaccaaggatgtcaaagtagcactagtattttcagagcagtgcattagggcaacctaatgcctgatctttccatcctaatcttaaaaatgctcaaaccccatgtctaagcttttgctgttcaacacatcgccactagtcacatgtggccattcatatttacattcacattaaataaaattatatattcagtctgtcagttgtactagccatgtctcaagtgctctagtcgcctatggctatggctacgatatagggcagcacacactgaacatttatatcattgagggaagttctattaagagtcctgacctagcacttacttaaatgctaatttgtatttttaacttacagttccctggcatcttgcttgaaatactctggtgacatagtaaaggtctcattcccatactgaatgtgttctttccatttaatagttgccactaggtaattagtagtgtctcatgggatgacagacagcagagcacagcagtcacaatgttaccgtgttttagcctgtaaaccttttgacaaaggcacatgttcctttatcacaacttgtttgtcaaagtagagtaattaacatattgcatccaatctgagataccatcaattgaaagatataccattattttgtattttcatgaacaattaaattaatgacattccgtttggtctacagtctgcccaattccagagatgttaaagtgtgaaaaaagtgtgcaccttaggtttattgaaatttaaaataagaagccaaacttttactcatttccaaaattgaatcttattgcaacatacagaaaatgaagcaacttaaatatagaaaaccttgcttgttagtgtttcaatggattgagaggcttcttaaaatacttctctattcctttattcattttatgtatcttgctatattttaccccactctaactctcttgcttttgggtgttcagttacacatacgttagaatattttatattgctccaaacttttttcctaatacttcttctctttgtattttaatttgagtaatttccactaacctatcttcaagcttaccatttttttaatggtgatatcgaatctactaccaatcagtggcaatttatatttctgttttttattttttccatttccagcatttcttttttttaatttcttttttataaattgtttattttaggtttggggtacatgtacaggtttgttttatgggtaaattgtgtgtcacaggagtttggcatatagattatttcatcacccaggtaataagcatagtacccaacaggtagtttttttagtcctctccctcctcccatcctccaccctcaagtagaccttggtttgttccctttgttgtgtgcatgtgtactcagtgttcagtttccctcataagtgagaacatccagtatttggttttccgtttctacattagttcatttaggattgttttagtccattttcatgctgctatgaagcatatctgagactgggtaacttataaaggaaaggggtttaattgattcacagttatgcatggctggagagttctcaggaaacttacaatcatggtggaaggcaaaagggaagcaggcaccttcttcacagcgctgcaagaaagaaccaacaggggaaaccctcacttgtaaaatcatcagatctcatgagaactcgctcactatcacgagaacatcatggaagaaaaccacccccatgatccaataatctcccaccaggaccctcccttaacacctggggaattgcaattcaagatgagaagtgggtggcaacacaaagccaaacatatcaaaggttatggcctccagctatatccatgatgctgcaaaggacataatctcattctattttatggctgtttagtagtccatggtatgtatgtaccacattttctttgtttagtctcctgatgatgggcatttaggttgattccacgactttgctattgggaatagtgttgtgatgaacagacgtgttcctctgtctttatggttgaacaatttataatcttttgggtatataatgaataatgggattgctgggtcaaatggtagttctttcaggttctttgaaaaatcactaaattgcctcccacagtgtctgaactcaattacattcttaccaacagtgtataagcgttcacttttctctgcaaactcaccagcagcagttattttttgactttttagtaatagccattctgactggtatgagatgactggaagaaggtacctgcttcccttttgcctttcaccatgattgtaagtttcctgagacctctccagccatgcataactgtgaatcaattaaacctctttaccatctcattgttatatttgcttttctctaatgattagtgatgttgagcgtattttcatgtttgttagccatttgtgttttttctttcaaaaagtgtttgttcatgtcctttgcttaatttttaatatggttatttgtttttacttgttgatttgtttaagttccttatagattctggatattagaactttgtcagatgcataaattataaatactttctccagtctgtaggttgtttgtgtgtgaatagtttctttcactgtgcagaaactcttcagtttaattaaatctcacttgtcaattttcatttttgttgcaattgcttttggtattttcatacaatcttttccagtttctatgtccagaatagtatttcctaggttattttccaggatttttatagtttcagggttttcatttaactctttaatccatcttgagttggtttttgtatgtggtaaagaaagggtacagtttcattcttctccaaatgtcttgccacttatcccagcaccatttattaaaaagggagtcctttccccattgcttgtttttgttgactttgtcacaagattatagttgtgcagctttatttttgttttcttttacgtgttccattggtctatgtgtctgtttctgtaccagtcccatgccattttggttactgcagccttacagtgtagtttaaagttgggtaatatgatgcctacagctttgttctttttgctttatttctagcacttttatttccttctttcttatattatattatattcttttatttcattctgctgccatttcccatctaatcatgcatatgtcccaacttgtccactagattctttaacatagtaatcatctatatattaaatttcacaggtgggaattttaatatacagatgattaatatgttaaatatatgtgtcatatataagcttagttctattgttttatcttttgacagtgtattatttattttacttgcatctttgtgtatcttataattttggttagaagccatatatcttcagtacagtagtagaaacttattaaattgtttatatactttatccagaaattaccttttttttggtaagccctttattatagggagttgtgccaatattcaggtgctgagtgctatggtttgaatgttcccgccaacattgatgttgaaatttaattgccattttaacagtgtggagaagtgggacctttaagagatgattaggtcacaagggctccacttttataagtgaattaatgccattattgagaaagtgtgctcttgataaaagcatgaatttggcttcacttttctctctgtcttacatgctcattcaccatgtgatgccttccacaatggaacaaaccccaccagattctggtgtcatgttcttgaatttcccagaccccaggagcatgagccaaataaacttctatttgttataagttatccaggctgtggtaccctattatagcagcagaaaataaattaagacactgagtttctggtttgctgcttctggtcactctcagttcaccacaggcttccaaactctctgatttaccttatgtttaaagggtgggctggtctgtcaggtagtttctctcgatgtctcatccactctcaaattcagatctcccatgtgcacttctgtctcagagaaggtcgttctttccacactcttataattccccctggctgtagactgttttgtattactcaacactttctagcctagtgttggcagaaagggaggatgacatttttcatttttctgttttactatcagccttaggtaggaaagtatgtcatgagttttgagggtagaacccaatatgaaaatcctactgttcttttatcagtataaacttatttaataatctgtgcccagaatgtatttcaggccttcccttaggattttttttcttctatttctcctgagggtagaagtatttgctgctattttgcaagtggtataaagcttttgttctacagtaaatatagaaaaggatctggtttcttagactaggggaatatgtgttattgttactgttattgagtaggacattgtaacaaatgtaatctattgctgatgggaatgctattagcaaaaggtgtacatttggttttggctatcagttgagaagtaatctatagcaaataagtaaataaaagcatgatgttttattgtatttaagtgtttaaggtcaatagcttgatcttcagagataaaactaaaactcactattgaagagcatgaactagacagtcagattagttgtgtactgtagttaatagaaaggataagaatgcaaacgggaaaaattaaagtcaattcttagtcttcctgcgttaatttaaattgtgtttgcaagtgatttaaatactttcccaaaatgtcttaaggaaaacgacttaaatggttcatatagtcagaaagttcccaggtagttctagctcccattgtgacttaataatacatatctttatttatttttcttggtttctttttccatcattttggtcacacttaagacagatattctctgtggtggcaaaattgctccagtaatgtcccacgtctttccagatgaaagtgcagccagaaataatgtttgcttctgttccagatttgttatcaaacattgcatgatgcttattagctctgagtagttacatagccattgtatcagtcattgccaccatagcataatcaagcctctgacatggtatccctggcatctgagaagagccagattccttctaaacacattgacaaagagtgaaagaaaactatattccaaaacaatattagacatttttaggagaaatagaattaactgatgccagttgtctgttttagtcaattgggggtgctataacaaattaccacagatgggtagcttaagtaccagacatttatttctcatagttctgcaggctgggaagtctgaggtcaaggttctggaagatctggtatctggagagggtctgccttttggttttcagatgcagtcttctcattggatcttcacataacagagatcagagaataagcacactttcttgtttctcttataagggcactaatcccatcataagggcttccagctttatgatctaattatctctcaaaggccccatatccaaatatcatcacattggggattagggttttaacatataaatttggatggagaggacacaacattttgtccacagaagtggccaaaaaaacaaaaatgactattgtattcaaagatcattgatagttttcatttacttgatatttcagaaactcattttctcatccttttctagtattcatgtttctctagaattcaaagacatactggtctaatattaaactgtgttcaccatgccaatttaccccagtttttgtaagctttttatcttaggttcagtctaagagtaaaaagcattgtcttttattgtaggttgcaattttgagaggctaagttgtgaaagagcagaaatgtgactacgtttagaatcttcttttgcaactaactttacttttaagctgttttatgctgagatatatacctaccacttaaaatatctcaatcaaagtctacgttaaagctgccattctcaaataaggactatgtattcatttgtcatttaaaatatattctatcatgtaatcctttcagtcaattcatggggaagataatattgtctacttgatgctgacattgctctgatcccaatgataggccaaataaaagttagattaaaaggcatctccctctgacttcaaaatttttgctaattttaatgtaatatgatatgtggatgaacaggcaaaaaattgagtcacatgagttttcatgttttagagaaactattggaaaaaaattgttaagccatgtttgagaaataaagaatattcctggtttctaatattatacaaacctcagttgattattttaaactagtgatgatattcagggcatgtctaaaaaaacactgggagtataactgtgttcatggttgatataattaattttgattcctgttttcattgttcataaaattataattttcaaagtatttgaattctaaatgttctgttttatccagtttttctttttaaattcatataggtttttaactgggtaaatgagtaagaaaaatatatacatttaatatttgagttctggtcttaaaataactataacagttttataaaccaagatgatattttaatttaattatttaaaaaatatattttttggtttgcattgacttactaaatagatttgcagttcagaataaatcataagtaaatgttctaacttgaactaggacttaaataaaaaattaaattaattcaaagttttcattcaaagtctagttttgtgctagttcatttggtagcttttagcctcaaatagctattgagcactggtagcatggctagtgctacattttgaaataacaatattttagatatgttacattaaataaaatatattattaaaataaattacagctgtttattttcagttttaatgtgactgctagaaaatttataactataattgtagcttgcattctattagacagcactgactagatcaatctgcagatctagaaatttagaaagccctttagattttaaatcttctaaaccgatgcctacaaaacaccaatatttaaaatcattttctttctcttagctaaccagcagctttgtgagaatttttattcagcatttctagagaccagcagctttgtgagaatttttattcagcatttctagagaatgctgaagtcactgaatctcaccacttgtgccccatctgtatttatgcaaatggaatagtgtgacaactgatatgtaaaacaatatattttattatgtgcatattctgttattcatagtgtattcaaaaccacttataaggcaaaagaactggtagatgagattgtctaccatcatatactcagtattgacagctgagaacagttttcagtagtagaaatatgtgcattttcttgagcataactagtggaatgttgaaaaagtagtactcattgaggaattatgccctgtatttgaaaatcttttagttattccattatagaccttggtgtgcttttgaggtgctcttgaagtgataaagtctttgttatgttggttggttggctggttggatggttaattaatttggtatcttggtgtcatatttcattagcagacacacttgtacaaaatactctatttttttttcctatgacctaatcaggtcattttgtttgtgcatcaagaggcatgatacccatttcatgtaaatcatttctagatagttagaacataactgtaaaaaatattgaaaatgaaggacaagggcaagaaaaaaatgagctctttaggaattagaacaattattattttcctacagatagcctaagaaaatgatgcacagttaaaagagactaactacaacatttaaaaatttttatcttgtccctgatgctttcgtttccttccttgattgattgtcatcatggcgccccttctttctttctttctttctttctctctctctttctttctttctttctctctttctttctctttctttctttctttctttctttctttctctttctttctctttctctctttctctctctctctctttctttctctttttattgagacaaagtctcactttgtcacccaggctggagtgcagtggcctgatcttggttcactgcaacctccgccacctgggttcaagtgattctcatgcctcagcctcctgagtagctgggactacatgcaagtgccaccacacctggctaagttttttgtatttttagtagagactgggttgcaccacgctggccaggctggtctcaaactcctgacctcaggtgatccgcctgtcttggcctcccaaagtgctgggattacaggtgtaagccactgcgcccgactatcatggcttatattttaaaaagtagttatgcagttatatataacaattaaaaccctcgcctacatagcttaatatgagtctctggaaaattttttcctctactctctctccaaaacagaacaatcattaatgatatagtttgggatttaattgatatcctttgttatactgtatttccaatgcagccaaatgcgattttattattcagctggctatcttttattcaatgtcaggatgagttaatcactttctttctaatagttaccacatatcagtgagttaatgtcatgatgaatatatccagaaaggaataacataggctaaaatagaatattataagaaatattctctatctgcctgtttcacttcaagtattataatattgaatgcaattgctaattaaaagtttagggagtcaagacatgcctaagagtacccagataattgacctagataatcctaataacaagttaggtgccttaaccaagtcattgaaagaatcgtatttcttctgtccagtcgtgtgtcagccactagttgttaaatatctcctgatacatttcttaattcctcactctgtttcctaaactgttcggtatgtaattgttacctggactctaaagtttctttttgtatggactaggtgtgatatttcaaacctgtgctttttactcatattttgggttctgactgtgatatagcactgggaggagattgtaaaacatctgttgagagtcactgccttatctatagtctgaactaaaaatgtctctcttcagatgactccaagagttcatatatttataaattgtatctaatgatttttatgattcggaaaatttgaagaacgtcagagtacactttaaaaatggaggaaagtggccaggcatggtggctgacgcctgtaatcccagcactttgggagaccaaggcgggtggatcacctgaggtcaggagttcgagaccagcctgaccaacaaggagaaactctgtctctacaaacaaaacaaaacaaaacaaaacaaactagctgggcatggtgacgcttgcctgtaatcccagctacttgggaggctaaggcaggagaatcgcttgaacctgggaggcagaggttgcagtgagccgagatcatgccattgcactccagtctgggcaacaagaacaaaactccatctcacaaaaaaataaatgagtaaataaataaataaataaataaataaaggaggaaaggaaaatttggagtcataaaatcagttttctagtgtcaacatggcttttggaatcaagcacaagtgggcacagaaataaagaaaacaggcctacatacttcatgatgtttttttttttttaagatttttttcttatttttcttatttttgctgtaaatcgtatgtactctctccaccttgccggcagttacatgcttgtgacatgtatccttcctaagagggaaaaaatgttaattactgaacctcagattctgatgcctggtctgatttatagtttatgggtgatgtgtttggcattttcaaggctcagttggttttgttgagcttcaggactgaagacttggtcccttaaagaagaacattctgcttttagtaataaccaggttaatgtgggccacatgccagtccagctgaatatgcatgaagtgattgaaattgaaagtcagttccttacatgtttgagtttcatgctatgaggaaccttacaaatagaggtcagagggatttttatgttgaaaatcagtagagtgttacctttgctatggaagaaaacaactttcttccgatattaatgtcagcattagagtaattgctctgtgaaactctgtctctagagttccattctctcttgaacaacaaatctttatcatcaccttagtattcaggtcatttttcataagtagcacataaagaacacattaatctttatagatgtctgcctatatttttatctcaaggttagttattgtcaaatattgtcaacccacagccttttcctttgccaagagttctctattaactcctccaataacctcccatcttttaaaataaaaacattgattttccctcaaagatgttatcattacctggaaactgaggcaaacaaagttaagtcatgtgttcaagttttcagtgtaaatgctgaaccagacacacaatccacacatatattttaatccacaaactcactattaaagttataatgcagactttgacgaatatgacgagcaacatattaattaaaaacctgaacaagtaaataatgttcatgaccaatataaatggatgctttaaaaaaaaatgactcaaacagatgtcatcaagatggcttactagaagcctctagcactcacctcctccacaaagaagaaccataacagcaaaccacacacattgaataggatgtttaagggagaacaatgaaattcagcaaggaagtgatgaagaccatctgaggcatggaagcttgagatggtagcatagagagggaagcaaagaatctggccaagattggctcagagccaagaggtactccccatttctgagaataggtgagtggggaatgccccaaagcccacattttgacaacagatacctgcaattctagctatagtagagcccctcaggcctcataggccctaagttcaccagagggagttgcctggagttcataggattttattatcccagagaaaaaaaattaatgctagatcaccttcactcgttgggacccaggttattgcagcacaatgacattttgagagcatggtcaccatcagagtacatccttccctgaggacgaatagcccctgcatttccacatccctggggcctgacatccatcccacatccattcagagggttgcagtgttgcgccaccagctggacccaatagttcagctgtgactgttgtactgaagcacatgcaggaccctccatcctagagtataaatagtctagcacagtgaggaagctttcccccggacggagaaagctgacatgcatattccccagagccttcaagccaccagttcaaggcataacaccacaaccagcaattacatttactccagcagcagagatgccatgaacttgtgcatttacttgaagggtctgaaggctggtctgcctggtatccccacctctgagcaaacttgtgccatggcaaataatcacagaatggccacaaaggcacttagagacactgctgacattgattaccaaataatttttatagagactatattactgtgcccactcagaaccaaagccaaagtattttatccaagtaaaactgtaggacacacatagagaaaaagatctttccctataaaagctacttcataaaactggaagaagagattgttccaccagatgcacagatattaacataggaataccaaaaaaaatatgatttagaaattcaataaaaagatagctgtattaaaaaagaaccaaacagacatattaaaattgaaaaattaaataaatacaataaaaataagtgcttcatcaatagactaaattaagtagaagaaagaatttctgaacttacagacaggccttttgagataaatgcattagccaaaagaggaaaaagaataaaaatgaatgaagcaggactacgggacgtataagaggacattaagaaaacaaatattggaatcatggaagttccacattaagcagagaagaagaaaaacatagaaaacctgtttaatgatgtaatagctgaaaactcaattcttggaagatgtgtggcatgcagataacaagctcaaatatttccatgtagatttaacccaaaaatgtcctctctgaagtacaataaataactatcacaagataaagagagacttctaaaaacagcaagaggaaagcatcaagacacctatgaggaaatgtcaatcagagaaacggtaaatttgttagtggaaactatacagatcaggaaataatatgataatatagtcaaaattcagggaaaaacagacaaattaccttccagccagaaatataacactcaggcaaaactatcctttagaaattaaggagaaataaagtgtttcccaggcaagcaaaaattgagggaattcatcaccactagactggtcctacaagaatgcttaagaaagtcttacatttgaaagcacatgggcaatctctaccattataaaaacatataaaaatgtgaacctcactggtagaacagataaataaatgagaaataaaacagaatcaagttaaatcaatatagaaaatcaacaaactgcaaagataagcaataagagaggaagaaagaaacaaagaatttgtaaaacactagaaaacaatgtaaaaaatgataggagtaagtttttcccagtcaataactgactagcatgtaaatgatttaaattccccaataaaaagatacagaatggctgaatcgattaaaaaacaagactcaactatatgctgcccacaagagactcacttcatttgtaaggatacatgtagactgaaagtgaagagatggaaaaagatatttcatacaaatggaaataaaaagtgagcaggaaagctatatttatatcagataaaatagactttaagtaacaaaaaaagaaacaaagaaggttattgtgtaataataacaagatcaattaagcaagaggatataacaatgttaaatatgtatgtacccaataccatagcatccagatttacaaagcaaatattgttagaactaaggggagagagagtctccactacagtaaaagctggggactttaacgcctgactctaagcatgaaacatatcatctagacagagagtcaagaaacataggtcttaaactgcacttaacaccaaatagacctaaaaggcatttataagtcattttatcctttagctgcagaagacacattcttctcattagcacataaaatattatttagcattaattatacttagagccaaaaacaagtctcaatatatttttgaaaactcaaaattatatcaagtaagaggaagcagagcataaaactttagaaaattttcagtctgatgatgcaatagaaaagaaaaacccattttctgaagagaaattcaagccagctgcagaaatttgcataagtaatggggagccaaatgttaatcaccaaggcaatggggaaaatgtctttaggcatgtcagagcccttcacggcatccccgcctgtcacaggcctggaggcttaggaggaaaaaatggtttcatgggccaggcccggggcccccctgctgtgtgcagccttgggacttggtgccctactttccagctgctcctgccatgctaaaaggggccgcggcacagctctggccattgcttcaggtgcaagcacccagtcttggcagcttgccttgcacatgatgttagtcctgcaggtgttcataagataagaattgaggtttgggaacctctgcctagatttcagaggatgtatgggaacacctggatgtccagcagaagtctactgcaggggtgcagtcctcatggagaacctctactagggcaatgcagaaggaaaatgtagggttggagccctacacagagtccccactagggcattgcccagtggagctgtgagaagagggccactgtcctccagaccccagaatgttacatccactgacagcttgcaccgtgcacctggaaaagctgcaggcactcaacaccagcccatgaaagcatctgactgggggctctactctaaagccacagtgggtggagatgcccaaggttgtgggagcccacctcttgcatcagcatgccctgaatgtgggccatggagtcaaaacagatcattttggaactttaaggtttaatgaatgccctcttggattttggacttgcatggggcctggagcccctttgttctggccagtttctcccatttgaaatagttgtatttacccagtgcctatacccccattatatctaggaagtaactaatttgcttttgattttacaggcttataggcaaaagggacttgccttgtctcagatgagactttggactatggaattttgagttaatgctggaatgagttaagactttggaggattgttggaagggcatgattgtgttttaaaatgtgaggacatgagatgtggggggggtgcatgggtggaatgatatgatttggctgtgtcccccacccaaatcttgtcttgaattgtagttcccataatccctacatgtcataggagggacctgatgggaggtaattgaatcatgggagcagttaccttcatgctgttctcatgatagtaagttctcaggagatctgatggttttatagatggtttcaccccctttgctcagcactcttctctctttctgacttgtgaaggacatgtttgcttccctttccaccatgtttgtaagtttcctgaggccttcccagccatttggaactgtgagtcaattaaacctcttttctttgtaaattaccaagtctcagatatttcttcatagaagtgtgagaatgaatagtatggaatcattgtaagtgtccatcaccagctgaatgaattaaaaaattgtggtataaatatacaagggaataatatgcagctattacaaaataataaaattctgttatttgcatcaacatggataaacctggaagacattatattaagtgaaataaattaggcacaaaaagataaataccatgtgtatcacttgtacgtgggaacaaaaacatttagctcacagaagtaaagagaagaactgtggttattagaggcttgaaaatgtaggagtaagagaagatagaaagaggtttcataaaggatataaaattatagctagaaaaaagaaggagtcctagaattctatactacctcgggcaactatagttaacaataatttaatatatattttcaaaaatcctaaagagaggattttgaatggtcacaacacaaagaaataataaatgttttaggtgatgagtatgctaattacacagatttaatcattacatattatatacatgtataaaaatatcacattgtattccccaaaatatgtacaattttatgtcactcaaaaattttaaaattttctaaatgacaagaatattttaaagatctctaagtaaaaagttttaaaacatttttaaataaaatttttattcaacaatatttaatatgcttctcagtttaactagaatttaataagaataagatgttttaagtagtcaatatttagagtgtgtatatgtaaccaaaatatgaaaatgtattagtattctttacaattaaatgtgttttaaaggtgcaatataatccttgtaaggaaaaggcaaacaaataaataagtccacaattgaccagtaaaagacaaattatgtatagaatgtaagtataacattcaaataaagaaaaatgacaaattacagaacaaattgcattgagcaactttctggttacttggggaataaaaaacaaaagtggatgtatacctcacaccgtaaataaaaaataattattgcttaatgaagagatcataaattttaaaagtactagaagaaaaaagtgtgtgagaacttacaatgttaagctagttaagctacttttggcatgctacttaagtatgagaccataaaggaactaacttttagagtaaacatataaagttttaaaaattatctgtggaaaacacacaaaatgaaaacacagatgctaaatagggtaaaatgtttactacatacataaaaacaaagttataatctgtcatataaaaagagcttttagagatcaataagaaaaagatgaatgaattcccaagaacaaacaggaaaaagacactgatatataagttatgaatgaagaaacacaagtgattacagcttatgacaggatattcaagctcaatcataaactacaggtctaaatgatttgttgttgttgttgctgctgtcattgtcattgtttttccttgaaataatttaaattacctcaatggcaacatgattttattgtgactttgaacaaagagagagatgcttgtgtagcatgtaggactataaattgttttagccgtagtaaaaaatgactggtaataggaatcaaaatgtaaaatgtgcatatcttctgatctacacattttacttttgagaatatatcctaagcgtatgcaaaatatgtaataaaaataattttagagttttttatggtatatggaaaatatgaacaatctaaatagctattaataggtaaatacatatattataatacttggaatttatatttattaccatttttctaatatttaaaaaatcatttaacacaggtatgttaattatgtatgagggtatagtgttatgcaaagttacaaatacaaaatcaatacaactcattttaaggattttctatctctgcttggtagtaaaacttttatggaataagttaacaagttgcaattgaaatagatttgagcttttctggttgtaatctcttgggcttagcctcaggtaataaccaaaaaatttccatatatttttgtcctttaatcctcataataaaacatttggatatatattattttctctattcccttgatgagtgaattgtggtttttttcccctttctttcttttccttccttcctgccttcctaccttccttcctttccttccttcctttcttcctttctctctctctctctttctctttctccttctctctctttctttctttctttctcttccttccttccttccttccttccttctttcttcctctttctttctttttcttttttcttgtaaactgctaaggaaaacacaagctaagatttgatcctattgaaatgaagacaaccttttctccaaagctgcttggaaatgaaatgaccacttttcgaagtcatggtttattcagttaacaagggcttgtaatttcctatgtgttgaaacaataattttcatccttacaattctagttccagcactaaatggaagctaggttgggagtttggctctctgtcctattgcaatatatttatttctgcatggatatgctagagagaaaactagtttatagctagtgagacaatgtttaaacttatttcgctataaatgaaaaatcgcttgtactactttcagtaattgattttaaatgccattcaggttatcaaaccagatattttcaaatgatgataagtagaaaatagtttaatgccaactgatgtggaagttgcttatttgtgttaattaatgaggagaggtctggtccatgaaaatattgtattacaaacagtggcattgtcaatgaggctgttagtttactcaagagtgtagtatggtgaaagttacatgttaaatatcaattactgaaaaatggaacatctttgaaaaggaattttgcactatagaaaacgtcgcaggaactctaagagcaattctaagagcaatttaaagaaggtttttctataatataataagcttatttatataacagggaatatatcagaaaatgatttattctgcctgctcaaagatctcctttggggtaataaagtataatcttctggtattagctgctattaatacataggccagttgaattatatcctaggcagaatagccctacatgcaattgaaaaatgttgtccaggtgatttttggtatgcttttaatatttgagtcatcagccatccattgtctaaagtaaaataaatatatcaaataaaaacgtgtacttcattcatctcattaggttgtcagcatttacagttagagagtatttctgaaagtattgtatttcagttcagaggaaatacactataaattataaaattgctgacacagtatctaattcttttccactgtgatgcctactagacccaaataaaccaaagaaaagtataaatagtactttattatacatcttgtgtggggaccgcatcatgctgcctataacagaatgaccaaattggttttgtgacggtcagttttgttttgctttttaattagcaagtttatttttatgttttatagattttgtcgtaaatacagcctaattaacacctataaactgtgacatatctagactatgcaatattgtttactgaaaaagagatgaactatcaaggcatgaaaacacatggatgaaatgtatgtgcatattagtaagtgaaaaaagccaatttgaaaagtctgcatactggatgattccaactatatggcattctgggaaatgcaaaattgtggagacagtaaaaaaatttagcatttgctcgggattaggatggaagaagggatgaactcgtggaacacacagaattttggggggcaatgaaactatgctgtgtgataccgtaatcatgaagatgaatcattatatactcatcataactcacggaatatacaacatcaagagtaaaccctagtgtaaattatggactctgggtgacaatggcgtgttgatatacgtttattgattgtaacatgagtaccactctggtaggggatattgatagtggagaggctgtgtgtgtgtggaggcagaggtatgtgagtactctctgtaacttccactctattttgctgtgaacctaaaagtgctctaaatgtgtctatttttaaaacataaaataaaaataaaaaacctgaattttatattcgtaatcttcatacttttagtctcaccaccttaagtattttactgtttgccacttaccaaaatggtggtgcaattgaagaatggtacgtgattcctctatgttgtatcatagtaaagtcatgcttgcatttttttctttcttattgtagtagaaaagccatggatttcagaatctgtaagatcttagttccaattctagttatactagctgtgtataaacttatttcggtataaataaaaaatcgcttgtactactgtcagtaattgattttaaatgccatccaaacctgaaggatagaaaatatccttttaaggttataaatctatccaaacctgaaggatagataatatccttttaaggttatagtgaacattaagtaagaaatattttgaagtagtttaaaatactaataaatattaagtatacttttaatactcatatatattttccttttcaatcaatacttgtttttcgatgttcacaaagcttttgttaaaagggcaatgttttaaaaatatttctgtagagctgtagtttatcattgtgtgaatcatattacaacactagagtctcctagctcatagctaggagctagttagttcgtaactgtgtgaagaagataaatcttttgaaacgacaaagtcacgactcactcatcttaaaaggtatctcattatcctagaacaaacttggcatcattgtattactgacttccaagagaaaccaatcccattttgcctgtattgtctttcctcttaccggcattttttaataaatgctgttgacacagtagcttgctttctcacagttcagttttcctaactgtttgattccatggcaaatccataatcctattttaaatattctccaggccatgaaaatgaatgctatttatatcaattcggctgttcaactgcagtgcagaaaaagcttttgtatccagagatacaagcctctggttcaagcataaattactgggatacactgctcttttttcttttaagctgaactctccttgacacgaatccccataggtgtcttaggtaataactgatattccaagaaaaaaaattgtgaaaaacagttaaaggaaaagacaatttacatttttaatctgatagatcatgtttccaaaatgaaatctctcttaactctggtaatcaattaattcatacatatttccatcaatagatctttgaatagtggcttaattggtcttttggaaatgaatcatttgcaaaggtagagtcgtgcttcatgtactagctccctgaaaggtagtgtgcagaaagattaaatcgcaaagtggattgtaatcaggcagatcttggttcagattgtgactgtttcctacttaaactttcagttttaaaattgaacttggcagagcttattttatgaagtatgaataatatttacttcttgagtaaataaatcttgaggttgatttaaatgttaagtaatataatatatgtaaagcactatgcagaatctggtatgtagtgaaagctaaatttgagttattattatatgcaggactatcttaagtttgacacactagctgtatttttctaaactgtataaatcacttcgactaagtcaactagtatatttctatgacgtactcataaaaccaaaaagattaatcatttcttggaaagcttatgaacttataatatgcagtcctaattgaaccatgacctacaacagagttttccataccaatgtaatgtttcttggccttgttgcaccgaatggaacataagctccgtggggacagagattacatttattttggtctttgtattttgcaagttacctcatttatgaacttgcacataattagtattcaatagttacataattagtattcaatagtcatttataaactgacaacatataaaagtaaatacaggttatcaactgacactcttatttatcttattttaaaaaactttattatgataatctttttaaaaatagttattgtggtgcctgtatcaaagatattaacagaaatttgttaaataaatgaatgtagttaattttcatttacagagcatgaatgccagaatttggataacttctgtactttccttgtgttcaaattctggcaggactaaaatatgtctgtttttcctttcttccaataatatctcatgccatgtttatataattaatacagtagattattatccataaattacatatatgcaaattcaactacatgctaaagttaacttgtgccccacaaatctactcctgggtctttcacagtcattcatagacatatgcagaataacagaacaattgagttgcttgttgtctactttcccagctaaggttgaacgaggtgacactgtgccttcctgtttcagctcttttactgtaaacaattatcgttttgagggtctacttagtgacatgtttttcacatttttgtgctttctgttggtcatgttcctgtttaaaatcacttcccaccagtcacttctgcccccaagcatagtgatgaagagttgtcctgtcttccttagtgcaagaatgctgtgatgtgccttatggagcaaacacatgtgttagataagcctcattcaagcgtgagttatagtgttgttggctatgagttcaatgttaatgaatcatttaaaataaggtgtctttaaacagaaacaaatatgaagtaggttataggttaaagggttcatgaaaatgttgtgaccagaggctcacaggaacctgatcctgtatttctcctaggagcaatgattcagtagttgctaattcagtgtttatgctgagaatacaggtaaaaacaactgcaaacaatgaaaattgtctataccacttgtagtagtcaactcttagtaatcaaactcttcttagggttcacagtataatatagagatgatgggtaccagattggattacatgatcttttgatgttttctgagtctcctaatacttttcttgatgggattgaatgattggatatcttaaggccagcttccagaaataagctgatcaagttttgatatggtatattggaattctgtccactcccactgccttttccataactattcacactctaataagtagtggaacatcatttgcagagatgggatgaataggtaatttttggctatgaaatttgcttgtccccataggtctctcagatgctcagtttggctttcactgtgcagcagccaatcattacaggaaaaactgttactcttcctaatcttaagtaactttgattttaccctctcgtcatgaaataagacctacttagccgtatggaaggggagtttaagataaaggaaattgaggaatgttaaaaaagagtagaaatgttatccaaggaaggagagagaaagagatgcagattagcacagggtgaatttagaccagaatgccttaatacagatgttcagtaaagctaaatctaattctcattgaaaatcccccctccctttaaaatatctccaacactatgtcaagaaagagagaaagagagatagaaatttcttcttccaaccttgttcaagattttgccctcccccatattctttattctgttgtgggcaaggaatgtgatttttcttattgaaagttaaaaaacaggaagtatttgagatctgctgggaacacacacacatgcataaaaagatagtgaatttggaggaaagtgttctaaactcagagtaaagggctaggttctaattatctgcagatggcaaattgctggctttgtaggatggatggatggatagatagatagatagatagatagatagatagatagatagatatggatgaggcccaagcctatatgttactgcattctgctgtgggtttgcagacaagtctagtttaacttctttattgcagtcttcacctcaacacacttactgcaagagacaatattgttatcaggctaagaactacagaacagaaggtggatttatatattcccttctccaatcacaccatttgaagacatataagtcctctggatttacaattagagaacgaccagcaacctctataaaaaatagtgcagaaagagaccaagattcaataattatacacagttgttaggtctcagtgtctgctttgcctaaaatgataatgcccagcaactttttctctttagatgtgtgcctaaaagccaggtacagtgtggtaggtgactcaaagataggatgaataccctctttccccccacgatatcatgacatatttgtcttctttgaagaccaagaactcacttggcagtttgctttggcagcagagctttctgagagagagagaaaaagagagagagagagagagagaaaatattgacagaagtggtcacatttctcatctttttgtcagctctggtagtaaattcaagatttaaatttgtagtaagtatggaactttatagaacacaaagtaaatgtcaaagtagacaccaggaaaaattatttttgcttctacagccctatcacaaaggcaatctcagatttaatagttattccaaaaggagcgggagcataaagcttcattgtaaaacacaatactctaacaaatggtggaaggcttgcaatttcattgcaaagagagaacatagcacttctttgccaaatatgtggcaaatcatatttaattgaagctattattccagtgagaagaaataacaatttgacttctagggagttttaattgacagtattataatatttgtgcaatgtacatccactacaagaataaaagaagcttttacaattgcatactgaaaaatgaaagtatcaataaaatttctgtaaatcctggaaataataatatcacaatatagctagctaaagaacaattttcttcactagattcacatagcttagagaaaaataattttcacagaaatatactcatcatctctttccctaacccatcttttgtaattttcctaatttcctctgtattccactatttcatcatctcattattaagaagcaaaacatagaggcatttttgcattatgcactacagtcttttgtttgaaatttaatgggtcatgagttctgcagtccttgggaagatagtctttaaaaaaatggggatttttagatattacatacttgtagccatctgcttaatatgtcattttcaaccattactatgaaggtgtggagagtgttatctcacttcaacttcaccaacaaacacttcaacatgcattagtttttttcctatcagaaccatcactcaagaaataccagttgaatgcatataaacatggcactgtgctaggtaatgtggaggatgcaaaggtaatagacacctgtatctgacaacattctagtaggaaaaggagacttacacaaaatgtttatatagtttcactacagagtgagatgtgtcctaagagtcatgcaggaaactgtgcgagatggatttcagtagaagaaatcaatatgagctccatacgggggctttattataaggggtagaattctcacctcagttaaggtagaatgtccttgggggaaaagcaaaaaaagttcaggacacacagggagaatccatctaatttgaagtatagacgatgtaaagagagggagtgggtgataagtttagaaaaacatgtaaaagccaaaataacaaaattatttaacatcagatgaggcagtttgaactttattttacaggcaatagggcattagtgaaaattttgaacaagaaagtaacataatcacaattatactcaggatagagtggattaaataagcaatggaattgatattagaaagaaaaattaggcataaggcacagagagggtgataaacttctgagctagaatgttttatattttcatttctgcctaacaccaattcttggattacctggatgttactaagaatatatatacatatattcacattaagataaagctatgatcaataatgtttcttttttaatttcagatttttcattattcgtatactgcttcatatgtgatttacaacatacacactaggtaagttctttgattttctagttttcatgagcaattgtgttactaaattgttggtgtagatatcagtttgttcatgtaaaaatattcacattttttcaagggaagtttgggagttaaatcctccagaagtagaggactccgtcttgcagtacgcggcctggggtgtccaagggcagcagctggtaagcgcaggcattggtatgcactgaacactgccaatcatggttttatggaagatgttaactgaaactttggaaaaaccataggaaaacttgtcctacaaaactttatgtttccctaagtcctttatatcttttatctaatagtccaacttaagaatacattaaatgatactagtattattttatcagttaataaagacaaaagtttattaagtaatatatgattaaactgctggtttataatgaaacctagaagagattcaaggttactaggaccttgtactgcatactttccattacataatattgtcagttttcatgaaaaattcaaaataaagattattttttcttaaagcattgttcagggtaaaaatttagacagaattatttaatattctcttaagagaggatttttacttttatttttattttgaaattattacaaactcaaaaagataattattgatatataaagcagtttgagcaattatatatatatgtatgtgcatgtttattttaggcaaagtcttgctctgtcatccaggctggagtgagatctcagctcgctgcaacctctgcctcccaggtttaagcaattcttgtgcttcagcctcctgagtacttgggattacaggcacatgctaccaggtctggctagcttttatatttttagtagagacggggttttaccatgttggccaggctgatctcaaactcctgacctcaagcgatccacccacctaggcctacccaaagtgatgggattacagacatgagccagtgagccccgcctgcaatattatattcttgtacatatctcatggtgacaatgtaaagcctttctcaagggaatattgctcagggagtagtattgcttactatcctgtgcatgctcagatgtactgagcatcaccaaactgatttctaggttatttgttaagcgtgtttacacctaccagcaataatgagagcgttcccttggttccatatccttgccaacacctgtttttccagacttttaaataattactcaaatgatgatacaaaatagtatttcgttatagttttattaacatttagtatttccttgaattctaataagctagagcaacttttcatatggttactggcaatttgtattttttcatatgtgaaatatctattcatatatttgtccattcacattttttattcttttttttttagttaaaaggaaccccttatatgttctggatattaatacattgtttggtctatcttcatccagttttcggatttacttctcactctcttaatggatccatttctacaaacatatttttttataaatgtagtctgatttatcaaatacatgatttgtactttttgttattgatgaaatctttacaatgaaatcatacttctctagaatttttcaagtgggccttccatgtataggttcttgatccatccatctgaaattgctttttttggtatggtattaagtccctatccatttttatatatgttttatatggccaacaattgtcctgaaaccttttgttgaccacttcattctttaactattcatctgcagtgttacagtgttatgctgtacatatccatgagtcttcttccggctctttttttcttccaggtggtttgtctattagtgtgctaagacaacagtatcttaattaaaataagctttactagctgacaaggcagtttcatatgctgactttgactcttcttgactttttagcctttcatatgaatgtcacaattgtctttcatgttacatgcccattttcagaattttgaatttattatttgaatctatatgtctattttgggaaattaacatcttagtgatactgaatcttcatatctacaaacatttaatgtatgtatttagttatttaagactcttaatatctcaaattttacaattttatatctaaaaatttacactttatcattttggtgactcttttaagtgcttgcatttcttattttaaaaatgtttgctactggtaaatagaaaggtactcaaattatttatttaatatatatcaaccttgctacgcacaattatatattccaaataattctgtgtagactattatgctttttgttaataatgacatttttcttttccatttcaatttttataatttctatgtcgttaaaatccttctgcactagttaacctatgaatgtaactaggtatggtggggttttttgttttttgtttttgctggaatactaaaaaattgattctattatggttactgggttaagttttacaattttttttttagttagttttagttagtgactgcaattgatgagacatgctttatggcttgggattttttcaaaatgctttttatgtgatggataattttatatatgttctatatgacaggaacaatgttctatatgtgcctacaggatcaatcttaataattatgtttctaagagttatattttcttactaatgacagtggatatgtgatttttttctttagttgtcagttttgcattatataatttgaactatgttgtaaagaatgaggaagttataaaatgataaatacatctttctattgaattcaaatgttttataccttaataaatatatttaccttatttacctttaataactctgattggccaaccctcatcctatcctttaactagttcttttaacgtagtttagaatcctctaggcttttttaaaatttgaattgctgttttaacaacagctggttgggctgagttaagtttttaatttcctgcaagcctcaattttctcatctataaatagaaatatgtacaccatcatatcattgtgataattattttggaaaatgactatttttcataataagatgcacattactatgatttatatcctattttataaatctgtatatttcttaagcttattagtgaaatagggtaattataatagatatttcatatcatgagaagcctacagaataatacactgtggctaaataaggtttcctttcattggaaaataatctggaccctcaaatattcaaagaaatcctacaaacaaccctgcattcactgtcctttccacactaaatggttgaataattgagtaaatcattatgatgaaaaaaggttagtgatttaaaatgaaaaatgtctgcaattgtccagataccacagattatagacattatatttgcttttatcttgtagatatttagataaattaacaaacaatgcatttaatctaccatcacagaactctctgtaatctatcccactatgatatttctgaaaagtggcagcaaaatttgcatagaatatggtaaatatgaatgtgcagggtttggtctagataaggcatgtaatcaatgaaacattcatggacaatggtgagtggacaccaagaagtggcaggtgctctcatccttcctgtttcactctgatgttgtgaacaatagagctggtccattgggccagaagcaactttggaacaaaccaaattccagaacacagaaacccaagacaactccaccttttgtacaaaatactgcccagtattttagaaaaaaatggacagtattttggaaaatcttttacactttggttggttttaaatgaccctcttattcttcatacttgagggaaaccaacacctatgacaaaataatagcactttgatacactcagggaaatagtattaatgtatgcattttctttatttgttattgattccttattttttaatatatttaagaaaattatgaaaatactaaaaatgtataaaaattataggttccctgtttgaagccatattgcaggtgattacattctggttctactgcttactagctgttgatcttgagaacattatttaatcttgatatggcttactgtttccatctttaaaatggtagtgctttatcaatagtgctattctggtgtttaatgtatgaaatacagttctaaagcactttgaatagtatctggcctataataagtattttgtaggtattcacttttactattattaaaaaatctgttttcatatgaatttaaacaccttagggaactttagggtgactagttttgtggagaattaagcttaagttttctgtaatgtcatttttcaaactcctttggggaattcttaagagaaatttcatatttatctagtttatcttttgagtgcatgcaaacataaatttaaaaaagtaaaagacatacttctacaaatggccaatggtccatttcatatgagtttggcatgctttgtcaatatttgaagctattagcaaactcagcaatatgattttattagagatgagtcattacaatactttaattagttttgcattaaataaagaggcttgtagtgtttactaactaaggataattaattatccttcattttcagcttctaatcttatttgctgtaaaagaaattcctggtattatagaagagaggcaagggattgacataatttactgaggaagaggatctaagttagaactcagaatattgaggagaactttcaatagcactaagtgtgagtaaaggcaatttagatgtgtcaaaatttgtggaaaaatgaacctgaagcaataaagagtgcattatttggagaaggtggtgagtgaaccactttagctgtaataaagttttattgaatagaaatggtttgggaagaggaatctgggaattatggtagaaagagaagcaccaggaatctgtttttccattcagataacaattgctacagtagacatgtaactattgagaactctagtctattgaaagtgtgtaaattttatgggaaggcttgaatggaagtttgtggttaattttagttgacttgaactcttagctcagaagcagctacctatcttcgaccccagccccatggcaggcagctgtgcttatgttcctggagcatgcattcatcttgcaggaaccaggatggacaatgagggccctgtgatgcaaataagtaaggatttgtattcttattgtttattgccccttctcattatgaaattgcagatatagaggaaggcagctattgtttcacatccttacacccttataacaagctcctctccctccagctgaagtgaattctaaggtggttaaaaggccagtgccctttcctactcttcatttttctcttttttgagggatgtcagccattaaaaattaagatattcaaaggcaactgaatgtatgggagaaattagcaagtcaccatacatgcacagggaaagatgcaggcttacaaaagatctgagaagacttttttcacataaggctgattctcagcataaagacagcctccaacaattacaaaagaaccaacataacaaaacaaaagcaaaaacataaaatagaaaaccatgggaaatgggaatgtattagtccgttctcatgcagctaataaagacatgcctgagactgggtaatttataaaggaaataggtttaatggactcacagttccacatggctggggaggcctcaaaatcatggtgggaggcaaaggaagagcaaagtcacgtcttacatggcagtgggcaggagggcatgtgcaagagaactcccctttataaaaccatcagatctcatgagacttattcactatcatgagaacagcttgagaaaaacctgcccccatgattcaattacctcccaccaagtccctaccatgacatgtgggaattattaaaattcaaggtgcaatttcagtggggacacagagccagattatatcaggggagattctgatttccagagataccaaaattattagattcaaattgtctggttttcaacaataaaaaaattacaaagaatacaaagcaataaggaagtatggcccactcaaagggataaaagacccaacatcaagaaataatggaagtcatggaaaatatgaagaacatgatgtatgaacaaaatggaaataccagtggagagagagagagtaaacctaaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggagaaattaagacattctcagataaagaaaaattgacaagagttaccactagacctgccctgcaagaattactagtgggagtccagcaggttgaaatgaaagtacactaggcagtgatttgaagccttataaagaaataaagatcccggtaaatgtaaatacatgggcaattatagaaatgtatgttattgttacaatgatttgtaactgcactttttcttttctacttaatttaaaaagctaagatatttaaaatttttagtctaaaagctaatattattttaactttaatttgtatttcacattttttttagacataatttaagaaagtaatgccttaaatgtcattagttaatacctttggatgtacaatatacaaatatgtaattttgtgacttcaataattgagggaggtgaggatgaaactatgaatgagcaacgtttttgaatgttattgaggttaagcttgtataaattcaaatcagcactataactttatgatgttgcatggaaccgccatggtaacaacaaagaaaataataaatatacacaaaagaaaggaaatgagaatggaattaaaacattctactattaaaaattaaactcaaataagacagtaatgtggaaaatgagggtaacaaaagataagggatatagaaaagaaatagaaaaatcacaaaagtaagttattccttatcagtaattactttaaatataaatagattaaattattcaattaaaagaaactaagaagataagttttaaaatataatatgattcaactacatacgctctataagaaactcactgtagatacaaagacacaaataagctgaaaataaaagaatggaaagagatatttcatgcaaacagtaagcaaaataaaataggggttgctatactaacgtaaaaataggcgttaaatcataaacagttttgagagacaaataaatcaatacagtaagaagatataacatttcaaacatttatatacctaataacagaccatcaaaatatataaagctaaaaatgaatataattgaagggaatatatatatatatatatttctaccataattgttggtgatttcaacaccatactctcaataatggctagaaaaaccagagagaagataattaagaaaatagaggatttaaaaaacacagtaaggccaggtgcagtggctgacgcctgtaatcccagcactttaggaggctgaggcgggcggatcacgaggtcgggagatcgagaccatcctggctaacacggtgaaaccccgcctccactaaaaatacaaaaaattagccgggcgtggtggcgggcgcctgtagtcccagttactctgaaggctgaggcagaatggcatgaacccgggaggcagagcttgcagtgagccgagatgtgccactgcactccagcttgggcgagagagcgagactccatcttaaaacaaataaataaacaaataaaaaacacaataagccaactagacttagcagatgtatacagaacactcaacctaacaacagcgtacacgttctttcacgggcgtttgagaaattcttcaggatggatcatacattttgccacctattaagtctcaatagcttttaaaaaattatcacacaaaagatcttctctgatcacaatgggataaagttagaaatcaataacaaactgaaaactgaaaaatttctacatttgtggaaattagaaaacattctctcaaccagtgagttaaaaaattacagaaaaattagaaaatacttagagatgaagtaaaatgaaagcacaacataccaaaatgtatgagatgcagcaaaaacagtgtaagcgggaagtagctatatatacttactgctgtggaattaatggtgttcccacaaaatttatgttgaagccctaacctccaatgagactttgttagtttgttggagataaaagttttaggaggtaattaagtttgtacaagatcatgtgtgacgctttaatccaacaggactggtggcttaaaaaacagaggaagatctctcactctttctcttgctcttgctgtcactctctttcactcttgctctttgtctctctgtgcatactcaaaggaaaagtcatgtgagggcaaagctgccatctgtaagccagtaggagagctcttaccaaaaactgaaacatgttggaaccctgatcttggattctttagcctccagcactgtaaataaatatatttctgttataaactgcactgtctttggtattttgttatggaaggctgaaaggattaagacactcacattagaaaacaaaaaaagatctcaaatcaacaacctaattttacaactgaaggtactcaaaaaagaaaaacaaactaaacctaaagatagtagatataaacaaagtagataattaaaaacagagaaaatcactaaaatcaaaagttggttcttcaaaaaaatcaactaaattggcaaacctttagttagcttgactgaaaaaaaaaaaaacaaaaaaaaaaaaacaagagaagactcaaattcctaaaatcagattgaaagtggggatattatgaccgtttctacacaaataaaaaggattataatagtactatgaacaattgtataccaataaactggataacctagacgaaatgaagatagtaccaaaaatgcaaaacttcgtagtagagtcatgaagaaatagaaaatctgaataggcttatagttaatatggatattaatgcagtaatcaaaaacctcctggccaaaaacattctggaactgatggcttcatgggtgaattctactaaacatttttaagaaaacctaacaccaaggccaaggcgggcggatcacctgaggtcaggagtttgagaccagcctggccaacatggtgaaaccctgtctctactaaaaatacaaagattagctggatgtgttggcaggcacctgtaatcctagctactcaggaggctgaggcaagagaattgcttgaacctgggaggcagaggttgcagtgagttgtgatttgagatcatgccactgcactcctgcctgggcaacagagtgagactttgtctcaaaaagaaaaacaaacaaaccaatatttctcaaacttttccaaaaagtcaaagaggagaaagcacttcttaacccattatctgccagcattatcctgatacaaaaatctatacatgctacaaaaaacttacagatcaatttttcttatgaacatttatgtaaaaattctcaacaaaatactaatacaacaaattcaactgtgtaaaagattatacaacatagctaactgggattcattcttgaaatgtaaggatcattcaatatataaaaaactgatcaatgtaattgtattagtcccttctcacatcgctataaagaaatatctgaggatgggtaatttataaagaaaagaggtttaattggctcacagttctgtaggttgtacagaaaacatggctgggaaggcctcaggaaacttttactcatggcagatgggaaagctggagcaggcatcttcatgtggctagagcagaggaagggggtgagagttaccacacacttttaaacaaacagatcttgtgagaactcactcattatcctgagaaaagcacaaaagtgatggtactaaaccattcatgagaaacccactgccatgatttaatcatctcccagcaggcccctcctccaactttggggaacacatttaacatgagatttgagtgaggacacagattcaaatcatgtcagtagtatactacattaatgaaattaaagaaaaaaaacacataatcatctcaactcatacagaataagcatttttaaaaatttaacacccttatatgactaaaaaaaaacaacaaactagaaataggagaaaagtacctcaacataataaatgtcatcatgtatgcaaaatgaacggtgatcattatacttaatggtcaaagactgaaaatagtttctttgagataagaaacaaggcaaggatccttccttttgaaacttgtattcaccacagtactggaagtcctagcaaaagcaattaagcaaacaaaaaaataaaatcaattcaaatggaaagaaaaataaaattatttccatttacagattatataattttatttctttaaaagcctagagtccacacacacactcagcattttagaactaataaacacattcagcaaagtactaggataaaaagtcaacacagagaaatcatatacatttgtaagtctatacaataactgtgggcaatctgaaaggaaattaagaaaataattttatttacaatagcatgaagaaggatagaatgctaagaaattaactcagtcaaatagatgaaagactcatacaatgaaaactaaaaaatatgtctgaaaaaaattaaaggacacataataaatgtaaaggcataccatgttcatgaattggaagatgtaatcttgttatgatgtcaatatgcccaacacaatctacagattcaattcaatccctatcaaaatccaaataatgtcttttttgcagatatagaaaagcctatcctagaattcgtatgaaatttcatagggcttcaagtatccgaaacatttgtaaaaaagaagaaagttggagaactcacactactgattcaaaacttactacaatgtatagaattcaaaatagtgtgacataaattaactgtgctggtacaaagacagtaatatagaccaatggaaaagaagagagagtccaaaaataaactttcgcatttatgatcaaatgaaggtgccaaatcattgaatcaggaaaggactatcttttttaaacaactgatactggaaaaactggatatccacatacacaaaaaataaactcttacctaatatcacattcaaaacttaactcagattggatcaaatatctcagcataagctctaaaactataaaacttttagaagaaaatataagtcagaagtttgaagatattggaaggaataaatgaattgaatcattttgcagtgctttcttggatatgacacaaaagacacatgaaattaaaaattgacaaattagattttatcaaaacttaaaacttttgtgcatcaagaacactatcattggagtaaaaaggcaacatgtggaatagaaaatatttccaaatcacttatctaagaagaggttaatatagaggaataaagtatacaggagttcttatatagagggattctaaaacgtaataaaaagaaagcaacctgattaattccaaaatgggcaatgaacctagatatcaaaaaatatgtaaatggccaataagttcatcaaaatagcaattcctatggaaagaagtttgatcttaatatgaagtggaaccttaggaattaaccattttcggtaggtaaacacaactgaatatagatgccttgatataattccatcgcagtaagtagcaaagtgtaagttaaagtgagctaacatttcatgcctatataatcatcaaaagtttaagtttgataataccatttactagtgagaataccatttactagtacacaatagggacatgtatatcctgccaaaggactactagtgacacaatgaccttgaggaacaaggttaatttccttgttcctcaaggttaagttccttgttcttcaaggtcaagtttgtagaacttagtcgtgttgaagaagtccatctctaaccctcagagagtgctggtgggcatttaaaatggtacagcctctttggaaaacagtctggtatctcctcaaacaattaaacagaaagttatcatatgatccagcaattccattcctaggtatatgcctaaaagttcccacaaactttgtacgcaaatgtccacagtagaattattcatagtaaccaaaaggtgaggaaaaacacaaatgtctgccaacaaatgaatggataaacaaaatgtggtatattcaaacaatgaaattattattcatacaatgaaattattcagccacaagaagaaatgaagcactgatacgtgctacagcttggatgaaccttaaaaacatgctaagtgaaaggagccagtcttctttcagaagtcaaatatgatttcatttatgtgaaagtccagaatgaggaagtttgcaggacagaaaggagattagtggttacttacagttggaaggattgagggatcagggagtgatagctaaagtatatgggacttctttttgagataatgcaaattttataaaattgactgtgataatagctgcacacatctgtgcatacaatacaaactataaatctgtaatttttaatgggtgacttgtttggtatgtgaagaataggtgtttttctaaagaaagaactggtaagtcctacaacagtaagttaggcattcagttgaaaaggcttgtggtgcaagaaggtgtgtcatttttctttttaaacaaatgtagccttataaaggtcagaattactcattgtagaacgttttgaaattgatataattaataaaaacagaaagtatacttatctataattgtatcacgaagaatggaataatttcaaaaatcaggtgaagggatttcacctttagaaggaaaaacatagtactaattagaatgaatctagaatcaagaagctcaagtccagattattttccattcttttccttactcattttttaaatttatttattattattattattttgctttgtgatttagggagagttgaaggctgtacgcttaaatttacttacattacaaatgaaagatggtcataactagttccagttttgtttaagttttaactgaggtatgtcaagtgtatcagttaaaattctccagaaaaacaaaaccaataggatatatatctccatatatatagggagagggagaaggattttaacgaattaactcatgcaactgtgagggctgacaagtttgaagtctatggagcagaccagcaggctggacaagtattaatgaattgatgtttcagtcttgagtcctaaatctgtcgggcaggttggcagttgggaaagttaggcacaatttcttgaagcagaattcatttttggggggaaacttcatattgtacccttaaggccttcagctgattggctaaggaccatccatattattgagaatattcttctacttaaaatgaattgattgtaaatgttgatcacatcgactaaatacctccacagcaacgtctagactagtgttttaccaaacaaatgggcactatggcctaaccaagttaacacaagaaattaaccatcacagtaggtatgacacttcacacagtgagaactcaagaaataatagctattattttgttcccacctgttctttcctacaaataattcacttaattcagagcctcatcatctttcacctagatattttagtagcttattttctaaaatttgttctcacatctccagtcattctaattcagccaccatccgcagaaatatatgttaaaattgaatgtacttaacagactcccacaaggttataaaatgtcattgaagtgacactcaatgtcattaatgtaactaatgtgacaactggtccatcatctgagctcctgccactccagcacagagcacatatttttctctacctgaaccaaactctttgtgatttctggatgaaagacacctgactcctctgtgtctctgagtcattcctcttggtagacctagccatttaaaaaaaaaaaatttccttcaaaagtctttgttaaatactttctctcttcttctctgataatttttttctaacccttactccatgctaagtgaatagttcgctttttgggattctggcattcctctctctcaaataatttttaatactatttatttatgttgttatcttctaccactaactgagggggaacacctagaatacaggatctattaaacattttttctctctcatttgtttttctcctcctccatttcttcctcctccttttttgtaaaatttactgtagctcaaggcaaaatgtaagtttaataaatttctggttgctttgagaaactgatgaaagacttattgttatttctgtgtaaaacaagaaaccaaaggttttgaggattgtataatatgggaaaaagtcatgtatgagaagatagatcttgtaaaggaggccatgatataccataagctattgaatctggaagcagggagctaggtgtagaggccatcattataatctggaactgcaatgataatcaaccatatatcaatataacaagcttttatgctgagatctaaaatttgattgctattcaaagataaaaattatcttataaacctaattaatgtaaatgaaatgaggcaaatattaaagaagtgtatttctaaaggtttctttttctttttacaaaaatgtcctctttgagactccttccctgaaattgctaatatttgtttaattttttatattgttgaaaaatgtaatgtttaggtaattcttcaaatacaaacaaaaattatccacatctctctatcacctgtgtttttgctattactaggaatttatcttaaaattttattaaaacctcaaattatgagcaatggtttagtttctttgggagactttaaatttgtgatataatctcttacttcattactaataacaattgtgaactatttgatcaatttttcccgagtagtatttaaggtagcacttttcaaacatatctttgaaatctcacatttcctactaaaagtcaatgagattttgcttcatattccattaaatatctatgctttttaatacaaaagtaattatttttaatctcatcaggatgtgttcaagaaatgtatgataagcatacacaaatatatttgtgtgtttgtatgcacacacacacattcacacacgttactgctggtgccaagcacgttctgggctgaaagtcttggccttagagtcctattataccagagctttaatggaagtagatgaggaacaaggccagcaattgacgaattctatttcaagttagttatttaactgtagtttgtatgatgctcatttctagttggtagaatgatgcagggaaaccactagggagtgaagccaaacaatttacactattaatatcaagtgtttgacatgatgagtgtttccaatataaataaatttggaccacttttttgttgttgtttacctcattcatcttcattagtgaagataactgaaatccgattaccttttcattttatctgaaacaaaatcgaatgttcctgcttttagttgcagggtataaaaacaatctcccttaccacattgtagtattgccccatatctaacgtctaatgggtctcaaatcaaatttgagatcaggaaaatcaataccaagcagctcatatcatttatttactaaatatttgggccagaaatagtaataaactgtaaggggataagtctgtttgggtttaatgggggggaaaaaaacaggaaacaaaacctcacctttaaattatcttaactatcttcacttataaatttgcaatgtatttaggtatatatttacatgaatatattacatatgtaaatgtaacaggaaatacaatgtcacataaataaaatgccttaacattgtgcaggtatgtgggacaaatatgcaattatgttatataatttaaaggaaaattaatttgcattgctgtgtaaaaatcacctacacatcaggtgagcaatcccacaaacttcctttaattcatatttaggcaatattttagtcatttagaaataataaggtatttgtaatgactttatcttttttctcttgttttccaatgtaaatcacaatttctgtggcacgtcttgtttcatcctgctcataacataatattaaatattaaattgtggagtaagaaccatcaaaatcatgggattgtagattttctaactgttcacctgggtcatgcataatctaatatacacaatgtatactttagacagttcctgctaaggaaactatttgaatgaaagagcaatgtagatgacagttagtgaaagttcctgaatattagactctttctgtatcattgcaactaagcgcttacaccatacctattattcttacatttgatcagacagggttaacctagagtgatatgtcaagtttcatttgatcagcagtctaaacaaaaacttaagaaaaatgataagattataatagtatctaccacaagatgtgaaccatcttacataacccctgaggttaaaagatcccaattaggcagagttcagtactttagtgatttactgtgttttattaaatggcatgcagataactccccaaagggaactgtggtctgcattaatgtcgagactcttcatgtcagaaataacttcagacatctttcaagtggtgtggtagaggagctctccgcttgctctcctccttaagaacaaccaaagaaatgaaaataaaaaaagacagtacaatttttatgttacattaatcagctacagcctaatctataatctcaacggaacatagagtaaaaagaaatccacagccagaaaaggattgaaagcaaatatacactttaatagattttgagaaacacaaagaaatagacaaactgacaattttagctggtaatttcaacatttctcttacagtaaaacatgaaaaaagtagataggaaatcagtagggtataaaaggtttgattaacactatcaaccaaattgacataatcgacttttatagaacactatatgtgataattacagaatacttgacatgtttaagtgcacacactgggccataaaacaagtatcaataaatataaaagaattgaattcataccaaattatattctatgaccataaaggaattaagtaagaaacaaacaaattttacacacacacacacacacacacacacacacacacacacacactctctccacattttttattggaatacgaatatatctaataagtaatatagtattatacatctagtgattctgaatgtagattttgtcctgtaaatatattacacatgtgtctcaagacatacattgagaaaattcattgcaacactatttataattttaaaaacaaaatagaagactgaacacaacttaaattattattatgggactagtaaaataaactatggtacataaaataataaaatagtgacttcttcagaagccattaaaattaatgattcttctatatgtgcaggaaagcagtgctatccagtgataaaagaaaggtccatattgttacttagcatgttattattacaataggtaaaacattcccccaaaacaaaaatatctatatattatttaaatatttccagaattatgaataacaagatgaaacttaaattacagaattgattacttttaacatagcatatgaaaattaaagcacatcaggaacttccaaagtaaagaaaaaggtggcaaattgttatatatatggatatagatatagatgcagatatcttattttctgaagtgtatgtcagcagcaatgatcacatacaatggcatgagattctacgtgtgttacacgtgtcaaacataatcagagacaaaatagggaaagcaatatgttaaagtaaaaataattattgttttagagtagtagaataatgttggtatggtctttaacgtttatgttattatgttacatattgttttaagtgttagaagaggaactagaatatgaggagcaagggacataaaggactagacatttaaagctgaatttaaaaagcaactgtgacttggaccttaattctacttggtaaaaaagacttgctaataatattgaagttggctattaaaagaccgtggtaagtatcttatttgtttctgatgtgctctggaatggaagtagaatgcaaagatcattatattacaaattggtactcaactcttaattctttcaaaattatcctaatcactgtttctaacatcccagaactaaactgggatatgggggtgaataatgtcaagttggctgttcatttaagaaaaacaaagcttgtccactaacttttttgatttcccttatgttattcaaattcagtatcttccaaaagagctttttttggggaaaattttcaccatcttctaaccaattttatatctctaacataaaaacctgtccctgaaagcataatgacatttgtaaacatactaataattcagatctttacacttattcttggaattagaatcaaaactagatataaaccacttcaccctttaaaattatataatttacttgacattaataaattcttcttgaaaaggaaaaataaaaatactacacctggatatgatgaagaatgtactggaaaataacctttcacttcagagcaatcacaatgaaaagaactttgactaaaattgaataaatggttttacaaccctgatatagaagagcaattgctcacacatcaatcttcacgcaaattcagcaataaactctgacaaaaccttaaaacaaaccaacacataaaaagctacccaaggactcaagcctgaacaaaaccaggcagattttcgaagggagtgaaatttacaggaaaatagctcacaaaataggattcctccattttgttagttttgtttagagttttagcctaagggcaactgtagtggaggcagagtgtgggtatcaagtaagttgaatctctgataggaaatccgactgtcgtttaggcaagaccaagagaaagagcccttgagtagctgtaactgccagagaatgagaagaatccctgagagagtcagagcaggggtaactagtggtgtgcacgtactcaggcaagtgtttgactgaacttcaactataaatgacagaattttccgacgaagtctttaaagctgctattctaactgtatttcctgaccttcataaaaataaatgcaaaaggaataaaaagataggatatatcagcatacaaatacacctatcttaaatctattgatatatttatatatcttatatatcctacctttcatagacagatacacgaagaatattaaaaagaagaaaatggacacttgtagaatttcgaaacagtatttaaaataaaaaaaaaattggatgggataaagagcagaatgaagatgagagagaacagagtctgtggcacacagatcaataaacaacatttaatctgaaaaaattaagaaatttacaaaagagagaaaaacaaaacaaaacaaacaaacaaaaaacagacccctagggacctgtaggaaaactgcaaatctctaacagatggtgcttggaatctcagaagaaaaggagagaatggagcaggaaaaatatctgaaaaaaatgatagaaattccaaaatgcaataaaaaacacaaatttacatattcaaggtgctcagtgaactccaaacacaatatattcaaggataatccctcaaaagtaaatgttagcgaaactgttgaaaactaaagataaagagaaactgtggaagtgaacagagacacaacacaacatataagtaggaccaacattagaatgcttacagacttctcattaagaaccatggggaatcaaagtgaaataaagacagtttctgactaaagaaaaataagggacccacactacaaaatatgctcttcagtgagaaagaataatatgataggggaactcggatcttcaggaatgaaagaagaacattggaaatgttaagtatatgagtaaacataaaccactaaatttcctcttaatttctgtataaaacgtattactgttaaaagcaaaaatgacagtatgggggtatgtatgtctgtatgttgtgtgacaactataacgacaaaaatggtgagggagaaagaaaattatacatttgtaacatttctatgttttacatgagattattatcttccttaataataattttcacaaggcactttgaatttttagttactgataaaaatcagattgcctgataattttagaatttaagggtatgtggtaaatgaggtagtttattttcatcaaacaataatagcatcatggattcataaacaatgttcattttttttctaacatttggattacgaatacatttgaaaagttgaaacaagtcactataaaatgccttcaaaatgattgacttaaaatttttcaacttttttctagaacattatgagcttttaaaatttgaggttattttattcttattcccaaaacctaagatgtattcgcttggtagctaatctagttttaatcatgcagttaataaaatatttattaagtaatcctgttttgttggtagcctgtgttttgttggtagcctgtgttactcccaaaggtcataaccttcaataatatagttaataaaatgtggaaaatatttccacaaagaaacaacaggacttgagtttttaaagaataagaagtttgcttttagaatctgtaatgtgttagtcactctggagaattcagttggaaaaaaatgaaagaactgaactgctgagatatttaaaatctagaagcatgaggtgataagtcaagaaatactttgggcaaaactgaaattcgtatagcacaatagcatgcagataaagctaggtgagtacatgttttttctttttctgtggggtgaggggagtgaatagtggattcgctgtcttagaaccacagtttcttaatttcaggtttgaaagttatatacattaatttgcagaaaagaaatagagaccttacaaaagaaaaaagttacttgcaaagactattagggacaatttggtaagtactgttagagaaattaaagatgagaaaaatgagggatacacataaagaatgggattgtcttggttgacctggaatgctacagtggctacgtatttgcagagattataaattgagagtcattctggattcttgtacatcataaaatggagtttaagattactctagctgttgtgttcaggatggatttattcaagaggagggtgattgtctgagatggagtccattgaaatgacctttcaatggagatttgaagtgctaatcctatataggtgtgggaatgaaaaagatgcacagttggtaaataatatgaataagagtgatttttgtggattttgattgaaacaaggcaatgtgaggaggccgagaagataaaggtatcagaaataacttcttaaagatgagtttgttcttactgctagactttgctgacattgagttgacacatatcccaaagtgttatgcaatttgaaagctgtaaaaataattggttcttaaggttacatatagtgatccatatattagttcatttttacttaagaagatatactttaaaatgcatttttaagagttttcctagaatattggacctataaaatggtctggttttttttttttttttttttttggaatcattgtctaatgcatttagcacagcagttctcaacctttttggcaccaggcactggttttgtagaagacaattttttccatggactggggcaggggagggatggttttgggagatttaagagcattacatttattgtgcacttgattactatgattataacattgtaatatgtaatgaaacaattatacaactcaccataatgcagaatcagtaggagccctgagcttgttttcctgcaactagatagtcccatctggggtaatgggagacactgacacaattagatttcataaggagcatgccacctagatagctcacatgcatggttcacaataaggttcacactcctatgagaacctcatgccaccactgatctgacaggaggcggagctcaagcaggaatgtgagcgatgggagtggctgtaagcacagatgaagcccatggttcacctcctgctgtgaagcccagttcttaacaggccacagactggtccatggcctgggggttagggacccctaatttagaaaatacaatatagtatcctagttctcaacattcgcaatgaaattagaaatagctttgaagagtcctgaattaaatatatatatatatatatatataaagaaactgtcttaattttatttaacacaatgtttcatagttgttttaccccacactagggatcagcaacttttttctgtaaagaatcatatagtaaatatatttggctttgtaagacaagagacaaaaccaaagttatgtaggtgcttctacaataagatagaaatcaaaccgctacaaaattttattgtagttattcaaaataaaataataagtacaatgttatgtaatacaagcctacaaatgaaaaaaatgaaatatgtttttgcaggttgcatgtaagtattccctgtcatcaagtccattgcaaatgttggtctacaaaaaccatttttactttgcatgctatacaaaaagaggaacagactagattctgcctatgtatcctagtgtgttgaacaccactctagaccatgaaaacaaatttttttgacatgatgcctattagaatttttttttagaaaatcactcttctacaatgaggagccaaaaagtagtaaatctgattggaatgaacctcatatgagaatgatttttttatgaagaagtagaaacgttttgatgtaaaaaaaattaaaaaaataattaaaagaaataggtagcaatgagcatcttgaggtgtgagttgataagcagcagtcatgagagagggcagctggaaattgagtcataaaggaagacctagacgtcagttatggcaaagaaggagaaggaacactcagaagagattgaattgagagtagaggtaagttggttggttatggagtgacagtttgagaatgtagagttaaaggttttggaatgctgaatggataaaaagccagggattattgaacattattatgggaatgataaattgatggaaggtcaatttttagtggcaacaggcttacaatctggggatgactggtgtgaacaggaatacatgacatgaaagatttatgtgatattgtctgtgtgaggaagggggtcactaagcctagtgtcagggagacttagttgctgtgatgatgggattcattgaagctccttgttctagaataaatgctattacaaagcatcatatttcttgaagcatgtgatgaaggattctggacaggagacttgcactgcaacctgagagactgtgcagataacttagaatctgggtgtacttcctcaattctcattatcctcctttttgtcttcctcctcctttttcccctctttggattacttttacattctcaggaatttcaagtctcttcagagagacttttatgaaagttagttcatgtcaaaccatcatctcttttaatctcttcttatcccatcatccatttataaagccagaatgtttatgcactggtgacacctgccccagaagtccactgctcattttctcctcagtcacattaaatcttttcaagagttatgatgccgagtcatcactgaagactgaatttggactttcctgtaaagtctagctgtctaaacatctgcttttctgcttctattcatttcaggttagtctattctaatgttaaagtatcacacagaaccacacccaccttccaccaaaggctgatgtgaaaaacagtccattttcactgagcacatgttgtttgtttactgtattaatacctgtaggagactcatatgggaaaggtgtttggaggttcagtttgagatatccttttaccttaattgttatattacagtaatgttgagattgttgctatcctgttcacttactgcttttccactagagcagaatgcaaagaaaataatttccagatcaattaaaaataaaacaaaagatcttaggatcatgatttttaaatgtcttgactctttatccatcattgtatctccaaaattggaccagtattgtactagccagtttttaggtggaactattcagaataatcaaagtaaacagtgaataatttttaagaaagtgtctccctcttatctctgtgcgttttccctacatctctcttgttctccaataattcttttacatttgtatcttgaccccactctttctctagcatacatgtctttgccttaacatttgcctttctttcctttgggttctttctatacacagcattttcaacatgtgtcatcttgatctgccttttctcatactagtttctctacttggaatagccctttctctgcttagaaaaatctactggatgggcgccgtggctcaagcctataatcccaacaccttgggaggccaaggcaggtggatcacgaggtcaggagttcaagacgagcctggccaagatggtgaaaccctgtctctactaaaaatatacaaaaattagccaggcatggcgacaggcgcccgtagtcccagctacttgggatgctgaggctggagaaccatttgacctgggaggcagaggtaggagtgaggcaagatcgcgccaccgcactccagcctgggagacagagcaagactctgtctcaaaaaaaaaaaaaaaaaaaaattatgaaaagccaggcgcagtggctcatgcctgtcatcccagcattttgggaggccgagggaggcggatcacctgaggtcaggagttcaagaccagcctgaccaacatggagaaactctgtctctactaaaaacacaaaattagctgggcgtggtggcacatgcctgtaatcccagctacttaggaggctgaggcaggagaatcacttgaacccaggaggtggcggttgcaatgagccgagatcgcgccaatgcactccagcctgggcaacaagagcaaaactccgtctcaaaaaaaaaaaaaaaaaaaaaaaagaaagaaaagaaaaagaaaaatctactggaacttgttggcccagctaaaataccatggctcatctgaagcctttttttgaccctcccatctctcaaccagattcagactgtttcatgacattccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttttcttttttcttctatctttacattttctttattaatacattttaaaactatttctcccaaatagcaaatatatatttacatgtttctttaaatgatatgaaacttacaatatcatttggcattaacatttgacaaaaatgctatttttccaggaagtctacctagctgttctgaccaaggtatcttttctgttttgtgtatcaatgtcttctccaatgaacaagcaaataatacaaatacagacattgatccatatttatgcaatggcaagtgaatgcggttcactaaggcggaagctgccttttagaaggattaagagatctaatctaaaccatatactttgctggtaatttcagctgaagaatttggtttttcttctttgtggaacgtgtagtaacccagtattgttgttgtcactgaattggacaatatcaatgaaaacactagcagacagtttatgttttgttatattggaaaatgcagttagaactgaagggaggaccaacagggaataatttattgcaaacaacccaacatgaattactgagaattaggcattactctgttgaatactttttgacatgcttttcagccccaaattaaaagttattagggcatattgtgatgtagttatgtatacatcataggtagtatgtagttgtatcccattgtaacagacagattaactgaagtacgagggatagccaattctatagaatctcatagggagaaaaagactcagggaagtattctaactgccttttattgcggatcctaagttatgcttgaatttaagtgattctcatcctcagtcatcatgggttcaattacatttaagttcataagaatactaacaggagtaaattaattctggacatgggcattttggaaccaagttcgcttttctatgattattttactggtgtacattgtgtttgaagaatatagtaaaaaaaaagttggatgtttctgtattgcaaaaacaaacaaacaaacaaacactatttattcatttgtggccaaaggtgccttgaaattttatgaagtagtataaaaagtcaagctgtgggaaaaatgtgcatgggagataaccaagcctagtcccaccttctgcatttttcagtttgttttcttatcagcctgcccataaactggaaaagcattaggcacaaacccactgataagcatatgagaatttcttctagtgtccctcattcttctttatggaatctgttataagaattttggaatccccatttgaaatacaaagagttacaatacaaatgtaaaaacaaattattgtaacgtcagaggctgaaatgcatatgcaggatcccttttgttaatctttggatgaatgagagggagggacacctacctgggaagaaagagtagtaaattcagctcactaccaacagaaatgacagtgaaggactttcttaacattgaggctttgaaggttaaactgttgcatgtcactttccaattaggatgcctgggagtaagcaacagaaatagactcaggcttacttcaagagaaaatgaattcattaaaaatattactgggtgcagcacaccaacatggcacatgtatacatgtgtaacctgcacgttgtgcacatgtaccctaaaacttaaagtataataaaaaataaataaaaaataaataaataaataagaggacaggctttggagccaggctgcctgtatttgtgttaagtttcaccattacctaccagctgtgtaaacttgggcaagttacttaatgtctttgtcctcagtttcctcatctgtaaaggataattttaaccacttcttaggtttttgtgagtgcttagaagcaaccaacaaatgttagttctcaaaaaaaaaatatatatgtatgtatataagttctcagaatcaaagagaaagttggaatttcaggactggaaaatgaacaggagttaggagggcctacacgtttttgaacataggaatgtgttcaggaaaatctgatgaggttgctgcaactggaagccacgtgaatgggcatgcaccacatcacccttgctggatgctgagggtctgctgttgctcttgcgaataatttttcaattacagttttattatctcaaaattcagggtcctgggtgggggcatgacctaaggatattttatctggattttgtcttatggttaaagactgggttgtactttccactgatactcacataatacaaggatcctccaaaatagaaagggaagtcagatgtggagtagccaaataagaggaaaaaaatgtatactaggtagccggtatagagaaaatgggtgcgtggtcattaatttaccatctttaaatgcatatacttattttcagcgtaactggataaaaatgtctgattctttctaaattgtaattatatcttttatcttttctagcaaattacttactactagcttccagtaattaaaaaaaaaaaaatcaaacatctatgtacaggtacactgaccaatatccatgaactgattttggttgatttaaacctgtagacaaccatgagaagtattaatatcacatctttacaaatgagaaaacagactcagagagatgaagtaacacgattgcccaaatattacaaagagcaattgacactgtcaggatgagatctcatgtctctgtgatagaaatttcatttttctacagaaccatgaaaaaagttatctttcagataacgtagctgtcatttcattcactattgactatctctacatttcttagatctctttttttctgtatttttttctttactaaaaatcgtgcttttatttttattttctattttgagttctattgcaatcagtcatattaggcagtaacattttctcctaaattaatgccctcatccattggttttatttttccttattctccatatctgtattaatttgtgtatggttttaatgaaaagtcacattataaaataagatcttgtatttttttaatctttataacctcaaggctcagcacagggcctagcacataggaggtgcctgatacatatttgctttatgataatgggctcgaagaaggaaaataaggcatgacaatggggtggcaaaggaaaagtgaaaaaggagaaagttgggtagagaagaaaatggatatgcaatgactagataaaaccatcttctagcacttcgacccgcataaatcaacacataagggatttttaaataacagttataatattgataactgtttgtctcctgtgggttccagtttatttctcggggcctgtaaatatttttcttaatgttttcaattaccaaaatgatttattcatcacgaggtcttctcttatgctaaataagttttatgaactgacatagccaagagaaagtctgttattatattccttatattccatttattggagttggtctttttgctaacttttatctggtatccatttatctcctaaaaagcgtggattaaaagataaggctttaggactggtaagtgacttacataattatgaatttaagacaaagggacatatttcatttctttgaaaatgcataaagtgctgcaaaggttttaagaaataagaactctttgaaagggcttcctgatatgaataattgcaaatgtcaagggatgagagtttcctgatagtgattctatttctagaatgtcaggtactgatgcaaaggtgacatgagtgatttgaatgagttgttctatgtctcagagatggtcccatagagaaatgaaagcagtgctttataaccaacagagagatttatttaagaccaaaatgtcagaggtaatcaaactgtttaatttgtgctcatagttttgctttgcattatataactggacacacagaatttattgtatactgacaaattatggaaacagaattttataaaaagtaaagttgaatgctgcattgtggctttcagtaaattttgataaaagtctttatggtaatattcttaatgaagtataaatgctgatatatattctatataacatttttccttttgctttaagtttatattagcatgcatgcaacaaaatatacagaactgatcctcgtgaacacttccatgtgcatggtgccaagtgcagaaacaaaacatcgttcacactattgaaaaacctgtattctgacacctaccagtaactatttacccacaaagataatcattatcctgatttgtaacatcgttattggctatcacaaatagcattaccaagaacatttttgtatgcgtcttttgatacagaaatctatctatctacccatataagtttctgttaggtatataccttagagtggagttgctgagtcagacctatgctcagctttggtaagaactgtcaaaaggattgacaaattgattgtaccaatttattctcccaccagcagtgcacgagggttccaattgcttcacatccttggcaacacttattagtggctctctttttcattttagccattctaattataataccaaaatattttgtgtgtgtgtttgcttatatatactcctactaccaaaagaatgtaagtgacataaatcaaaataagcacttttcatttatcaatttatacatcaagattttaaagagtaattcctccagatggtttctagactaaaatgcagcatattgcttagaggaggaaacttttcttcaatattcgatgatccatctaaaaatatgtcttaaatatttcaaaaatttatatttattaaacaaatataaaggttttgcaacagcttatgtagatgatggaattcaaggtgtcttattcttacaatatctctgataaaaaataactgtaaatgtacttatatgttttaatatggtctatatgataatacttttttatttattgaaataaaatatagcatgttggaggtttctatgtgaaatagaaacctaatagtgattctgtttcactgaagaatttccatgtgtctcatttatttccaaaacaatattacatcaaattaaaagacaaatatttagtttattctaagatgtgttcttaaagacattgataaactggcatgactaaaaaattaaatgaaatcaaatttttacctcataaaacaaaaggtctaaggttccagataaattttgaagccagtgttttgtcaggggccatggtaaggctggaatttgggtggtgggccgggagccaaaaagagctgaggatatggttgctggaatgttcaagttctattaggcagggaagaaggtgagaacttcataggctttgaaagatatgcaaccagtgctaaaaagagccgcagtgattgactctggaaggtgaagcttaggattcaagtgggagatactaaaacattggcattggaattcacaaacattttaggcatgtacatttaagacatatgttaggaatcatgactccattttgccaattataattcctgttaggcagaatatctgaatcattcttctgccagcagtcccccatgtccatcacctattctgtaactatcaccaattattttccccaatattttcctaaagctgattaaacactcttgggtcataagaaatttacatttgtcaataactgaaaaaagttggttcaaactatgtgatctagccttcaagctgccctatggttttgtacaaatttaacctttagagcaaccatatcatcatatgtatattatcacaaaaattaatgttggtactttattcataaacatgtataatttacatacataaacttgtataagtcatgtacaacaataaatatagtgactaatcatcagggaaatgcaaatcaaaactacaatgagataccacttcacacctgtcaagacagctattataaaaaaaaaagtgttggtaaaaatgtggagaaattggaactctcatacactgttcagtatacaaaataatccaggtactatacgaagacagcatgaaagttcctcagtaaattaaaaataaaactaccttatgatctagccgtgccagttctgggtatttattcaaaataattgaaattggaatctcaaagagttattagcactcctatgttcattgcagccctattcacaatagccaggatgtagaaacagtctcaatgtccatcaacagataaatggttaatgtgccatatacatgcaatggaatactatgcaggttttaaaaagaaggaaattgtgcaatatgcaacaacacaaatgaaccttgaagacattaggctaagtgaaataagccaggcacagaaagacaaatactgcatgattccccttttatggggaatcaaaaatagtcaaatacatagattttaagagtgaaatggtgattgcaaggggctgagggagaagggaaaatgggaagttactaatcaaccgacacagaatttcagttgagtgagattagtaagctctagagatcagctggacaacattatacctacagtcaatgataattcattgtacgcttacagatttaagagggtagatttcctgttgtgttcttatcacacaatttttttaactctttgcaatattttcctagccttttctgcttgactacctgctttccacttctgtaccccactgtacctcctcccatattaaaaggcaaacacagatccttccatagtctcttcatgcttttgtgtatttgtaaaatagagtcatgtatcacttgatggggatatgttctgagaaacgtgtcgttacgcaattttgtcgttgtgcaaacatcatagggtatatctatacacacctattttgtatagcctactaggaataggctatatggtacagtttattggtcctaagctacaaacctctaaagcatgttactatattgaatattgtgggcaactgcaacacaacggtatgtatctttgtatcaaacatatagacacgtagaaaagacacagaaaaaatagaatattaaaatctcatggaccacccttatgtatgtggtctgttaccgaccaaaacattgtaatgcagtgcatggctatattgtacaagcaactatagtcatccatttttgtactgtttcagtaaaggtttccaaatgggaaaacagatattactctagtggtccagatagaagagatttaatacagataattgttacaaacagtgtcgtaaaggctggaggggccaaagtggtggtatgcagaacctgtaaacacatgttgccgttatcaaggcaggaccccgggcttacactcccgtcaccactgccactgaggtcctattgctgaggctggtgtgccagagccactgccagaggcttccggtttctgactggtagagctctcctttttttgcagaaagtaactagaagtcaactagcaaagaagctgagaagactattttgaaaggaagtcttagaaatgtaaatttcaggctttctaaccacccccagtaataaaaaaccatataggggcagcagcgggactgacgaccaacagacaacctccaatgtttatgtgtcggcgagattactgatagtataaatttatgttagtattgtcattgtctggtatacaaagatgggcttccgtcgaattctttgttgtttttgcttttctttggttttctctcttgcttttgtcacttgacgatatctcagtgaaatttttccaagtcaactttattcttttccaagcacaaatttattctcttcaagtcatgaatgttattatatggtgtggatgaatagtaatccatccaggcattcgattatgatgagttttcatcttgactctgacaattacgaagagttttcactttgactcttctttttagttgaaataaacatcactgctcattgctctctgcaggttggtgtattttgttgttgttgttgttgttttttgtttttttttttttttacacggctaggtcccaggtttaggattgctggtgagatggaatatgttttgtttgcaattgccattttatattcccaaatgggaataacacattataatttcacaactaaattagaaaaggacagttttcactgcatccctgccaccaataggcattatctgggatactttcttaattacaattttatttcccagaaagcaagccatggtggaatgaatgcaaatactatcccaactccagtgtaactttacagatctttccaaaccattataatgcatggagatttttgaatcattcaccattttcaaatttaaaattgtcatgaaaattactcaaatcagtgaaggcagaatagcgtttcagtaatatttcagctaaaacaagtctaatgtttaattatgtatcttttattttgtgtttttattttcttttaagatggctaaaattttgtgagagtgctgctattgtaggtttgtatctgccattgtcgcaggttgaatcacttatggtaagctaatttatattgtaactgcattccaactcaagatcttcatagactttaatatcaaattttcatttcttgccacatgttcatcacaagttgtatgtcagtgtggagagaatctgcctaatggctcttcacccagaaatccaggctgctaggtgtccagcatctggtgaatttgctggtagttgtggcagaagagaaggtggcaaattaaaaattgactcttaaagacttctgcccagcagtgatgtatattgggtccaatcatttgttaatgagcaacattgactaacacattgattcgaatatcccttgaaacatttatgacatatttcctaacttgacataatgcagcacatagtatttcaattgttcttctatttttttttgtggtgactttacccattttgaattattttatgggtagagtaagaccattgattttgaaaaactggaagttgactggctctgcaaattgaagagttagctggtaaaatagctttccctttttatttgttgtgctgcttaggtgttgtgtttgttcttgcattgctatagagaaacacctgagactgggtaatttataaagaaaagaggtttaagtgattcaaggttctgcaggttgtgcaagcatggcatacacatctgctcggcttctgggaaggcctcactggtgtttactcatggcagaaggtaaagcaggagcaggcatatcacatggctagagaagcagtaagacagagtggggtggtgggatgccacacactttcgaacagccagatctcacacgaacccactcatattgtgaggacggcacccagctgtgagggatgcatgcccatgacctaaacacctcccaccaggcctcatctccaacactagggattacatctcaaaatgagatttggcagggacatagatctaaaccatatcaggcgactcactgaagaaaataatagtataaaatattatggcagtttaatcaataacattaggataaatagcattagtgtgtgtcatattttcattgtgattaaatctaaatgcagcccttgatcattgtcattggggtccagtttaatttcctcagagtgctcagacagtacctggggatacttgcagctctcaaattgttactaatggttagagttttcaattatttttgaaacaaatacaactcaaggataaactttgataattgaaaagggattaggatgttaaaaatgcacactttcatgaagacagctacttattttttatccactgaagaaaacatcttatggacattctctcatattacagctttcagtggcatggcattagaattctgattccatattgcttgttcttctacattgaagcagatgtcagtttcatatggattctgagtatccagtctgtcaaatataaatgtaattactggtcaatagttttggataatttttacatctgttgaagttgtggaggttttattaattattttgacttagattttattcccttcagaaagctgagaattcagaaccatattactttgggtgaggtcacctccactcctaataagagcaatatgtgctgagtagtcccggtgtgcatgatctgtgctgttatgactcacaagtcccactagaagtttcaggtacaggaaaggaatttcctccaaataaggaaaacgttgtgcacctgtgttgtatactgtttgtgaaaagcaagaggatgtagtattggaaaggtgtaaagcttatgctttagttggctagaacaaagttcatattttttctcagttatcaggggtcgtgaaagtcattaaatccaacttctatccagtgttagggaatctgagaggtaattctcaaacttttgcctaagtgtgatccacataattttagtaataagcttatttcctatttcattgtctcacctgagaactttctaactgaggtggaagcaataaatattatttgttaatagctctctcctcctccatgtcccttgccttcctactattaatactaccactattgctgctactgttctgctcctactcctaatacatatttaactaatataacatgtactctaccagacaaaacgttgggataatttacatatcagctaaagctgtagaggcttcattttgacttagagtttgttgcctccaacactcttaacattgtgaaccaggttatcttgtgtacagtccaccctgcttttagtaataccccaatgtgctatttattctgcattcatcatctcatttactcttcaccacagatctgtaaggtatgtgtgagccttattcacattttataaagtagaggaccgagatttagaaaggttaagaatgttatcaaggtcattaggattttaaatttaggctgcctggctataaagtccacgcttgtaaccaccctgcagtaccctcctttcattgtttttatttatttttaaattcttactctgatattgagattctcacctgtggtataaaaaagatcctgttgtagcggtggaattaataattaaatacacccacctgtaaatgcttgttaaatcaccagaattaaaatagaatatccatgaaatgttctagatgttcaaattgctcttgtcactgtgcacaccaagatttaaaacctagggcctcgtaagtattcagacaattgtcttggaagatcttgtgttttctctatttgctactgtgtgttaattctataccatgctaggatacaggggccctatgccatctttcaccttcttagtagaatgtttgatctaaatagcaatttggcttgccctggacaatgttgtgcttcccctaaccaaagaaacatggttctctggaagattatagtaccacattggtcagcagtttcaagtatttggcattgaagacattgtaaagcgaattataaataattttatcctgaattatctatatcataggcacattgtgacattgtttagtttgcaccattgttcctgttgttggggctattgttgatattattttggcagactgtgctatgttcaaattaagactctctctggaactctcagttataaggttattattattgccgtactatttacaaaagagttgccaagactggtgcactggaagctgtgttccacttatcaattcaaaggaattttagtatcgtttctaccatcagggaatctgtgagctgagctagatagaatcagagagattatctagagattattttattgatcaccaaatgcatttttgtaaaagtaaagaccccaaattgaagctcttcaaacagtcagttggtgttactaaaatggcttatagttacagttatcagtctcttgagtaagcaaaatgttatctcaaagccaaaacaattttgtggtatggagagagattattaagtagttgaaatattgttgctgaaaatatggatttaaaagcatcaataccaagtgccatggaatttccaaatgacaacttgatattgatacaataaaacagaaaaagccattaataattgaaagcaataaaaacatatgccttgaataaaaacaacttgaagcccgtaaataatacaacatggctattcagtgatcattctgtaatattaaagtttcaaaaggcatcctaacgtgttggattttttgtttgtttcacatttcctgatccagatttatatttttgaaaataatatctactatcaacctgatataaagagcagttcattgcgactgacatcttctggaaaagaagaaataatttttaatgggattgctgactggttatatgaaggtgagttgatcagatttagtttcaaaggaaacaaatgacatatttttatacaaaatctaccaaaaaaaatctattcattccggagcaatacttacagtacagtttcttctcattttctctcaaaattgccctcatgctttcatatctttgcatgtgcttatattttgtgtggttgagatttacatctacttacatgattccatgtttggtgtatatatgtacatataggctagatagatattatttgtgaggacaactaatgaaagtaaatggttaccttatgtcactttggaattagatgctgaattttttctgactctctgggaaagaagaaacagaaacctttatttctaaaaaaaaaaaaaaaaaatgcataaaaagccacctgattttagttatttccattagggacattctgtcacactttataagctattgcagagggagcaaaataaaacccacataaagagttattttcaatatctattgaatcaagttttagtaatagctgagaatataaaaataaatcaggtgatgaaaatttatccagtttttatcacgtaccaattatcagctgagttctacatatagattgcctgggcaagactcaaagtatgagtttattacctatgtttcagattcttcagctgattttggcaaaatatgtcaagatttaaagtaagtctactttattataaattataaagctatgaatcattcaaaaagtgaattttatttcatgggcaatatttgcaaatgtaatctctctacctcagatttgacatttttaattctataagaaaagtgaataacttagaccaattattcattcattcactctttcactcaaatgatatcattgaaggcctactgtattctggatagatgtctaggtgccaggataaaagacggagcaaaaagtactgctctaataaaccgtatatttacgtgaaatattttgttaggtggagctattttattaaagaagagatgttgtaacccttgagatttatatgtatatgtgtacatgtatatttatatctataatagatttctgtgtacatgccagcatgaaataagatttttagaggctacaatttattgtgaagagcagtgagagcttccccgaaaatattaacaataagtatgctgtgaaagtatatattagaaaaagaaatacacaggtaaggagtgttcattggttgagagttacagaatctaaatctggcttttctatttcaaagagatacattactggaggggactgggatggccctcagaatttaataaacaggtggacaacacatttaaaatctggttagttctggcagtctaggtagcaggagctaattgaagtgcagagactaagacgtgccctttttcttcaaaatattattggtactgtgtgacaccctgacagatgaagaaaccatgttaatgcagtgtggtaagtagttgaatcttaatcaacacagaattctatggaagaacaaaggaatgataccattctagggatttgcaagcattttttctaaaggagaaaccctggccaacaacagtagctcaagcctgtaatctcagagctgtgggaggccaaggtgggagaattatccaaagccaggagttccataccagcctagacaaaatagcaaggttttcatttctactaaaaaatttttaaaaattagccagatgtgatggcatgcacctgtgttcccagctgaagtgagaggattgttaatgagagaggattgcttgagctcgggagttgaagactgcaatgagctatgatccaggcccctgaactccagcttaggcaacagagtgagatccttacctcttaaaacaagggagagagagaaaaagagagagagagagaagagagagagagcatctgagtcaagcctgaacagttaacaagtgttacgcatgagaagaaattaggaaggaaaaatctaagcagatgtaacaatttgcaaaaacccacaagtgtgtccctagggaaccaaagtctccttgatataattgggccataaaatttgagacaaaggaaggtagcaagaagcgagggatagtgacctctatcaatgatttggaatttcaattattttcctaccatttaataggaaaactaatagaagttttcaagtaagggagtgacaagattggatcttccatatgaacagattgtttttgtgacagcaggaacctggggtctaagagtggaaagaaacggtgagcggctgtaaggcttcttctatgttctatcaagagataatgagcaatggaactagggttaaagcagtaaaaaggaggaaagactctaaaattgatgagacaatgaaatatataggtcttagtggctaagcagatggggtgaatgataagaagtcaaggatgattctgtgtcttctggtttgggtcactagtaagtagtggtggcagacatagtgagcaagcattaacaaggagcagtgggtttcagggaagagaagactagattagcagcaatgcgggcattgaaccacgtactgacgtgctcccttggtgataaaaggtggtctgtaacgtcgatgaagttttcagtcaactgagggtatactcaatgtagaccatgcttattgtgctgctccgtcccgaattaagatgacttgggtctctgtcctattgaaaaggcttcatacatttataaggaaattttaaggagagaaattagagaccgtttcctgacaaatacggtaattttcttaactaaagaataaaaatctatgtattcggtctgagagtaaactgtttgtaggggttgtggagagcagaacaaacgggtaatacaaacttttgtgatgatgctgtaggtctgacgcattccaaaggggaaaggaaaaagtatagtttttgccatactttgggctcctatgttgccgttaactaggaaatgctgtacgtgtatgtgatttaatcatcaaaatgtttgtgcatctaatcatttatgaagaaactaagacgcacccagtgctgtggctcatgccagcaatcctagcactttgagggggcgaggtgggcagatcacttgagcccaggatttcaagaccagcctgggcaatatggcaaaatcctgtctctactaaaaatacaaaaaaaggctgggtgtggtggctcatacctgtaatcccagcattttgggaggccaaggccggtggatcatgaggtcaggagattgagaccatcctggccaacatggtgaaaccccgtctctactaaaaatacaaaaattagctgggcatgctggtgcgtacctgtaatcccagctactcgggaggctgaggcaggaaaatcgcttgaaccagggagttggaggttgcagagccaagatcatgccactgcactccagcctggtgacagagcaagactctgtctcaaaaaaaaaaaaaatttaactgggtggggtggtggggtagcacatacctgtgttcccccctactctggaagctgaggtgggaggatcacctaagccaggaagttgaggctgcagtgagccaagatcatgccactgcactccagcctgggcaacagaagcgagaccctgtctcaaaagaaaaaatttaaaaaagaaaccaagactcagagaggatcagtgatttagacatggcctcagagctaatgagtgggagagccaacatttgaatgtgtgtcttttgttcctaaagccagggcttagtcactagtctactctacttgttatagggggatgtccttcactgttccccaagacacaacacacgttttgggacctaaattgtcagacttcagtgatctgtttcctcagccaaagactcatcctactgtccatggacttactctaatcctcactgcatttccaggaggaaccctacccatgacttcaatgttaaggtttggcagagggatgtaagctattcagatgtttttgattttccctcactattttgactgctacccccaacctctgcttcaagagtcctacatgcaccttaccctcccactatcaccttgcttgtggaatgtgccaggagctcccaagctccagaccttttttttcccctttaatgcactcactgaaacacaatgatattgcctagggaatgcatgtaatttcaacgttatgtgtgtgatactctggtgtggagatttcctttttattactttacaggagtcaattacaatctaaattagcatgtatgggagacacagaaagtaacatgtaacatttcaacttttttaaaattgaaatttaccttttgtaaatgtcatagaaaaaaaagatgagagaaagagtgacataaaagacaataaaatatttttacagtaagctttacaggcatgtcttaatcttttaagaccaggccaatctgtaagagtggctgctgcccccaactagtcactaaatagagtccttaaaagtgtcagttttaagaatctttgtctctatttttagtattgtttagttcctaaagaaagtaaagcaatataaagtataatgcattttaaacagcgaagtcagaaaaataagaaaatgctcaaaaaggaagattatttaaaatgtaattcgcacaaaacacgtataatgttattcacttaaattgctgtatttaacctagcaatgtaattaaatacgatatcagatcaaagttttactttaaaaacttttaaaatgttactaaaaagaaagtttacagctacccacttcacagctttgaaaatttccataaagcatttaatctattaaataggaaaaaaaatgactcactttcaaatatttaagcatatagaataatggaactaatatgcttaagtgatttacagatatattttagaaccttgtatatttaagggattattccttaaagtttaatccaacagctgtggagcaaatatacctgccaggcattatctaagagcaatacgatgagaaatacgggtttccatgtcttgggtatttccaacttagtgtagtgataaacaataaacaactattgtattgggaaccatttggagcatagtaaatataaatataaataggatttatttcacatactaaatagaattataagtagaactaagtttgataggatggaggaatgtcaggtgcttcatagatgacatgggccttgtgttggtattcaagaatgacaagaatgaaaaggtgcggaaaaattcacgagataagcaatattcttatcagcagattctgattgttacactttttttgttgaaataaaacagggcaaaatgcctattttcaccttcatgtttgtttcacattaatgtttcacattaatgtcttttggcgacatgaaattgcattcatttcatcattgattcaacaaatatttattgagcacttgctcagtgtcatctatggggctgcagcatgggagtcacaggaaggcagggttatcagtagtgctgagtctccagaggtcaaacaagggaaggattccaaagcttttgttggatttgctcatagatcatcgatggccttgacaggagtaaaatcagttaattggtggggccaaatccaagactgcagtggatggacatgtaaatggggagtgagaaagttatgaatagagactattctttcaaggaatttgacagtgaaatgcagaaaattgaaaaaaaaaaaaaaatcaaccacaggcctgcagagctgcaagtagcatcctcaggaaatcctactggtctgaactgacaaactaaaaatggaaaaaatcagcttgctttttacaataacacattaatctaaacacaatcgttgtatctcagtattgtggaagtgctttgtgttgtggctatgtttttaagtgcctgtgatataaaaccacatgtgctgaaaactccatctgctctgcagtgagattttctaaatcagagtaataaaaacgatgaagagccaaacgtacactaaattggaatgaaatgccatttgtaaaaataaattctttgtaaataatataatataattaacattggaagtttcaatccatgagtaaatgtgcccattagttgcagttaaagaagcttgtgccttatccaggatgactgttaagcaaatgcatattaaagattattttatttaccaccttcccattccaggtagctttatctttccatctgaagaaagtcacaaggctctctatatgattattttggtacattagcatttttatggggaagaacattaatcatatgtcactctaaaataaatgagagtaggcgatgcctcatttctcttgaaaagcgtactcaaatttgggtcaggtttattcttgggaagtactggacacacatatttcagcacctacgacagaacctgtttcttagaaatctagagtattgattttagccaacggggtatctttgtatcttcaaatctcatagaacttagagtttacggtggggccgggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaaaaaaaaaaaaaaaaaagaacttagagtttacactcaattggcccttagcatgcatatatatacacacacacgtatatgtatatttttttctgaatgtgtcatgtgtataactcatgtctccttaaccaaattgtaagttagttgcataaatcagtgtcaatatcacaactgaagaaaggtggcacgttcaaaagggagtaattcaaggagtttaagctatgaaggggccccttatcatgaacaaggtaaatgccacaaccgtggcttgtaatgatttagccattaacagccaaagggggaaggggacacagcagtcacctgaaactaggagagaatgctatacaatttttacagaaatagaagcagtggcttttggttgggcgaagccaaactcacataatttggatgcatgggagataagaaaataaattccacgcacccacttcctcccttcatttgattcgccagggtttcatagtggtcatacccaagaaaaagtcaaagaacataagaatattcttattattcaaattaaaagctagtgtcccaggaaaagaagtacataaaatctcatctgctattgtttcattgcaggatggtattagtcctgttatatatctgaaatctgtaaacatagccaccacttgtatttttcatagaaggttgtggagaaatgcccccattaataataataataaaaacttattatgtgatcttagttagtaattacagttgccttcttccaatgttcatttcttttacttttactttctgtcaggatgctacagaggttatttaacaggtggatcaggccaaaatttcattcctgccaaatgttactcctttccatccttttctatttttttttttctttgacagagtcttgctctgttgcccaagctggagtgcagtggcacgatcccggctcactgcaaactccagctcccaggttcaagagattctcctgccccagccacctgagtaactggcattacaggtgcccaccacgcccagctaattttttttttttttttttttttttttttagtagagatgcggtttcgctatgttggccaggctggtctctaacccctgacttcaggtgatccgcccacctcggcctcccaaagtgttgtgattacaggtgtgagccactgcacttggccccatccttttgttaattatgttgttacaatttcagttttccatcgaccagtactattgggcaaaaatgtatttgtgactctcctgagttccaaatgtatttctccttgccctcctttgcacagcaaacatatttttatttctggcagatgaggaccatcatcagacccagcttagtaactgtgttttgtctttttttgggggagttgcataatgagcccacaatggtggggagaaaatttccgtttccaattcagaggaatagaattatgactatattcctggtggataccctcgtcctttaggcaatggacttctaaactcaccaacttcaatattatgggaataagaagcaaattgtgttctgtgggttattgctgtgataataaaagataacactactacttctaccccttagtgcctagatctgtacctcatggctatacaggtggggcacactgcatgttaaaggatgacatcccggcttcaaggttattgctaaacaaatagtgccaaaactgaggtagagcagactattttactcctctatcaatccaagtacatatagctagtggggaacatgataaaattagtaaataccaccactgagcccatggtgcttttttgccacaaaatatttccttttttgagataaggtaatgtggattattatggtaatggataaatgtttctgtaaagagtagtgctgaacagatccattggcagcaaaagcaaatccatgcccagaatatgtgtgtatctctgtgatgacaaaatgctacactgtcttgatggaaaggttttcatataattcatgtgccttcctcattacattatctcaaaaaaggaaatattttgtggcaaaaaattcacgtgccatcagctcttcccctgagaagtgatcctatgtcaaaggctcagcgatggccactaccattggcaggtaatggtgggagccagaggctgacggacatgtacttggcagtcatcttgtcctaaatttttcccctttctagtaagtcgattcacttgtttttcctaaacctccctgtcactagttttctaattttacttttgccacatccctgataggtggacccttattagttactgcacttgagtcaggatgtttccatgcctgaaactaagtctcctaccacgaacagtggacaacgaagtattctgttcaaaatcttaccaactgggaagatttctgtttcttattgtctttcagtgccactcctgagtcagattctagtatggagcctacccaattccagctcgttgttgtacatcctgcagacctgccataaaccaggcccgcgtttatttctcccttgccaacttgtgttagaaaacatgctttgtggcacagatgtgagatgaggagaggggatgaagcagagaaggcaatacaatgggcaatcacatttgttttctggctcaatttcacttttattttatagtggaatggtgtgtgtgtgttcagttctatggtcagtggatcagatagccatcagttcatgatgggcagtttgggttgcatactcacttggtatcccatggtgaggctaaatgtttctcctggagccctggaaagagctgcccttgaaatagataatatttttcagtacaagcgacaatgatcttttttcaaatcttgtaatgcctgtcctatgattgtcatatggagagtcccaaaggctccacacagcatctctatttgccatgggcactgacattgccattggatctgctggagtcacaaggttcaggacatagaggaggttgcaacatggcctagatcagttgcaaggccccctggtacactgattctactcagaactagcagttttacagcttgcctgggatatagaacagagaacatatgtcaatgcggcttgtgttgttttcaaagtccaaagaattcaattcctctttacttttacataagtacaattgtaacaaattttctctgactttagaagagatatcccggtgtatcccaaactactagatttctagaaacatccccggtgttgcacacttttaaattttaaagaaatttgtctccctttctctacctctatgcagaggagttctagttccctaggatagcggttgcctctgtcagcaagaagatttgtcagaattttgatgttcaatatcttcagccataaaattaaccacatacagcagcattcaaccataatgtgttatttataagattggccaagaaatcataactatactgtatgcttttgtccaaacattcttatcctgtgtgttggggtcccaatccatcgttatgaatatctttgtcttaccctaaaagagcaaatggagttgagcctctaatatgtattgcagccgtgtacccgttcctatgttctcttggactgtggccatagtttccctgcaactacagaagagatggactcttccaaagataccatcgtgacctttggttttgcatgggcattcctgatttcacaatcatggtttcaagctttcttttttcctgtgtactatctgtggggtgtcagaagaaccatgcgaacttgtttcctaatctttacatcatcattgttgtagcaagtaagtgctacaacacttacttgctataactagagatgctgtgtggagcctttgccactctccatatgacaatcataggacaggcattacaagatttgaaaaaagaccattgtcacttgtattgaaaaatattacctatttcaacaagcatttgttctcccaatgccttttccctctacctgtattttattccatgtcaccaccactgatgattgattactcacagttccgtctcttgctatggattgtctatgctccaattcccacttgagaaggtgataaattccatttgtatatatagatagagagatgacaaatgtagtctcaacatctaattttgagggtctcttctgagtctgctgctattattaacttctgtatctgtcagagtcccaagtgttggcacattcaacaagatgctttgaagataattgatttacaaagtgaacattttattgtctttttatttacaaggagaacatttgctgaggttaaggggtaggaaaaccacaaaggaaagtgatgtaaactaagctagtagcagccaagttgttagcactcctatgaccatgaagatgagccattactagacacataaggagaaatttgtgtagaggtggctgcagtgacagaagtagtgacatcatttaaagttcacagccagcctgaggtaacattgtaggatagagccaagagaataaataacctgactttactctcctctttctaatctcctgccaaagggaagccagaggacatgggggccattttgatgtcgttcatataggttagctttctggaccagaaagcgggaatcaaaaaagtggatagtggatcttgaattaaatgaaagatacccagtatacttcttattccattttcttagagcttaaaatagtttgatgaatctagtgggccctcagtttggttgatgatggtagaatgcaaatatgattacatgcaaatgtgaatgaatcatgacatggatatggttttaggccacatctcactcttcaatcaccgttctcattctgattactccagtagtgctttcatctgttctgtctacattgctgaaaatccatgaaatcctgacttaggtgcttcattgtttccttcctctacagctgcttgctcttcctggaattaaaagggtgactcagaattagagaattttcagggaagttaataaaattcaatacacagtctagaaaatataggtgtacaatggagatttcaaggacagatgtttgtgggtcactgagcccacatctctacagttggtctcaaataacactcatttattctagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggtaagtaacatggaagtactattttgttccttctctctctctgcactagtgacttgacagatggtattcttggttcttgaacaagttgtctttggaggaaaacagaagttttccttacttgtcagactcatcactttcgatctcccagtagtctatacacagtgcttgggtagagagaggtagagatgatttgaaagtgtgtgaactttcacttttgttgcatttctttccttttgatgctcacttttattttttcacaccttacagttgaaaggggagagagaagcaattgggggtgtactgaggccagggcaatgttttgtccaaggcctattccataataggtgttacaaaggaggggaaagtgccatggtcaaatacattggaagttcttaaaaaaaaatctagcttctttcagatgatttcttagagcacttaatgtgctatatgttaatgtatattataaatcttctataaaaaatagactatgcataaagaatctccagtctgaaatagattaagcataaagaatctcaataaagaaaggaccaagtataaaaaaatcacccataaagaatagactaagcagaaagcatttattagtattagtatcaatatcagcattaccttggcagagcatactctagaacacactatataaaatgctggtatggagtcatagccatggttaggtaagacagatggaatttttcatcaggtgaagaaatatggcaatatgttccagacagcaaaactattttcaagtgttgggcaaggcctctataagagggttgcaaaaacatctggattgtactgttttttcctctgtatgccatctttaattgctcgagatctcttttaaacatgtattttttcccaatgtttatataacaaagaagaaggctcatgtgtaaggcccccagtatattaatcatgtaaagaagtcttatgggaaacgtgtaaaatttctcttctcattttagctcctaattaagtaagagaggatgttgatctcatttagaagccatttttaagccatttctttagtgagttgtactttgtctttttcaagcacaataggttttctgccgtttaattcatgcactacattagttagacaaactactgggtaggttcccatcaccctcattactctagccctgtcagggtgggggtgaggtcatttacactttccttctgttcccaccagccaccatattcattttatccaaaggcaaaaaaaggaggcttgaatattgaggatcagaaataaaatgagcatattcctcagtgagatttctcatccatgttccttccacaggttgtagtattaaatgcaagattataaagagtatgattccatgattttaaaatgtgatttatagggtcttctctggacatagattagaaagcagatatactcagtgctttttaggagaacataatgatttaacttcacaaaaaaaaaatactaagagatttttattgtactcaaagaaaagaacttctgctttctccaattatagatttagctttttttttttttggcatgacagtttggacctatacagcataccagcactattttttcccccagagaaaacctgaaaagttgccccaaatatattaattctcacattgtttgatttatgataataaatgttcacctgacaatttaaatgtgaaatggagaactagtgacatactgtgaaaggcacattcaactgttcagtgcactgcacaaagggaatacaatcacatctgactgctcaacgcactgcacaaagaaaattcagtcagttctgtggaagggacaactgtttgtaactgatttcccaaaagaaatgggatttttttttattcacatagtaaaaccaaatgcattgctgcatgctcaaattgccttcttagttctagactcatggtgcttgaacttggccatgcctaggcctcataattttgactagattgagacaaacaaacaaaccaatgggagcatttgaggaaattaaattatgtcagcaataattcagaagatactggatatgaacctagatactttatcatttgataatgtcttctaataaattaatattgcttaatagtaaagataggcgtaacataataatctttgtttattaattgtagaaatcacaggtactaatgataaactttatgttttcagggagactttccacttgtttgtttttttcttatttggtctttatcacaattgtctcaattttacaaatgagcaaatagattctgaaaggcttagtgcttttatacaagtcacagttattttaagaacagggaaaaaactcaaatctattgatttcatccctctctataaaactcccacaggtcaacaatttgtatttccaaaaacacagctggaatccaaacatctccttgtcaagttaacatatacatatggagctctgtttgctccatttactcctaatgacttagctacatgtgggtgccattcttagcctcaaacctgtcattttatatatatgcaaataatatgtataactatatatgataactaccattaatatttattagaagtaaaaaacatatgcctctaataggcaaagccaaaagaaagaatttccagtcctcaggtgatttttagtaggaagacctgctcacctacccaggtacttaagacaataggactctaagaaaataatctgttttggtccttgttcttaaaacaaatttcagtatcattttgggtatgttacgtcaattttcagattttttattatctactctggtttcaaaaaatgttttgttagtttttgctgtaacaaatgtattgtttcaattcactcttatgtgataaactttcaaaaagtgccactttggaaactgaaacaacacatagagtttatactaaattgtgctttaaattaaactagatgaaaatgagtatagcaaatacctaatgtggtcagatttactaatgaaatacagtaaacaaatatatttgtattttacttaattcagcatgattcagaactcataaaataccctatcattagcaattcagcacaaaacagatgcacggttctatcccagtaacctcaggttaatctttgtaattaaaacattatcttgtttaatgacaatctagttgccagtaaaataaggttaattgttattgaggcttgtgtttcagaataatagaggggagaaatttgtggatttgcagtcttcatggcaaatgtaactgtaaaaagcaaatagatgaaaaccctccaatctgcaaactcttgaaattattcaaatattaaaatttacaaatgaacttgcgatgtgtgcttaatttcaaaactccatggaaagatacaaatctgtgattagagaatgctggactgttgaattttggaggcagcctaacgcttagttgagatgttcacgttttgtctgaaaactggccacattgtgtgcacaatttttactttgtgataagcttatagcgctgctgacataaagaaaactgccttaaagatgataactgatacgtctttaagaaagtatgccataaaactgtgcatcattggtaagaattcacagaaagatctaatttaatttaatttcccgcttgctttaatcagtgtatctaatgataaaaaatagaagcacagcttttcactaactggaagatttaatgtcttaacaataattatcattttaattcactaccatatactattttaggcactttacataaatctttttattagtttatgagatattcttatctacagacaggaaaccttcaactcaaaatttctgatttgtgacatattctcaaagaagtgtttgtctcatttttgacaaaataagacaaataaaatgatacttgagaatctttagcatgtgctcataaccatgccaagtaaataacagactgaacatttggactcaggtttcatggacttacacattaagctaagcctgttctcgaaatgtggtcctttcaccagcatcatagggcatcagcttcatgctggaggtggactgccttcagcagtcagtagcttaagaagcccctcaggacctctgaatgattgcgatgctgtctaacttttgaccaccactgagctgttacatagatagatgcataaatagataaagatacagataaaggtcaatgttttattaaaatttgcacactcactatctgggaattttgtaaaaacagatttgtaggcccacactgagagattctaattccaagtctgaatataggtttcaggtggggtccatgaatgcgttgctcaggttccaggagatgctgattgatgctacggtccaagaacaacactttgaatggcactgccaatactgtgtcaggctgtaaagttcaacatacgagacccagctagagaaatggtaggctggtaggctaaaaattgaatagattaaggccgttattttgagggagaaacatgacaactaaattaaaacaagaatgatgtgaaagagagctcataagagtcacagaaggctaaactgcccaaaaaatgttcccgggcactgttgggcttgggagtaatgaaaagatttgcaaattctgatccagaacctttggcgtgcgggaggctcatagcttatcttccaggaagccctttactctatgaaccaatttcataatctctcttaacagttacctcatttccatagtggaaacctttcctgacttctttctttggctcaaaacttctaacctgtgaatgatgtacttccacagatgtgctagtctcttttgatatccaacaaaacatttattgaggaactcctgctggctactgttggcatatattatgttgattctggtcctgatttaactatgggttttgtcaatgccaattccttaaacatggatcttcgtcatttttaaatcagttttattccctttaggttgtttattggattttttaattcaactcacatttaatttcctttttcttttctatatatctcatgtggacttctttaagcatcagccacatcataaggataatggcatattgtttagaaacatattaagtaccttattggtacttaatggcatattaagtctaaacttaatggcatattaagtttagaaacatttggtacctcattgatggggttattcatttattcattccaattgcttgaaatatgtcatgaaagttctcattcctgccccttactcacagtgtatttggcaaaactttgaaggccattgtgttggaacaaacagaaagcgcaatattcgcattgtagttaagaacatcctgggtttaaatactaactttctcagttttaggtatttcacgttgcactgtttgcttagattctccattgtgaccaagagaatgtttatatcttacgactgtagtagggacatttaatttaataatttgtgcaatgcctttagtgcctactatgtgccagaaacgtaccaactactatgcctgctagttattatttatttaatgaagtgttgattcactgaactcaaattaaattatccttgctatccttgcctttctgttcttcatgccaggtactcagtgaggacagtctgcccatggcccacctcccaagggttgtcaattatgcaaatgagtcaccccatttagtaattagtaatgtttaaaaggaaagcccgggagattaatgcgatagcatacattacggttttggaattttaagcacagggcacctggttttggtaggcgtctttctttctttcctttctatttttcttcatttctcctctttttttttaattagccaaaccttcttcccattgcatttcatatcctctaatgtgaataactacttgatctactagtttgtttgtttgtttgtttgtttgtttgtacagccagcccttctggtgccattttagggaaagaacacagaagcactgcctaatgagtgaagtcatcacgatttcctatcacctttaattgtctgaagaaaatgattgagaagcagcaatcttcaaaaacaattgagggcaatcatgttgtcgaatttaaaatcatttctacttcagagaaattaaactttttttcttttctaacacaaaacagtaaatgaatcaaaaatccttttcttttttacccaatatattctaatgcttaatgtacttgcaatacaactttcattttctcaaaggcaggtcaagtgaacccaacaataaaattatatgttgtaaacctgtatggaccaactcacactttggagctcatgccacctgacagctttaaatcaaggtatgcaatttcaatttcacttttatggggaaatagatattttcactccaattatcattttgttgcaatttagagagagatgtgatcagctcaacaaatccacttgaaaataaagctgaagttgcctacattagtgaggaatgaagtcattctcggtctctggctgttcctaggaagcatttagctccaaggtgattatcagcaccatacaatgactgaagaggctgatactgagaattaggtcttttgctggagatgtgacagagatgggaacaaaagatcattttccactgaattttcttcaagaaaatagttgctccacattttttttgaaggtgttcattaaaagtgtataatctctctggaatttgtgagtttttccaactttctccccatagttttgccaaagattctctagctttcttctccagacatttaagaatttttttttcaaaatatcctatgtatgaaatacttatatttaagaaacttgatcagggagaaagtaaacacattttattgggtcagaagcataattgtaatattagcaaaatcttcagtagtgaacaactaattaaataatcatgtgtattttgaaatccatcatggtttcagacttcaaaagtgattctttcaaatactagagtcctttggaaatttatcacaaccctagagatgggataggcagctgatttagaaaaatgttttcacattatattgaatgatgtggggataagttcaaagtttattttgatgatatcgataatcagggtgattggttcccacagaaatttcattcaaatgttgtttcattgacattatttagaaaaaatttcatcccagttggtcattttcacagagagtgcagcctgatgtgtgtggaaattttacgtacttgaaaaggtaataaaggtttatggaatgcttactccagaagaccctcattaactacctaatataaacttctccttctactgatggaaaagataaatcccagtgagagtaaatgatttagattaggggctcaggactcattgataagaaaagtagaaaatgaagtaaggactctttcatcaggttacagagcatttcatccacgttggatggaagaccttaataataggcctgaattggcatataatgtaatacagttgaccaaatcaaatagtaacatttatttctgagcttgatctagcagccatgaatggttacgttacaaatgaaacaatgatggatactattgacattttatctggtccttaactcttatctttttctctggtttgtttaatgctatggaataacagaaaagggaaatagactaggagtgcttgagtcacatgtctaccaccatttcatttgtctcattggataaatcactttacctctctcagggctgaatccccttgtcttttttttttttttcttgagatggagtctcactctgtcacccaggctggagttcaatggcacaatctcggctcactacaagctccgcctcccaggttcacgccattctcttgcctcagcctactgaatagctgggagtacaggcacctgccaccacgcccagctaattttttgaatttttagtagagatggggtttcactgtgttagccaggatggtctcaatctcttgacctcgtgatccgcccgccttggcctcccaaaatgccgggattacaggcatgagccactgtggctggccccgcttgtcttgaaataaaatttctaatttttttcctttcaaaaaaagtttgcaatgggaatcaaatttacaatatccatgtttctttctaaaaggagctcttgattcctgaccttgattttttttacctatttgtataaatataaacatatataaattgaattattaataacatactttcttcatgtcctattaagttaatcaaatgtcctctcttctctttgatgtttgtgttgtgttcatagtatagctacctgtacagtttaaaatactgcctaaactctcaatagcagaatatttaaataattcattttataataatttacatgtttatgggttttttttttttagtatgttacttaagcatctggtatatttttataatctttaggttatctgtgaattgacagccaataagtgaatcatattatgtttctcagtacagttataaactatcatttttttcttttttagtacttttttccaccacacctaaaccacaaatatgatcatctcttagttttcttgtcttaataaaatcgccaaaatgactacaataataattgaatacatatatgattatgtctatataaggaggaataatagtaagataaatatagaaagatttttttcatgacttccactaccttataaaccagattctctgacctccacactggagaacaacatttttttgttgtttgaattgaagatcttaggtcctttttttggtctgtctgattgcttatttggatgattggtttccttatttataataactagtgtttatcactgtaatagaaaaagttccccaagctagtatcattatcccttcaacccaatacttatactcaccaaagactgtaaaatacattttaattaatttatatgatttagaaagaaattaaaaggataagataatctacagaaagacataatttcttctcctaattcttaccctcatagtctcttcaattgttttatttatttatgtctgattcagctgaagtcatttcatcaatttagacaatgagtgcaacttttcctcaataataattcagttcagactcatctcatcaccattcagtttatctttacctgaatcacagtctgtattgattctgaaaagaatgtagcatggtaggaactaagataatgcccctttttgaatatccccagaactagtgggagttggatgggttatctcatcttggaaggaagaaacattttgtcaaattgttgtactgtgcacttaaggtattgcaatcacacaatacctttattagaaaatttaagtgtgaattttaaaatatatatttactttccagggaaattttatcttatgataatgaatcatgaagattttccacagattggataagtcacattaatttggagaagtgatacgtggtcatttgtgtagacctctctagtctgaagagtaaaagtaatgatttgtccttggtttcttcttactctatgtccttagcattattttacttcttagaaatctttctgtagtcacttatcttttgtgacccattgttctcaacctgcatcactgatttaacatggtcattttgcccctgtgactctgggcttgacactgtcatgctttctctccctatttctttaagtatatctagcctacatctcttactcttccaaggagtatctgtgccttccaagaaaatctaattaataaattaacccatgttcatggaagtgtcctgaataacccttctgacaagtaatgcatagttattaacagaggtctttgtagaacgctagctataatttggtcatgaataccatcacaatatacttatgggaagacatcacagattatctagaagaaaatgagctcaaagtaactacaccgcacaaatattttggtgtaaacacagagcaatgattggacaggaaggccatgaaaacacggtgtaactgctaacatacctgtctgcaggtgatgctggggcctccattccacataaccttgtgtacaattagatcttctgtgccagaccacccagctgatagaaagtctgttgacttgagtgcaatccctctaactagcttgtctctgtctctgtggctcaagaggaccagatcctcgaggacttcctgggtaatccagagccatggagactaggaacaagcaggaaacccagttataagaaagggacacttctgctggccactggtcgtggaacaccagatctaatgtgttcatgagatggagttccaggaggacagctacatctgcagcaggcaggccaacgagtgtgacatttccaggtaagggtgcttccctactccctcattcagagacagcctgaatacttatgagtaagcaagatcagtcaatatgaatcacagggagatgtacacctaggctcctggggcaaggaaagaaaggatataggaagtgattgagttaatagatatatctttcctccctgcctatgtgtcaagctctacttgagcttccattttggctatctccaacaccttcatatagaaatttcagtggtttgaaatggtcgtttgttagactttaccaattaaaatttgtggagagctttcattcttcagattgtgtttaccatgtgcaaggtcattcttgggtataagcaaggtttgtaatgaggtatctcacatcagattatgctttgcttatgaccgtaagccacattatttaaaaacagacacaataatcacaatatttaatcaaagagaactataagtatattgctgtaaattaatgattttcaagttaacagtttacaactaagttagtgttcccttaaaaatcagttattcaccacatttgtactcgttggcttttcattcttttccaaagattaagttcttttttttaagtcaaaatttggcatcttagctaataaatatattctgtcatgcctgtgaggtgttgcaaagatgttcttgtagcatttcatttgagaccaactttgaaaaggaaagctctcaagatgaatgtttaaattctgttttgttgttggtggtatttatttttaaaattattcatgttagtttgttacctcatattgcacaaaatataatattatggcaggtaattgagacaaatttctgattatattagaaaagcaactatatatcagttcaatatagagtttaccaaaaaatatgaccttcttgattttgcagtctttggttagttgtttacaatattcaaattaattttttacttcaaatttcaacaacatttatatcaattattcagcatttcagcacttattttctgattatttatagtacttactatcatttttctataaactaaattctctagaaaaatctattaaaggttaatacttcattttctactttttaatattcacattgctaaatataatggtgtatgcaaaataatcggcttaaacgaaacacagtgaaagtgaacaggacactgttctttgcaggatcacaaggcctattgatatggacaaagattatacctaagccagctgcatatttgattcaatgttgccttattaactctacttcgggcactttatgttttgatttcactgagtttaaaggcagttttcaagcagagctcagctagttgtggcagctgccagatgtcttgaagaaattgttgaaaaaaatattacagccttccttgtatgtcaagttatgcttgcccttctactgacatcttcactttgataggctaacaggttttctagaggaaacagtagctactcggtaatgttagatatgtaacattcatgtagttgtatatctaacccagatacctctaaagacaggcaatttgtatcaagaggttatttttctgtagttgatatttttctaagtcatataaaactgggttaattaactgtgttttttttttgttgtttttttttttttgagacagagtcttgctctgtcgcccaggctgtagggcagtggcacgatctcggctcactgcaacctctgcctcccaggttcaagtgattctccagcttcagcctcccgagtagctgggattataggcatgtgccacaacacccggctaattttttgtatttttaatagagacagggttttaccatgttagccaggatggtctccatctgctgacgtcgtgatccacacgccttggcctcccaaagtgctgggattacaggcataagtcactgcacctggccaaaactagtttaattagttttaatacagtacattgatgacactttccgtgacacgtggatggctgtttcttctgagatcagatgagattgggcatgttcaggatggtatggctgtagactggatggctatttctaaagtaactgatctgttctgaaactgggcaagtttttagagaagtttttttaagtttttatcataaatggatgagtattgatgattgcattttgttgcgtgtgagttggaagctttgtgacatattgtatacctgtccaaatgtatgtgttacaaaggaagatatataaactttccaatcaccagttaccatgaggacataattggccccataaattatatctttattataccaagaatttaatagactcccatcttctttaatttgattcatttcttgtttaaaaatgtttcaaataaataagataattaacaatatggaaaaaattatgtattaaaaattgggactggtccttggtctacaactggcaaagaccaaaacaaaccattcataccttggtagccaaagtccccacgtatgaagtgaaataacacagaggttatgtataaaggatataattattaagccaggaataatctttgccttttaactggaagagattattcttgatgattcattgattgtgattttaaagaaaaaaataacatacctttataaatgtatacttgttttgcacttaaaggagtactaatcaatagaaaattttcataaatatctagcatgtcattgttttgatttttccaagaaatacttttctgggaaataattcactctcaaatttgttctcaaattatctgtatatttgtatacatatgtatacatccatgtgaatacatacatacacatatatttgtatttatatatgtaaatattgaaaagagcagatatctatttatctatctatctatacataaattaatatgtagcaacatccttatagtggttcagttattcttatatataaaatggcaaatgtatattgttggtactatatcaatgctctggctctaaacatacattttaattttgtttccaaactagagaatactatatcactatggttaaatgggtaagcaataccaagactgtggtaagatggttaaaccgagctcagaacatctccatcctcacagtctgtgagaccactacaggtgcttgtagtaaagtgagtataatttatttttcttttatgcctaaaatgaagtagcttatgcagctttacaaaggggaaacaggaaatgctttgtacaaaaaaaattcagtgtttaacttttaaaactaataggaaaagaattattctattaagaatatatactttaatttataaagcttccaaactttgaagtgaacaatattgatgataagcagaagagaacaaactgagcttttgaaaaccaaattaatttttatacagcatgaagtataatccaagccacgttagcttctttctcagatatggaatttttctccatattttgtctttgattatcttgagaatataagaagtttctttcctatcttctttaaacatattccttttaattttttctgtagttcagatagatctgataaaataacagtgtttctgtactgaaattaagtaaaacaagtaaaaaattggttcatgaactactctgttttgaaatcaggttatatttcaattcttaataccagtttttgtaaactctgtggtaaattcaatgtgtcatttttaagattcctggtagagaaaacactgcagtaagtttaaacggttatgtgtatggtatttgggtaaagcgtttttagattaacaactgaattttcaaacttctgttctggaaaagatggagtacgtgttacctgactagcttttctgttataaacaactgtaaaattgtacaaaatatacaaaacatctgttttcagatatgggacattaggaggatcatgaccataaatgctgaaatcaagtaaatgcacaaaatcaaccttgctatgactttctattcacaacacttttgagaccaaatggcaaggagatggagcccaagcaaagcaaaaagatttttgtgatctaagcagacagggagaaccagcgtttgaggctttttttggtgactagcatttataggacagggaccagagaagttggagctttatagaaaaggactccagcaatctatggagaggaccccttaagtattaggctcaatgcttagctgtgcatacctatatgtttccacactgtcttaaagaaaacaactactaaaaatttttgaagcaaatgaagaatctgcaagttgcaaagtacttagagacgttagagttctgaacaacaatagtgaagagatctccctgaaaaccctgggtattcaactgagaacccagaaagaaagcacattagaagtagggctagtctagacaccttctaatcacctttcaattacactgtaaggtatcaagttcatctgtctgtaaattaactgtctactaggacaaagtgtacatttttaaaggggaaattacaattgataaagactatcaacaatgtagcatttataatgtcaatcatatgatcaatactatatatgtagaaaagtggaaaatataacctactcaccttcctcaaaaatatccagtaaaagctgacctacaaaggatagtaatattggaattagcagacacatgttttacaagttattagaaatgataaatgttggaagtgatggatatcttaaatacactgatttgattattgcaccttgtatacaggtatcaaaatatcacatgtactccaaaatatgtatgattattatgtatcaataaaaaattaaaaatcaaggtaaaagttaagtacagtgaagtgaagaaatctcacatgtgcagttaaatgagttttggcaaatgcatatatcccgtaattcacacctcatcatgatataaaacatccctattatcccagaaagtttctttgtcctctttttcaatcagtctcagttcccagaggcaactactattctgaggtctattataaattagtttcgcatgtttttaaactgcatataaatgcatttatacaataacaaagttattagaaataaatctaacaacttagaatagctccaataaataaacaggtggaaattttagtggagaaataaactttaaaatgaaactaaaatttcaggaactgaaaaatacaatgtttgaaatgaaaacattgaatagacaattcagaaataaatacatgtgtttatagtgaactgattttcaacaaatgcatcagaacagatattagggaaaggacagcctctttagtaaatattgctggaaaactggatgtcaatgtgcagaaaaatgaaactagatgtgtatctctcaccatatacaaaattcaactcaaaatgaattaaaaactgaaccgtaatttccaaagctataaaactactagaagaaaacagagaaaatgcttaaggacattggtctaggcaaagattttatggctaagacttcaaaagcacagacaacaaaaagaaatgtaaattggtactgctattatggaaaacagtatggaggtttctcaaaaaactaaaactataattaacatatgttactagcaattctactactgggcatttatccgaaacaaaggaaattagtatatgaaatacacacctgcatctgatgtttactgcagctgtgctcataatagtagggatgtagaatcaacctaaatgttcatcaataaatgaatggatttttaaaaaagcatacatatatactttttaaaaagtatatatgtatgcttttttaaaaagtgtgtgtgtgtgtatatatatacataaaacattccattgtacatatacaatggaatactattcagccataaaaaagaatgaaattctgtcattcatggcaacatggataagtctggaggacgttatgttaactgagataagcgagtcaacacaaagataaatatcacatgctcttacgtctatctgggggataaaagaaattgcacttatagaagtagagagtagcattgtgcttataagagtctgaaaagcttgggaggaaaggatagagagaagttagttaacagatacattacagctagataagaggattaagttctagtgttctgaagcactgaaggttgaatgtggttaataatgatttagtgtttattttcaaatagctagaaaagagaatgttgaatgtttaaagcacataaaaaatgataaatgtttgaggtagtggatatattaattatcctgactttgtcattacacattttttacatgtatcaaaatagcactctgtatttataaatatatacagtaattacatgtcaactaaaaataaaaggaaaatacatcaccaaagtgaatgtatgaagaggaagaatatttgaataattttacatcaattaaagataaaaataaagaatgaattaaagataaatttatttagtaaattacataaatttaattcataattagaaaccttgccacaaggagaactctagaagcgggtggattgcatgatggattctatcaattattaaggaataaatcctgtaattccttgtcttggtttgttttgtgctgccataacaacctaccacaggctgggtagtttataatgaacagaaacttattgactcacagttttggaggctgggaaattcaagatcgagaggttggcatctggtgagggacttcttgctgcatcatcccatgacagaagggcaaagagagggtgagagagagagaaacaaaaggaggctgaactcgtccttttataaggagcccactcctgtgataacaaacctactcccataataaagacattaatccattaatgatggcagaaccctcatggcctaaatactccgtaagattttacctcttaatactgttgcaatcacacaatcacaattaaattttaacatgattccggagtggggagcaaatattcaaacactgtatcattctttctaaggagtatatgataacatccctgtactccttagaaagtgaagaagaaagagaacatttcaactaatattataagagtagaataatactgataccacaactagacaagaaaaatacaagagacaacattttagactgatctctctcattaacacgtgtaatagtctgttttcatgctgctgataaagacataccgagactgggcaatttccaaaaaaaaataataataataaggtttattagacttacagttctgcatgtctggggaggcctcacaatcatggcagaaggcagagaggaagaagtcacatcttatgtgggtggcaggaggcaaagagcttgtgcagggaaactcccactgtaaatccatcaaatctcatgagactcattcactatcatgagaacagcaaaggaaagattcgcccccgtaattcaatcaccttccaccgggcttctcccacagccatgggaattgtgagagttacaattcaagatgtgatttgggtgggacacagccaaatcatatcagcacaaatatgagaaagtccttaaacatatcaatactcaactccagcaatataaatagaggatagtgcattgagatcaaatgaggttaatcccaggaacttaagattggtttaatattgaaaaccaatcaatataatatattaagaaaaaaagaagaattaaatatcttggtagatgaagaaaaagcaattgacaatattcaaaaccaattcacgataactttcaatataaatgaataacaagaaacatccccaatctattaaaagatactcataaagtacccccttactgaatgtgcaaacactcaccttattcatgttaagattagcagtgagataagggtatccattctcagtactatcaagcaaactttaccagaggccccactcagagtaatttagcaaggaatcagtatagtgttaggaaaggaagaagtaaatctgtatttatagataacataactgtatacattaacaaaaaagcctacaaaaaaccctagaatacaaaatcacaatttgtaaggatgcaaatggggtaaaatataaacaagtggcaagtaagtccagagggcattcaggtttctcaaaccagtcttctaacttttgtctataagtttgtacttgtttcaaaataaagaatgaagaaacaacaaaacataatttctaaatgttagtgatattaagaaaaaaaatcagttaaaataccactaaaacccttaaaactttaaatacacaattataaacttaacaaatattgtgaaataccccaatactgaatactacaacattgctaaaaggcatttgaaagacctaaataaatggaagctattccatgtttttaaatagaaaaaattaatattgttaagatattaattctacccaaatttaaccataattttaatataataccaattaaagtcccttctgattttttttgtagaaacagacaagctgtttttaaaattaatatggaaacaaaaaatacctgaacaagtcaaagtaatcctgtaaaagaataaaattgaaggagttagccctacctgatttcaagaataaataaaaagctacaaaaacctggagatgctagtggaggcataaggaccacaaataggtcaactaaattgaatggtttgcagagaacagacccacatttatatgattgattgattttctacacaggtgctaaagcagttcaatggagaaaaatggtgctgaaaaaattggcatcccgattggataaaaaaaattgatgtttgacaactcatatcatattctaaaatcaatttgggataaatcatagccctaaatttaagagctaatactgtcagtgttctaggggaaaatatgaaataaaaccttactatactgaataagccaaaaaatcattaattatgaaacaataaattggacatcaataaaattagaaacttctcatcaaagacaccattagggaaaaggatatgcaaactacagtctggaagaaaatattttgccaaatgggtatcagacaaaaacacatataaagaaattctataactcaataataaaaacacaacctcataaaaacatcaaaacatgtgaacagttacttataaggaaaagaatgaacatatgaaaaagtactcaacatttggtcaggtatggtggctcatccttgtaattttagttatttgggaggctgacatgagaggatcttttgagccaagagttcaagaccagcctggacaacaaaatgagatcccatttctatataaaaaaaaaaaaataaaagcactcaacttcattagacattagcaaaatatagattaaaattataatggtatattatacataattagaatgactacactaaaataacaaaaaactgacaacattaactgttaaagaggacgtgaaaaacaaaaattctcgttctttgcaagtgggaatgtaaaatgatatgattacattaaaataatattttagttccaaatgaagttaaacatatgtaaacacaatttttttgtttatatataaataagaagacatatatacacacacacatatatatacacatatacattcatatataaaaacacattataggctgggcacggtggctcatgcctgtaatcccaacactttgggaggcggaggcgggcagatcacctgaggtcaggagttcgagaccagcctgactaacatggagaaaccccgtccctactaaaaatacaaaattaaccgggcatgttggcgcatgcctgtaatcccagctactccagaggctgaggcagagaattgcttgaacctgggaagtggaggttgctgtgagccaagatcattccatttcactccagtctgggcaacaagagtgaaactccgtcacaaaaaaaaaatacaaaaaacaaacaaaaaaaaacccatacattataattccattacaaagtatttgcacaagaaatgaaaacatgtgttcaccaaaggatttgtaagaaatagtctgtagagaagctttatttacaatagctaaaaagtagagactatttaattgtccactaacaggaaatagactttaaagtaagacttatctacacaatggaattctacttggccatagaaacaaaatactgatacgctcaacaatatgagcgaatctcaaaaacaagtggtgtggaagaaacctcacactacagagtacataataggtatgtaatgcatgatttcaattatctgattttctaacacaggcatatgctgtctatggggaaaaagatcagaagtgattgccttttgagaacctctggggaggagcatgagttaatgttttggggaaaaataaagatcctataacttgatgggataaacttgtcaaactcatcacattatacacttaaaatctgtgcatttcactatatgtgaaaaatttaaaacatattatttaaatggtctgtgaaggagagccctcaagaggcagacatttctctttgagtagaatgatgagcatagtcgtggaaatgagatagttaaatcaaccacttgatgctcttctcattaagcttgtattactagaaaattcatctctttcttttggctagattatagattgactagaatttctccacgtatttgttaaagtgttctggatggtttttattcggctgattagtaagtcatttaaaaattggcctacaggccggctgtggtggctcatgcttgtaatcccagcactttgggaggccagtgtgggcagatcacctgaggccaggagtttgagaccagcctggccaacatggtgaaaccctgtctctactaaaactacaaaaattagccgggcatggtggcacacgcctgtaataccagctactcaggatgctgaggcaggagaattgcttgaacttgggaggcagaggtttcagtgagccgagatcgggccactgcactccagcctgggcaacaaagcaagactttgtctcaaaaaaaaaaaaaaaaaaaaaggcacaggccaggcataggtagctcacacctgttattccaacactttgggaggccaagtggggagaatggcttgaggctgagttcaagacctacctgggcaacataatgagacaccatcttatttttacataaaaaattaaagtaaaaatttaaaaattagcctacatatattgtagttagagaaagcccttctagacaaagatactgtaaatatttcattgcatacagataactgcaaagataaattaaaatgctttaatagaaaatagatccagtaatcctatcatactattgatctgacaccttattgatattgtattttattctacgtatggagataaaaagactttgcattctgttaattgaaataatgagacaaacaataacaaatgaagttttgagctctcaggggttctaccaaaacttggtggtactaacaagcagtggcattggtatctattttatttctgtgctttacagatatcaagaatggttaatgctagggtgtaaatggagaataaagaaatgattcagttagattttttttgatatcttcacgtaatgaagatctattgaaaaaaaaagtgccctgaaaagagaaagtgaccaattataatgtaatcataatatggatttagaaaaagaaattagtatttaaaaacatataaataatttattattaacaatttgagatgggtacctctgcatataggaaagcccctaatatgttgttacttatctttcttaatttgaatacgtttattatagaatcatttctttcagaaaactgcaagatatttcatgtcattacatgtaaacggtattattaaagcttgttttttctacacatatttaacgaggttaaattagtctaattttgctttttgcaatatgattttggctctgatctactgcaagactgttttgaagggacacataattttgtcatttcaaatgtttgatattttttctcaaagactgagttactactgataagaaaaaaagaaggccatgattatgagtgaattgaatattgaaagaatgtccactttttagttttattcctggctgtttgcccagttgctttgaaggacttaataattttgtctcccaatgatgcctagaggtgaaaagagacagtgtctggtggttcaaaacagttgaatgaggtaatcaaacagagctggaaaatgatcttctctccctggtgaggtactgctgggaattctgaaagaattcaccaaagaaaagactttataattaaattatcgtttagtccctattctctacttactcattcagattaaatcaataatgacaatgaaatctctcatggtgtttcaccagttgaagagagggaaaaaaaactgataaccgtgttttaaaaaagttaaatttatatatgctcattttggtctttagatgcttcatggagttaattgttttgtttcagaaatatgagatgacatcagatacgtggctctctcagcaggtacagtataggtggtctgtcacatcttggccattgtgaccatcctgttcacccattttttatgtgataactttctgtaaaaagtatgagtttaaggctttgctaggtttgacagagtgatcctttttcattaaaaggatcacttatgacttgggctttctatggtatcatttgtgaaaaggttacttccatttttttaggagacataaattgcagagtagctgccaggatcactttttaaaatattctgtgtaagtacactcttgtgtagatgaaggagaaaaactcaggacctaaccaaactagaaatcattagcattgttcaaattgtctgaaaaattgacctgacctttacataaattgatcatggagatattcaaataaatacttctcttcttagttgtattctagctcacaattctagtttgtgacataaatgaggctggaatcaagatgaacatgacggactaaaaacctaatcactgttacatggtctcatcctggacaattcagaaggaaacaacacaaatagcttatttaaatatagctgaattcattttactcttaactacattagtgagttttgcaaagggaaataagatgtgtggtatggtttggtttggttttctttttgttctttaaagccctcttttattttatattacgtctatggcgttaatgaccacccatattttgagaccttcacatttatccagacacttcagtgagttctgaaatatccaaatttatgcttgccatctcctcctaaatctgtaaaagtagcttcatactccccaggtctaagctgaactcattccttttctagtcagtcttcttaatttttatcttaggactcaatgacataattatccattcagatgttaaaactatttacctaatagtcatccttgaatcttttctcatttttatctatctatatataattaatatgtacagattttactttcaaacatctctcaagtcaatttacttttctctaattcacaaacactgtccatgttcgaactacagatccagcaagtctcaacccctcaggcacctgccaatctgttcacactgcaggctaactgagtgacctttttaaaatatgcatttaattgttgctactaacattcccctcatacttgcacttccacaactcaaagaacttttctctcttctttctgtccttcagataaagaccaacatccttaaaaggtccacaagggattaattgaaagctttttcagctctgagtcatagaatcatttgatctgttttctccagtctagctacatggaccctcatatgcacagggacttcataagtgcccttccttctgaacaaaattccctcaaactttcttatatgaagcctatttatttttcaaaccttggcttaaatcacctatgtaagaagtcacttcctctaactagcctaaccaaatcacatctcccaataaaagttatattaaagtcaagtgtaatctttgtgtaacacacaattattgctatgatttttttttttgctaagatacaaggacatgaggatgttttttacttctaattgtaaaccaaacgcctagtatagaattcaatatgtaagaattcaatatgtaagaagagcttaatagatacttactgagtgattaagaagaaaagtaaaaaggattataaataattgtttgtctgaagggtaggtagatggatagacacagataaatgtttgtatatatattacgagtatatgtgtctttgcacatggttatctattaatataaatacttttatcttggtcaatgtacaaaataaaatagaaaaaaaaccctgattttacagctaataatagactcacaaatttcggttagatacagaaaataagaacaatggacaatatataacacataatacttatgcattctgaatttccctccattattaaacatcttttgctattactttgattgccagtgacattcataatagtttaacatatgtcaacataatgcatgttcttttgagattatgctatctaatttttaaatcccaaatttatgaatgtttaatagaaacttttttaaaaaacaaagcatccagttattaattattcagttagtaaatgccattggtcgtttatcacagttgatttttttcttcagatgctctaagggaattttatgaaatacttagagttatatgaaatttaatgtatgagcatggtagcagtaataagaagcagcaaatttctaagataattataaatttaatagaatcatcatatactgtctttttgcatagcagaaaaggcaaagagaagtaggcatgtttagcctagctttcaaaggacttgcaattgagatgaccagtgtgtaatatatttggtcaagggaatagagtccaatatccccagcttaccatcttgtgtgtcaaaaacactgacttgtataatgtcatgaaactgagcagtgagattggcaccatctgtgtggagctgaatgtttatcaccagacattgtcaagtgttgggggcagattttttagtccagcaaggcatatgagattgtagcccccatctattccttttctgaactacttctaaggtactagaactggggaggaggcaatgtaaatggaagaatgcttatatatctgtatatgagaaaaaagctattcatcttttgatagaagtacaaagggagaacggtaagggaggagttgctatgtgggggtaaatctggtggatagagtgatatataaaactaatatttttgttcatggtatccatatattcatctattcaccaattatgagttgggacctactgtgtcttaggcaatagagctaaacagataacatttaaaatttagttcaattattaattgcctagtgaaggaagccaacaagttaatagatcaatataatagagtgcattggaagccatgataaagatgaaaacaagatagtttttagaatatctgaggagagatttcctaactagggaaatcttggaaattcttttgtttcatgagaataagtaaaaaatgagtaagatttagcagaaaaaggaagacgaaaaagttgttccagacaaaagaaactccaagagagaaatatcccacaggagcaggtgatggaacaaatagaattattgactttattatagttgaaagaagtgattcactcagtcaagtattttgtcagtatccattatatgctcagttatacaatttttccaaccttgaatggtatattatctcagagttttaaatttattacatatgttacttatattttcatgaatgttcataaggcagttaaggaaaatatccttattttactgtcaagagatgtattgtgaatgaagctaaaatcaaactgttcagtatattaaaatagttattaattgactgattcattcagtaaataattattgagctcaatttacatgatagtcactgtttcaggtgctgcagatgcagtagtgaaaaatacaagtttcctgccctatggggcttacattacagagaactacatacatacatacatacataagtatgtaaatatgagattagtgcaaaagtaattgaggtttttgccattacacggtaggtcgcaactcataattgatgaatagatgaatgtatggatacaatgaacaaaaatactcattatatatatgtgtgtgtgtgtgtgtgtgtgtgtatatatatatatatgtatatatatatgtatatatatatatatatcactctatccaccagatttacccccaccattaaaagtaatggaaaaaacctcaattaattttgcaccaatctcatacatacatttatatacagtatgtacatatgtacatacattcatatacatattttgccattaagagtaatggtaaaaaccacaattacttttgcaccagtctcatacatacatacattcatatacaaacaaacgcatacatacacaaattatacgttgaatggtgttagttgctgtattagtccattcttgtactgctataagagaccaggtaatgtatgaagaaaagaagtctaattggctcacagtactgcaggctgtacagaagcatagtagttattgcttctagggaggcctcagaaagcttccagtcatggcggaaggcaaatggggagcaacacttcacgtggcctgagaagaagcaagaaagggatgggggaggtgttatacacttttaaacaaccaggtcttgtaataactcattcactcactgtcatgagacagcacccagcggttactgctaaaccattcgtgaaggactcacccccgtgatccagtcacctcccaccaggccccagctccaacactggggatttcaatacgacatgagatttgggtggtacacagatccaaactatatcaggtgctatggaaaactagaaagaaaataaaaggagatgaaggatgtcagatagagttggatggtctgactttcctgatctcgctttatatagggtaataaggaaacaccttattgataaggagatttcggattagagacctgaaagagataagaggaagatccagaccaagggaatacaaagtacaagagccctggagcaggatcatgcaggaacccagtgaagaaagcaagagaatgacaaagatgagatcagaaagacagtagagggccaagtcatctaaaagggcttgaaggccattgtgcagagctactcaggacccatatcaaagcctttctttataccatatataaccacctctcgttagtccagcaggaaaaactcaatgtttcatcagataaatgtgttttcttaatgtttttcctgaagaaagagcagtatctctctctctctacatacatatatgtgtgtgtgtgtgtgtatatatatatacacatagtgtgtgtgtatatatatacataaatatatatagtgtgtgtatatatacacacacataaatatatagtgtgtgtgtgtatatatatatgtggctttcatcatttaattttcaaaaataattctattgatttaatgtgccaccagagtgtaattaaaaattatcaaatggggtcacagttgtaggtgggcatttgtgtttgtgtgtttgtggagagatgagcaataaggatggtaaatttgaattaaataactttctatagaatcctttcaatttcgtggcctgtcgtcttttgtattttcagttaatttatgaatacattatcagaaaagaatcttcaagtaagtacagttgctgaagaaaggatttcaaaaaatatgttacagaattttgtaattaaaagatttattttgataaactgatgcagatgtttgcatgttctttatctttgaaggatatttcactaaacacaatcttatgtgaagatatgacagttcttgtttgaaccaatttaaaaagtgtctttagtctgataataaatcattcatatccaccatgcacaaatttctcctatccttcccacaactcaaccacatacatatgtaatgtatcagatttactttaaaaaagtttaaaaaatagcatacattcatttttttaaaataatgtgcccattttcctaactaattataaatcaatatttggtataacccatgcaggaattaacagtagtaggcagcacagattgcatgtgcctttctgagattgttctgtgctcttctgtattttagaatgaggagcccgtgttttctagagacggcagcaaattctttatgacagtgcctgttaagcaagggggacgtggagaatttcaccacgtagctatgttcctcatccaggtaagtgctggcttttttccatgttttgatttcattgtcctcatgtccccgaaggcccagttcttgtggcattctaaacctctagttcatggtggtgaaacccagccatatatacaactcacagacatcttaggaagaggacctccatccatagccatacattcaagccttaccttcccacaaaacagtctcaacactcagtacaatttaatgagttacatgtgtgtcctatgaactgagggctttgggatagagaatttaataaattaaaagcacccaacttttgaggacctgagataatctagagaagattttttattcaatgaacatatatataacctattttgtacaagtaatattctccaggtgttataaaagttttaaatactcaaaggaacctaaatgtccatcaaaaattgatggttgaataaattatggcacatccccacaagcaaatacagtgcagatttttaaaaaacaggataaaatagatgttttatgttaaataacatagatttcatgttgtaaaatataatctatgttttttttttagactttccgataaaaagaggggaaaggttactttttatctaatcaaaagaatatgaagggtttatacagttttattataaaaaaattagtaaattcaggtagttagtttaaatttgacaaggttattgagtcaatctgaatttaatttccaagagcaagcatacatgagaaaataaagcatccttcaaaatcatataataaataatctagtctcacacacaggttaaaggctttctaatgaaaagtcactgtggctaaactgggatcttcatgagtgttttacaaactagctaagagtaatttcatacttacaaaatatagaataaatataaatatggcaaagatacctaactgaccttactaattttatgtttttagaacctttaagacctgtgcacattctcaaatgattaccattatccatatacatttgtattggacagcttaatgctttagagtctcaaaatcttatgtcactaatttaaaatttaaaacttgttcagggtctgtgtaattaaaatagttgtcattgttttaactttaattttaattacgactgaaagaaataatttggaatacatacaatttccacagtacagatgtagattgattttcatagtatattattaaggtggaaaaacaggttataaactaatgtataatgtgatcctatttatgctctaaataaatgcatttatagatgcatttatatatgcatttatagatgaataaaattttggatgtttttatatctagctattaaaatgattatataagtcaggtataattaagggaactttttttatgaaactgaaaggaaatagactagcaaattactttactttataaacttttgctaattaagagtcaacttggttatcacaaatattagagaactattttggcccctaaaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtgtttactttgttcctcttctatatagggactataacacagccttcattgaagtagaaaacattttttttctattctggttgctgtttaggtaatttgtggtttgcctcattgagaaatgaacatgactgcatgattatttatgaatattttggcaattgattaaaattagtctactttgctaatgagtcagaagtcagtgctaggtaaatacaatttatacataactttgaacacacacaaacacaatcacatatgttattttaggaaatggtttgaatcaccttgcctcaatttaaaaatagctaacaaaaaagctatttatgaattgtgtatgactgcttaattgacatatatgcactataaaattctgaaaaattcaaacttaataaactgataaaggagtatataaaaatcacccacaatatcatcacctcatattctcacacttttaatccattattgtgtatattttacattcttttttcatgagaaatatatgattttcccctaaagattgcaattaaagcataatatagatttgtaacattaaaagaataactaatgagtgttttcttacaacatttaattgtattcctaatatttaacattttatatttttcttaaatgtgattttaatagctgctcagcattacagcaagcagatatactgtactgtatttatttatttatttatttatttatttattttttgagacagagtctcagtttgttgcccaggctagaatgcagtgacacgatctcggctcactgcaaccccctcctcccaggttcaagccattctcctgcctcagcctcccgagtagctgggattacaggcacccgccatcatgcctggctaatttttgtatttttagtagaggcgggtttcaccgtgttgcccaggctggtctcgaacttctgacatcaggtgatccacctgcttcagcctcccaaactgctgggattacaggcataagccaccacgcccggcctgtactgtatttaaatgatccaagtttattcatcattaaagttatttctatattttgatgttagaaatgattcagagttaaaagcccttataaacactttacttataattcttcccgcaaaattatatttctagatgttaaaagatacccaggcagggtatatccatacgaatgtatttgtttaggttttgatgtgtaatgccaaattggctctccaaaaaatagtacaaaaatttactgcctaaacagtaatgcatgccagcattgatgactttttaccccctttccttcccttgctgtgctacatgattctacttaaagttgtcgtgcctgaaaagtgagaaatgacaggactggggccttggcagccaacagtcagccaggtcacctttgcagtacttggcgcttacctatgtttgagagcttactagttcactcagaatatatttatttgcttgaagtaccttactaaatgaaattactaaatttttgcaaacattttgctctctcatattatcagtaagtagataaaaatcattaattagagaccaagctagacaattattgatttcaagctattttcattatggagagtgatggcggtcactacatatattttagtgggtttttttttttcctcatttacaagagctgtccttgttaaagtgattccaaaggatacaaataaaaagagaaaagaatgcatgtgttttcctccagtcttcatttaaacattattgtaattttatgtaaactacagtattgcatcctgatatgtcaaatttaaattttaaatgcacacttttcccacaatgctaaataattttgaaaaataattctttagaagattaatattgagttgactggatgtgcatcaataaccattatttgttgttctgtgtttaatttagtggcaatttgttgtaatgatagatgtcactgtatataaagcttatttatattgtggattatttctttagtattgattaacaaaactggaatagctggaccaaaagtaaaagatttctaagccctaatatatgtatttccagatcactttcagtatgaatatatgaaagcaaaatttgtgagtgttttctccactttcatatattccattaaagaaaatattaaataaaactatggcttttctggaaatctatatagctaaagaaactgttcttctggatagagtgttttgtacacgtattactatcagtttatgtacttcctgagtcatacactgatacaaaaccttttaccccagaccattaaacttttgatcacttcagatattcgcccctttgccccttgaaaaatatttgttatgttgacttcaaacttctgaattctcatctcaggaactgtaacattctacatcctgcaattcaggctgcagtgaagagataggtttttatcaaaggtatagcacctttttctctcaaagatggagtaagcagaattttcattgtgttcagtcgttcagattcataggcgtaaggaatggccctgtcaccttctaaaattgtgttaaatgaaaaattatatgtgggtgaatccattcactttctctattcagcaacacgaagttttgcccatgagagctgatgatttcacttggaacgattttaagtggcattattcactacaaatactgtggaaaacagcatgcccccaatccacaattttatcacctaatcaacccagtaaaatttttgcattaagtttcactgctgcatctgattaggacattgtctgaaaacaatgagctcatctcatgtggtgaatagatggcaaattaaagcatgctatttttaagcactacaatatttcccttatttagaaactataaaagtgaacatttaatataagaaatgtgaatgaataatgtgtaattaggtaaaaagaacatgcagggttaaacttgtattgatacccaatgtgtttccaatttgtaaatcgcattataaaaccaatatttaacttccttgagcaagataaaatctctatgaattgaaggtcacttgtctggtgtctaatgctccaaataaacactctattccaaatttccagccctcttttaagaatgaatgagctcacgacttttgttgctttttagtctgaaattaaagttgaaatattagttcaatttaaaatacattgtcatactgcctttatcaaaagtctactacagttttatatttatattcagtatttctattctaccaagttaatattgcagagattatggattcacagaaacaaagaaatgttattgtagagaaaaaatgctgttctttcctgctttgttaagtgatctttcctgtgattgcatttctgctgaaggtgcttaaaaacctaactgaagtacaaacatccccttgtgaaatctgctcaaatactgtgatatttattaagtgttgttcagtcatctaccatattctgattggtattaagattattagccaggtcaaaattaatgtgctcactgctgtgacagtcttatgtagattattagaaagtaaatctttgctattatatgcaaaatgagggttcaacttgttccccataccatatttgccctggtagattaaaagcaagcaaggcaattacagctgtttcaaataaaatcaaaaggttatatggttgttattaaggcttccaacaagagatcttttggtcctacacttgaaagtgtaatattttgaactaaaaggatcattgaagtaaatcatatataatattttttatactgtgttcaaacatttttcaaagcattgggtttttactcatggcaattttaatgttgtatctcatttgtctttaaaacacacatacacacacacacacacacacacacacacacaccaaaatactctgaaaaacagagaaaataattaacctagaaatctgtgggccaaaagtgtctccagatgttttcaaatattgagcaaagtttcttcacttttttaatgttttgagattattttatcttgaaattggcatcaaagatgcactaaaaccttgaaattttagtatcctgtccttggctcattcaaagcagggcctggaaacaagaaagaggagctatccactgagttatttgcctgtgtgaacttggcaataaaatgtatgactttagaactctgtgccagcctttgggttatgcagttctcatatctcacaaattgggtgtctttgcacttatacctctagtcaacaaatacttgtaaatcagtagtacgtcagatagtatacaaagaagttgatataaagaagtcacaggcttgctgttgaccttaagcagctagacgtctagagaacttccactaagaacataaaatagactacttagggagatattgaaatgcaaatacataccaataagacagaaaatttttcaaaggaagattctgttagtacacatgtgcagtaaagtatggaatgcccttttagtttacactttcagttgtgtgggaaaatagatgttataataaaactatcctatatgaacctaattctgaatttatttttaccaaaaatgcattgaaagcattactcagctgacagattacactctctgaagacaatgaaattgaattgcacaaataacaacatttaaaaggttatacatttggaaacaaaatataatttctattcatagtttcaagaagaaatcagcaaacacttagaactaaatgagaatactacatatacgaaaatatgcaatacatataaacaacagtttttaatatatgcaataattttatatgcatatatgaaattatgtatatatccaatgtcagaatttagaaaaggaagagaataaattcaaatgtaaaagaaaggtaattagaaatgaaagaatagcacttattaatctagtaagcaaacatgaaataaagcagtatgataaaacaaatagtaagttatttggaaaaagtagttgaatctataagagctgtcaagggtaataataacttggacagttccaaagtataaataatggaaagggacaaaactacagattttaaaaatattaaaagaatactatgaataactttacattgataaacttgaagtttaggagaaatggatgcaatctagaaaaaaaaatcaaatcagatttaagaaacaatcaaaatcctccatagtgttaagaaaatggaatcagtgatgtaggattttccacatcagggaaaggttgtttttaaaagtgaatctcaccaaatattctaggagtacgcacttccaattttatattattttgaaaatgaaaaaatatggcatgtctttagtacaatttatgacatgggtatcatcttgtaaccaacacgaaattaaaacagtatcagaaaagacagtataagaaagcttaaaaatactaaaccaattattgacaagttgacttatttaatgcatttaaaaaattaactcttattttttgaacagaaatgcaaaatttacttaaaatttcaaaaatatgtaagataattaactgcatttaaattttcctgagaaaattataatcaccttaatagatgcagacataggatccaagtaaattcaacaaaatcagtattcaaaaaccttagaaatttaggaataaagggaacttctttaaggtgatgaaggcacttgccaaaagctttattcatatagcataattgataatggagcagtagtaatattccctttaaaatcagcactgagataaggaatcagagtgaagtagcttgagtatacacaacactagagataacagttgtttttgtttttagctgttgttgttttatacttgaagctctggggtacatgtgcagaaggtgcaggtgtgttacataggtatacacgtgccatggtggtttgctgcacccatcaacccgtcatctacattaggtatttctcctaatgctatccctcccctagcccccaacctcctgacaggcgccattgttcagctcccacttatgagtgagaacatgcagtgtttggttttctgttcttgtgttactttgctaagaatgatggtttccagcttcatccatgtccctgcaaaggacatgaactcatcctttttttacggctgcatagtagtccatggtgtatatgtgccacattttctttatccagtctatcattgatgggtatttgggttggttccaaatctttctaatccattctaatcagtgttctctaactacataaagtggttaaggaatagaatgatagtatttctaagaatactttttgggtcaaacaatatatattttttagacaatactactacctgttttttacatattaaaatgttggtcctataaacaccttggaagcattgattaagctaattaccttcatcaacatgaattcatctctgaaaaaaaattattgcattaaatggcaaatcttataacaatgcccatactgcaaaggttaaaatgaatacaaacctgagtatttattggagtaaagtttgttctaaaatgttttttttttttaaagctaactgtacagctgccagtcatttacatgagagtgattaaagtcctaccttggaagcaaatgctgccatcaacatggtatacttgattcaccctcacctggaggagttttctgaatgacttttctatagttgaaatgaaggcactaacctacctgccttgatctgtgtttataggaatgcatgttcattcttgagctgtggaacagaaaactgagtgttaactgagaattagagaattcgaagtgtcacaagcagttggtacattcgtgtttaccagagagatgctgtttaaatgaaaggaaaatcaatattttctatttctttgcagagtaaaagtgagcaaattaccgtgcggcatctgacatcaggaaactgggaagtgataaagatcttggcatacgatgaaactactcaaaaaatgtgagtgttttcagttctctagtcaggctgcaagttagcgttgtcaaatgccatcttttctaatagaattatgttttgcttaccatagtcctagtcaaaacaagccagccatggaaagaataacctttctttaaagacctcttccacacttcacacagagacatcttacacagagggatgtgtgtgtgcacacgcacacacacacacatatactcacacacagtgattgagagaggttatgaaaaaggatgattttatcaggggaaaaaaatatgtttcctagtttgatcatagccctgtgtttgtatagcaaaacaactcctgtctgtattttgacagttttaaaaattcaagtgaagatttaatgtgaaaattcaggtgaagattcaatgtgaattcaggattcaatgtgacaatgtgacaaaattcacagatcacaaaaaatagatctgtgtctaatgcttgtgttgttttctttcctggacagttactttctgagcactgaatcttctcccagaggaaggcagctgtacaggtaagcagtgtgcaaggatctccttacacagattggcttctcaatggctatctatgtagcataaggaaggaaaggaaaaatttgaaatgtctttttcaacatggctaggaagagccaactttgctgacaaagcttcacactcttgcaccagtctctcccttgacaggactggagaaaatggagccctgcttgctccttcctgctctgcagcctccttattcttttcttcacctgcttttgcagtttcttaatatcttttttgtggcttatttctctcaactctccacatcagagagatttacgtattttccctcgtgccttcatcttctgctaagtctcattttgaattttcagtgcattaatgtggcacaggtgaaatttattcttgtacaatataatgttgttgtgaacagttagtctagtgtatcaagcaggaagctttccctctttgtcttgttgttcataaaacccagtgagattgttgcaggaggaggcatccttatttaaataaggaacgctcattgcttgctaaaataaagcaatataggggaaaataattacatttgttcaatttcccaaatgcaaaactatactcaaaaaaaggcttaagctcacacctatttagtattaaaatgtctcctcactcagagagctttcaccaggatctcacaaaaatgacttttatttttggctggcaagcaacctattaattctagactttatatacatgttctaatttccatttcacagatccatttttaaagtgtcaaaactgccatgacatattctcaggggaaattcatcatgttttaagaagtgtcaccactaattcttaccgagtagtactgactttcctttgagagtaaaaatgcatgcttaaagtaccccgacttcctctgcatcacccccacactcttatttatacacaatttgctttcatcagaagcaaccttgtccttttaatcgcctttcttaatacatcattattataagtttattctcgtggacctcctggaacgcatgttcttaattctgacttccaggaagcaaagctattcatatagagatagtgatttgaattttggattcgggatcttgatcaaagtactggtcactttttcttttggtgacctaaagcttatctttcttgaaacatacattatgattgatatcggtagccataaactgtagcttagagagatagaaacactttatatcttataaaactctcattttataaaactcaaagaaaaatgacagcatcagaagattagacttggtcaagttcagcaaatggaactgcctcaatctttcttcccattattagtgtaaaatgtgatttgaatcataatgacttcttagatttgtgtgcttgtcttatctctctagtgactgaggcagaacagtcaatgtatctctgacatgtactagtgtagtcgacagtgttacaaagaaaatgtagtagcaataaattttcccttaaatagctcatcaaatgccagttggcttgactgtaagataatgttagtgtttgacccagaaaatgcaatcaatgtcttgcccaggctataaaaatgatcactggttgacttaatatatggcactaggcacccctgcaggagtaggactgctaccgtagtcattgttactttctttgtctcaaaatttgtgtctctttatttcagcaatctcataatctaaataatgagaaaataccacataaatctccagggagcttggatctaaaagctttatggaagagtagagagaaaaaggttttaaatcttagtatgtcactgaatagctgtatgcaactgggatactttctaagcttttctgtggtgaaaattgtacaatgttgtgaatgtaattaatgaaactgaattgtacacttagaaatgcttaaaatgacaaatgttatgttatacaggtttaacccaaattttataaaatgaaaaaaaatggctatggatattttataagttatcatgagtgaaactaatatgatttgtgcttggtatatattgttttgagtattataaggaaatttttggattgtaatcatctcacagtgtttcaaatatggaattgtgattttgtgaactgtttcttgtagctgccttaacacccctgttccaatccccatacctacagcgtattgcacatcaaaatcaacgtgaatattgttcatttgtaaatatacgaccaaaaatcatgtttcattccaaaatgaaattgagaccttttgtctgatcaagtttttctaaaggtattctcaacagtgttttcatccattgacctaccaaattttgcattcagacttatttattaaataaacaatttgataaatgaaatttaatcttatattaatttttcaactcctgtaaccttaagcaccactattgtaaaataaagatggtgatgactcttctttttaccacctcattatgtcaaagtgtgtattgttgttagtgttatatgtgttataatacaaatgtaacttttttaaaatcagtaatttttctgcaagtaaatgatggggaaaatttggcactgataccaaattctaatgtttagaatgtttaatttagaaaatcatgagctggatttttttgtttgacttgtggaaatgcatattccttctttcaattagtatgtattaaacattgaataatctctgtgggaaattccctttaagactttacacagaaatatctattaaaaatgcaaaaaacagtaagttaatttgagttccattgaaatcagttctttgtttatagccatacatacaagtgtacatattacatacataaaataatacataattttaattttaatagattaagaaaaatgtgtatgttttaacattactaatagaaggtgactttttatgtatatggtgattcatagtttacagtgaacctctatgcaagcaccgatgtaactcccttgtttatattatatttaaatatgaacaccacacattcaagtgcctagaatagtagcatttctataataacttcctttttctttctccagtgcttctactgaaggattattgaatcgccaatgcatttcatgtaatttcatgaaagaacaatgtacatattttgatgccagttttagtcccatgaatcaacatttcttattattctgtgaaggtaagataatacatgaattctgatataatatattttattcattgtatttggtcaatatctgttggtatcagcaactattactctagatgatttcataatcttaatttataaatttttgttaataggatatacattatatatagacttactgagatacaattttttacatattttgtatagaaataaaaaatgagaataagtcaataaacatgcacacataattaataagtgctatttgaacatgagcaactttaaaaggtgaataaatatatttacatcagcgaggccatgccacaatcataaactaatttacctagtcttcagaaaaagtaatagtctagtcttctttttaaaacaatgctttggttgttaagagatttaggatctatggaaatttaggacctgtggaaattgaattcccctgcttcagagttcttcagttctgatcaattacattcaccattattacttcttctatcttgtaacaatatgcgtagtcttacatgtttatacagtatctctacaatatattcatagaaatcattttccttttaatatggtactgtattttccagagattaaatagaactcatgtgtcctcttataatatgaagagttgagtgctactactgcagctgatatattaagctgtccttttttaagagacaatgagagatataccaagacttactttttgacattgtttttctcttgatatatgaaatgaagtaatcaaaaaagaagtccttgtttaatgacaccaggaaaaaaaaattagttttagatgggattccttagagaagtgaagtttcaagataactttttacagtaacaaattagctagtgtattttaaatatttgaagattatggttaacgtatttttaaattaatatatagttaccacccaattttaaacttttcttatggatgaactatttccaatatgcgtgctttctttttttggctgagtggcaaatagaatttgatcttggatcagtggatgaggggtgaaagggttgtgaatcagctttgtgaacatcagtggctagtctataaaagactagagataaagagaaagcatgtagaattggctaaaaacatagaaatatagaacatttgggggaagagagaatcttaacaataatctctgcaaatagtttccttctcatatattcttacccttctgaataaaacgcttataaataggaatgaaagctagttatctggtttctgttttgttatgttttaaccacgaagtgcttccatttggggggaaaaaactattatgtaaactttctaatgattattacttagacatctttaaaaatatttatacacatatttttaaattccaggtccaagggtcccagtggtcagcctacatagtacggacaacccagcaagtgagtacacaagaagacaattaagaatagttatggttggcattagtcttagacatcgtgttatctattctgagtcatatcctctataaattcttcttcaaaaaatccccaccatgaggaaagctgcgtgtataccatcaacttgaccttatgtatgtaagagaaacagtaaagcaagagatatgagccatgttacaggtgggaggtgaatcttatatgcccgaaataggatatctactacctaagtcaaatagagttattgatgaaacaggtacattttagcttactggcctcttaatgttctggttcattcttgcctgggcctcacataagttattcctccagaataaccttttgaagacatttcagaaaattatgaaaaatgtgttattttatatattttctatcctgtttgttccagatatccaggttcttctagttttgtatatgcactttttcatttatgaatttattcatttgtatatttgttaggtttgttaagagatcacctacttttgtcaaacaatgtgacagagtcggagggtacactgaaagagtgttttgttcaagaacttacagtaaagtagataaataaatgcatggttgagcttatcttaaaaatgaataaccagatttcatcctgccttcctttctctttcctttcttccatgtttgtatccttctttcattttttaagttttatttaatcaatgcttctattctgtgatgatttcacataagctactataatctaataatggctcatatttattgactcacttgaactttggaatacctctgagatagttaatttgattatccctttttacaggtgagaaaaattagtctcaaagaggttaagtggtaataacttggccagagtcatactaataaatggcagaaccagggatcaaatgagacagtctgactcgagaataggtttataattcactacaatataataactactttttctattgtgcttttgcctcatgcattgcatactcttatttaagtaggagtcagttaggtggcttgacttagaagatatataggtaaaaaagtgtaaggttgaatgacaaatatcattttgagaaaacagaccaagaccatttatattgttcaaataatgtcatatagacacttagtgcatgcccgaggcaacaagaaatttctaaatttgtgttgggtttttgtgtggctgaaagatggtttagcacacattttagtttctatttatttcattatttccgtcttcagtgtaaaccttaaaaagattatgttaagcaaatcaaatatattcaatattaactctaacggcaacaataatgaccatagacagtacggttgataaaatggaaagaaggttgaatctcatagatagaactatcagtgtataaaataagtctatcacatgctttttgtgggatccaagacagtgcgttaacatctcaaaacatcagtgtcctccgagacaaataaacaaatgtgtttgcagtgaagatgagtaacattcatgacatataggacacacttaatcaataactatttgtgttacactgtatatcttgcctttaacaaaggatgattaaaaattttccaatctgattttaatttaattttatcctgttgttacaaggcaatgtcttttctaataacttctgctgcaaattacaaaacatttctgtctaagggaaatcatgttattttcctgttcaaaagccaatcatgtttgtctcaaggtcaacaaaaacaaaaaaaggctgtgaatagtggtcaagtgcttaattttcttttcaaaagataattacttagggagataaaatttatagtcaatggcaagtaaatctttgggtcaatgaaagcaaatataccaatgagtaagtcataactcatttttgggccacatgaagtagaatagtgcatggagagaaaattttaaaaaagaaaaaggaaaatatttaacaagcatggaaaacctttaaacccactagttatcaaagaaacgcagaagaaactactgccatgtaatttttcctaacaaattaataacattaaaaatttacattactaataaagatagaatgtggtagaaatgttaattataacatattaaaaataatagtcaaaacttatttcttttgtttttttgagacagaatttcactcttgttgcccaggctggaatgcaatggtgtgatctcagctcaccgcaacctccacctcccaggttcaagcaattctcctgcctcagccccccgagtagctgggattacaggcatgcatcaccacgcccagctaattttgtatttttagtagagacggggtttctccagttggtcaggctggtctcgaactcacaacctcaggtgatctgccagccacagcctcccaaagtgctgagattacagccatgagccaccatgcctagcagaaacttaattcttttatatcattttttcatttttgtagtttacactgagaaaataattctaaatggagaatattatgacaaagctattgaaaatagaaaaagacattataaataacaaataatgggagtttgtaagtacattttaatggaatattactcagtgccctgggcatcttccatctgtttttccagaaccacttttaactctcaattcttctcttcgatgttctctggcctagaagtactttctatagatgacttaggttctgttgccccatggcttccaactggattcaaccaaaggaaatcttgtaggcaactggaaagagggagaaaactgctctgggttgtttattccaccagccgtgttcctatggagtcaccacaggttggctgtgacctttggctgaagggaatcttcacccttgaccttcaggcccagccactgttttcttgaagttttctcttttcactgtgtttctgccaggttttggtatcagaatcatgctgacctcatagaatgagttgggtaggaatcccttccccttgattttttggattagcttcagtaggattagtagcagctcttctttatacatttcatagaatttgaatatggatccatctggttccagcctttttctagttggtaggctttttattactcatttaatttcataaatcattatcggtctgttcagggtttcaatttctccctggtccactcttgaaagggtgtgtatgtccaggaatttatcaacttcttgtacgttttttagtttgtgggcatagcggcactcataatagtctctgaaggctttttgtatttccatggggtcagtggtaatgtcccctttgtcatttctgattgtgtttatttgacttttctctcttttttcttaggctatgtagcagtctattaattgtatttatactttcgaagaaccaacttttggtttttatgctttttcacgtattcatttcattcagttcagctctgatgtgggttttttttttttcttcctcctgtagctttgggattgatttgctcttgtttttctagtttctctgagtgaatattcaccattttttaagcatttaaaattaaatgcttaggatagcttctttggaaatacactaatgtttaaataatcagagtttctttccattttaaacatgtaaaaaacctcttagaacatctagtcttccagatatatataataggggaagatatttacttacaaaagaggtagtttgatgtgcctgaggttacacatagacagcgtagtccaatgggagaaacataaaattacatgcttataacagtctatgattatttctctagtaaaagtgcacacagttcaggacaagaggaagtcaatgagaagacattttcagaaaaacgaatgtgtgtatacaaacataagaacgcataaaagtgttcacatttgcaagataaacattgttcatcatagctggaacaaaacatttactaaaagagcaaaactatatgaggccagaggggcagactggaattggattataactcttatgttttctaagtagtttggattcaatcatatttgttcaatgataaacctttgacattttattttattttttttctggccatggagtaactggaaatagacctgattcccttgtttcctttaataataataaaaaaaaagagtaaagaaaactggacaaaatatacaaatcaactgtttccagacattcaacaatagccagcatgggtctctgatccctgaaagaaggaaacaagtacaattagtgttgtaagttctctggctttcttgttaatagaaatttctgaactccaatgcaataaggaataagctaatcataatacaatgatatctctgagttgaggagacagaaaatgatattcagaaagattgaggcttatggaatgttgaggaatggtatggaattttatggaattgaggcttatggaaagatgaaactggaaatgaagaagccacatggagaaagacatctgcatagggctggaagagggatcaccctgaatcagctgctgaaaatacctagctgagtatgcataggaagatgcttcatgagtgtgggcaatgccggagctcacagagtggtgggatttgctcaagttataatcagcacagtagtggaacatttagaagagatcccagaagtgtcctgccttttgtagtgctaaactagccatagagcaaaggtcattcaaatacacactaaaaagatttcttgaaaagtcttgaaatggtcaacctgcctgcaacatatgccagaacaaagtccaacaattgttagaagatcacaacaaaacccaggctttcaaaatgtaaatgtcacaatggttggtatctaataaaaaattactagctttgtgaagaaagtagaaaatattactcataaataggagaaagattagtgaatagaaacaaactcagaaatgacagagatgatggaaatcactggcaaatacagtaaattagctgttacaaatacataaagccatcaaggaaagaatgaatgtagagagaaaacaaagataatatatttttatgaaagaactttgtgaatttaaaataaaatatttgaaatataaacttcactggaaaatactaagaacagattagatgctgcagaagaaaagatcagtggacttgaaacaatatcagtggaaaatttcttgacacaaatagaaaaggaatgaagaaagtagaacctaaattaaccataggccagtatctacatctatcatatttgtaattagagtcagaatggggcaaggaaacttgcaaaaaatatttgatgcaataacggccaaaaattttctaaatctgatgaaaaagttaaaaaaagttcaacataacggaagcaggataaatgtcaataaaaccacactagcgcacatcattagcaaattatgcaaaaccaatgataaagaaaaacattttaaataatcagaaattaaaagacacattacatccacatattatgcacatagtaaaaacgaatgactacagacatctcatcagaaaaaagcaaactggaagacaatagaacaaaatgctgcaaatgctgacggaaaaccaaactgaactaaacaaaaattcttaatagaaaaacaaacctagaagatatttctcacttaaaaatgaagacaaaaagaaagtttcaataataaaagaagtgagaacgttctgtcatcaaacttgctcttctaaataacaaattgatcaataaaaactaaataattagaaaatattttgagctgaaggaagatgaaaacacatcagattccaatttacgtgtaactacagctgtgattagaaagaaatttatgactctaacttattatataaaaataaaaacacaacagatcccaatttaggggttactacagttgtgattagaaagaaatttatgattctaacttattgtataaaaagaaaaggtttaaaatcgataatctcctctttcaccttaaggaattagaaaaagaagagcaaattaaaacaaagttgaaagaaggagattgaaaaatgactaagaaggaaatgatattgaacatagactagcagtagagaaaatgtatgaaaccaaaagttgcttccctgacaagatcaataaagttggcaaaattctagtgagagacatgaagaaaaagagaaaaatgtaatgccattaataaaagagatgatgtttatacaaatgctatagatattagaatgacaatagtggaacattatacgtaattttttgccagtatattaggcatcttagatgaaatggaaaaattccttaaaatacacaaatcactaaacattcacacgagaagaaatacagtatataaatatgcaattaacattctcctcacaaaggaaactccagatgcagctagtttcactggtgcattttatgcaacttttaataagttaataccaagtttacacaaactctttttaaaaatataaggcaggccaggcgcggtggctcacgcctgtaatcccagcactttgggaggccgaggcgggtggagatcgtgaggtcaggagatcgagaccatcctggctaacacggtgaaaccctgtctctactaaaaatacaaaaaattagccgggtgtggtggcgggcgcctgtagtcccagctattcaggaggctgaggcaggagaatggcatgaacctgggaggcggagcttgcagtgagccgagatcacaccactgcactcgagcctgggcaaaagaatgagactccgtctcaaaaaaaaataaaaaataaaaaataaggcgagtattgaccagattccaaatccagacatatatattaagaggacaaaaaaaagatcaaattttctcatgaatttaggtgcaaaacaccttaactaaataatagcaagtcaaacctagcaattatagaaagtatgatagtttgttatggccatattgggtttacccaaagattctgtgtttgctataaccttcaacaaacaatgtaattcaccgtattacactgacacctcaaaggagtttttaaaaacttgaaaattttggcaaacaataataataataaattaataggaatacctaatcaagataagatagaaaagaaattcctgaacttcatgaatgatatctgtaaaaatactacagctgacatcatgcttaatggtgaaagaatgatgctcctgcctgaggactgggaaagtcaagaatatttgttctcactccttctgtgcaacattgtggtagaggacttagccagtaaagtgggtaagacaaagaaatatatgcagtaaaactgtgtttatctgcagaagacatactgtgtacaaaacaaaaaggaaggaaacaaaaaattgtggaatatacacacaataaactattgaaaataagtgaatttatcatggttacatctgtaggccaatacacaaaattcaaccatttcatcaatgaaaatgcaagatttaggagtatttttaaaatgctgtttaaagtaacatcaaaaatccatggagtatctaggaataaatccgataaaaatgaatacctcctctaaaatctgtataatactgctgggagaaattaaagactcagatttctacagacatagacttgtatatatctgtatacaatatgtacacatggatatatgtgtgtacaatatgtatatatgcaaacatatatgtgaatgtatatatatggattagaaggctatttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggctatttttgtgatgtaaagtctctccaaatagatctataaatttaatacagtgcacgtacctcaaaattccagcaagttactgatgtccacttcatgttttatcaaattttttgatgtttcatttttgctatttctctattactgtattttcaaggtcattactcttttgttcttcagtgcctaatattttattaatatcacccagtatatttttcatcttagatcatataattttcatgtatttcagattctgcagtttttatttttagaaatatataacatgctcatgctttttctaccttattaaatacctgaactacaatccaggtgtcctcatcctgtgtttctgtatcccttttaattggtataggtacctaggtattgtgaatcgcatctcatttggtgctagataatcttgtattttgctaaaatattcttaagcaggttaacaatatgatcagatttgcattttgaaaacgtaaatgataaatttaatatagaagcaaatgaaaaagttttactggcctaatgaagcttacttagaaaactgttgtagtaattcaaaagagaaatgatgagttaatcagcacagtgcctgccaaatggtaacaagtggataattttttgttgtgtcacactgattctgtttaatgcataggggttagctatttacactaccctttttggtttacagaatattttatattggaaagcaattctatgctgaaggaagctatcctgaagaagaagataggaaagccagaaattaaaatccttcatattgacgactatggtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaaatcatgtataaagatgtgtaaatttttttgaacttcttgcatcccacatggagtttggtgctactgccaggaatagtgacactaaatagtttgatttgtgggtgtctgcttagcaattactcaagccctgcgctctttatcagttgtttatgcaacattgtggaacatgtaattccactgctaaaacaatgggttatgtttgtatcactcctattgatttttcctcctgcatgcatggcctgcagtaagctgctcctatgctcagaaaacttgactcaagtttttttcatcttgaaattgactttgaagttaaatatctttatacattttgtaaggctatatcatgactatatagtattaggcaccgaggcccctaacatctaatgcgtaactaacttgatattgatttagcattgtattcctgagagttataagttatttcccttattaatatgatcaggtagcatattgatataatagtgcttaaaacagtctaaaattatatctttagatacaataatttcttcagatataatatttagaaatagtaaatatgaaaataacattgcttattatgatcactgagtatagtggataagtattcagtctgtggaatcggatttcctgggttcatattctagttttgctatttattagctgtgtgtccttgggcaagttccttaacctcctacaaggctaagtttctctaaatataaaacaatcattacaatacaacctgtgttttaagactgctttgtagactgagtgaaatacaacatataaagtcccttaaacagtgcctaacacatatgattcttataattattgcgattataattcttttttgtatagactgcatttattttatttagatattttaatatatacaagcaatttgtccctttattttaacaaaccacataatacagaaataatataatatttaattttctctctcactctagtgttcatttctaattctaattattgagctttatatagtttctcatatccaaacttttctcccttgtccctaaaagccagaaagctctgaaagttcttaatgtctccttgaggaagttcttatttgctgtttcttaattcattgtttttttttcttgtcttttttacctagtttcttctggtctattttaactgtatgtatgatttactgaggaaaaatgtttaaggcactaaaacgagacaaaaagaaagcaaaaatcaaacccatcttctatctcagtcacgtctccctttggtaaaaggaaatgttcttttgattcactgaaaaataaactttctcaaggaagggacatccctcaggcacatcctaggcatccctcagtatgtgatgaccttcaaaatggaagataaaagaactgactgcccttgaagcatgatatttatgcagacgaatgtgtagataattatgcccacttgcgtatccacctgctgtagggcagtgtcacacatagggggaaaaccgaataagagttaacagaatctctttgttttctgaaacagataagctaactggctcatcttggcatcagacttgtgttttgttctggttgatttttagtttataagaggaatataaggacctacacaagaaaccaatttgaagacttctcttattggcaaggggcacttggggttttttttgagaagtgggattttggagcaaaatgctggttttggagtcaggtaggactgggttcaagttggagtgctgagatttaacaatacactgctgaattttttgaatcttctgttgccttataaataaattggggaaaataacatgggataatatttctatttaaatatattaccatagtttttggtagagcataagcacttgcagatagtctttaataaatcataagcagaattataattattattagtatggtgcaaaagtaattgcagtcattataaatggcaaaattataagtaattgcattacttataaatgcaaaaactgcaattgcttttctgccaacctaatatggataatagtattttaaagtatttaatgtgattaatataaatatttaatgtgtaatttaatgcccataaagttattcaatagacagacactactaaaatagataaaatagtgccgtcagacccatggaatttactttgctacttttttggttgatacaggaagaatgaatgaaaatgagtataaaatcatttctagttatactttgttatatatagttatatattgtttatactaaatattaattgacattatccacacttttgggttttagagggaaattatcgaaagcgtcacagaatgtgacttacaaaatccaaaaggagaatttctttttttttaaatttatacttacaatatgatctattcttttaaattgcatgattatttctaaaacactatgcttgaaaacatataagggtcagaatagcaaaagtagaaagtgttttttaagaattttaaaaactgcccatgatttaaagccatattttttctcaagcttaaaaactgttttcagtgacaaattgacttcccattctaaaagtaataataattattatttttttcgcaaatgagcaattagacagtgataaacaatagagcgactattatttaaatgagtctaagaggtcattcagtgattttggtgtcagtactttattgcaattttgtgccatatatctggtagccaacagaatatgagccatttcttgatctgtagtgatgggtttacatccaaggaattatataatgaatgcatgagttagcgtcaggctgcagcaagcacctgagtggctgaaagaaagactgccctggaagaaagtggcctctggcaatttggaaacccagttctgctcaatcttcattatggatcttcaaaagaaatggtcctctgacctcccttgcttggtcatatgttttgaaactcaaacttaatctcgtaacatttaaaatgtaagtgaatcaaagatcaatgtcaatgtcacattaaaaagagtatgcgggatggagtacataccacattaatatttttactgtagaatatttttaccataatggaaaaatctaagaagcattggcaccatagatggatctcagtgacctgagtttgctgtggtctctacggagtcatgatcccctttttctgaacaactcctccaattctcccttcaagtgcctatttgttttactcctgcctttctgtttaacattatagggagcccttaaggacccggagtccttattcatttttaaacttattctatacacatctgtattcattccagctcttataacctcgtattgttcttttttaatattattcttacttcctactcatgtttatgtaatttaataccatacacgtctaccacattgcttttacatatgagaagccgtgttaatggctatggggagataacaagattgcaagcatcttgaagtctataatagttatttgggtttgttcagtctatctccgcaatgcctaatacacagaacttactgactatcctgtaattaccaaatagtgccaagactgaaggtgttgtggaaaatgccctgcacttgcagacgttcatttggtaaacaaacaaatatgaatctaatatacttagatgctgataaaagcaatccagaaggttgtactgttatttaaaaagaagggatttttgtttttgtttttattttctgtccctctgaagaggagcagcatcagctcaggagtttatttcagtaccaagggcccgtcatctcttcccattttctactttttcatgctcaagttatcttgccacactcgttaaaggtctaataagggaggcagtaaatgttcaacagattatattaacttccagaatgcaacatatgctatcttgcctccatgactttctttcctttctctgaattcaccttccttgaaatcccaagaaattcatggtcatccatcaagtcttatcttcctggagctttcttccattctcctcctctgtcagcctatggatcaggtcattctaaccggagagcattattcatttttatctagagtctcatcactgaatgttctgtgtatcagaatcctataattgggtcatcttggtagaagtgatctgttttctatataagtattctttcaaacagcatgatataagtaactgatcattcacaatgagggaatatattcagttattcatatccaacagtcaagataacatcattgctggtttgttatacacacatttcatttcctcaaacaacttgaaatattgtttaatattttaattagcatcaagcttcagacaagtcagacatcctatctggatgactgaactctaacctgctatactattctctacttacacttcctttctttagtttattgctttttgctctctctctcttttagttgcttttccactctgctgctaggttgaacttggcaaaatccatatctgagaatgtagccctcctatctaaaatcttctcattattcattcatcattgattaaagctctgcgttttccctcacactacgtaacagtcttcatgatatattttctatttttctcttcgtttttatctcacatcagccacccccaaagagaaatcccatcctttagacagactgctttgttctggggaacaccaccacttcaatcatcacttgtgttttcacatagcctcccagtgccctgagtttgcctgcccacctggagaagttctcttaagacttccagacacacttccagataactttatgcacaccgctattacaaacatgtaaccataccagattacaacatttactttgctttctctcctgttaaactgccaattccttttgaatagttttgccataccgcactaactggagcattatttgatagaataaatgaatgaatatatgaatacatcaatgaataagtaaacaaatcaattaaccctgagtttgtcctcaagaatgaattaagtcgagatggagaaatggagaaataaatgatttgtgagtttataattgatttctgtatgggtccatttctctgcaatttagttttgtactcagaatgagacgcgagtttctaatttctcttatagtctttctggatagggctgaatattgattgattttcatgctgtctcttcactgtttctttttacaatttttttacttagcttaagataataagaattgatattagctaccatttattgttattgtgcaaagagtgtcttgctgagaatatttagacatcatctttagtccttatagaaatcatccaaggtgaatactactgtcctcatgttaacacaaggaaactataactaaaataggtcatgtatgtgttcccccaagttcacagaaggaaaagttaaggtttggactcaagttttatatatctattttctgtattaaaacctctgctgtattacccaatgctgcctgcctacatagtccaccgtattatgataattattggcatattatcaaagaatgatgacttgaatcagaagaggcttctctactgccaaattcttatgaacttttcttctttccactgaacagtttataatagtttctggaatataacattttccacatgtactatgttaatgctttggtgtaaagtattgattatacaaatcatgactgagttcatgaatattccacaagagagatcaaattctcagctcagattatttaataaaattctgaattctcatcaaaatgttcactttgtgggaagtcttttctactctgtatttgtttcatagattcctagggttttcgcagatcagattgtgagaggtgagttcattttgtttcccaaggatgaagacatatatattccaataacttccaacatcatttgatcttctatttgttcatgccaaatacacatctacttttaccctcagtttcttgcaaaaatagtacatataccgtctgatgtgggtgaaagagatagcttgttgatattaatgtttgtctcaaagagggattattattgctttgccatataatgaggttcaaagcttaaattttaggtttatcatttttgtatctttgtcatttacatggatggagaatgtacccacactgtaatacatagaaaatgactaagaagaaaaaaggcagtggcatttaatcttgttaatagaaggggagaaggtgatcatttgtttctgtttttttcttgaacatatttaaacttgttctttcacaatttgtagataatgcatcttaaatgtcagcattaacttcttaccactatttaaagttgtacaaactcaaacttgctgtattaagaaggtgacatgggggaaaaacccaaatttagataaatttatagataatgcctaagctataatatttgtttggtgtttattttaactggaatatatatatatgtgtatatatgtgtgtgtgtgtatatatatatatacacacgtatatgcacacacagaaacacacatgccattttaggtcttctgttaacataggttttagatatgcatggattcacagaattatatgaatgatataatatggtttcatatgaatgatatgggcttattaatagttcctatttaaaacttacatgtatatgacatatttacagatacactactgaatactttttataagaaatattgaacttcgtaatttacaaagttcttagttttagatggtcatataaatgtagtcattaatgtaagggtaattcatattgaaatcagtctctttttctgttttaattagttatttgtttttaagaaaaaacatattaggatataagattaactatattattagtttaacatgactttgaaaggtgaagttaaaaataccaagatacagtgtattctttcttggtaatcccacacatctccacatcagaggaatacatcaatgacattatgttattccaggattttttaaataatatattctttccttttgacttatatataaaaacagtacattatgaatcatgtaaggctgtgtagcatgtaagtcaaagtgtgtctatgatgatgggaggctaggccagagctccaggcttttctagtccaacatacatatatttttgagcaacaagtaatgtgcaaagttccctactaaaaattacagggcttctaggagatataaaacttgggaagaaactaataattattgtatttttaaaagaaaaccacaacccaaataatacaattgttattaatatagtaaagttttaatcaacgttttgatttggaatcattcagtcattttcagcattggactttagcacttgttcttcctcttggagggcattctcttatagccgttttttctcatttttagcatgccattttaatcaaaattataaacctgatctagctgtagccttcttcattaatccactatctgagtccatgtctttgtagcctgtatgattagagctctcagttgtcacctgtccctcagtaacatggaggaagcataatcaattggaagttgctagatcagccacaactcaccctaaaaaagtgcttccgttgatttttagcttttttattaaggttccaatatattgctaagactttttccttacttataagaaaatgtggctctgatttcctctagacattaataccttgggaaaggctgtgtctgcgccactatgacagtgcattatactgacataatctccctgtttttcatcacatagaaaacatgtcatacaagataaatctatgttgcacaaaacatgctgcatctttgggaattaaaagtgttgaaaattatattgatacatatatgttaatgtataggttatatatattttaatttataagggcacacaaaaaaagtccatctatataacatgtagtttacacacttcctatgcttttattttttctttttttattaatattattatactttaagttttagggtgcatgtgcacaacatgcaggtttcttacatatgtatacatgtgccatgttggtgtgctgcacccattaacacgtcatttagcattaggtatatctcctaatgctatccctcccccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcaccattttttatggctgcatagtattccatggtgtatatgtgccacattttcttaatccagtctatcgttgttggacatttaggttggttccaagtcattgctattgtgaatagtgccgctatgaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattataactggtgtgagatggtatctcattgtggttttgatttgcattgctctgatggccagtgatgatgagcattttttcatgtgtcttttggctgcataaatgtctttttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgacagtagtttcttttgctgtgcagaaactctttagtttaattagatcacatttgtcaattttggcttttgttgccattgcttttggtattttagacatgaagtccttgcccatgcctttgtcctgaatggtgttgcctaggttttcttctagggtttttatggttttaggtctaacgtttaagtctttaatccatcttgaattaatttttgtataaggtgtaagggagggatccagtttcagctttctacatatggctagccagttttcccagcatcatttgttaaatagggaatcctttccccattgcttgtttttgtcaggtttgtcaaagatcagatagttgtagatatacggcattatttctgaggctctgttctgttccattggtctatatctctgttttggtacgagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataggaaggcttgtgatttttgtacattgattttgtatgctgagactttgctgaagttgcttatcagcttaaggagattttggcctgagacgatggggttttctaaatatataatcatgtcatctgcaaacagggacaatttgacttcctcttttcctaattgaataccctttattcctttgtcgtgcctgattgccctggccagaacttccaacactatgttgaatgggagtggtgagagaacatacctgtcttgtgccagttttcaaagggaatacttccagtttttgcccattcagaatgatattggctgtgggtttgtcataaatagctcttattatttgagatacgtctcatctatacctagtttattaagagtttttagcatgaagcgctagtgaattttgtcaaaggccttctctgcatctattgagataataatgtgatttttatctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcttcaaggatattggtctaaaattctctttttttgtagtgtctctgctcggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgctccaatttcggagcctgttattggtctattcagagattcaacttcttcctggtttagtcttgggatagtgtatgtgtcgaggaatttatccatttcttctagattttctattttatttgcatagaggtgtttatagtattctctgacggtagtttgtatttctgtgggatcagtggtgatatcccctttgtcattttttattgtgtctatttgattcttctctcttttcttcattagtcttcctagcggtctatcaattttgttgatcttttcaaaaaaccagcttctggattcattaattttttgaagggttttttgtgtctctatttctttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctacacactgctttgaatgtgtcccagagattctggtatattgtgtctttgttctcattggtttcaaggaacatctttatttctgccttcatttcgttatgtacccagtagtcattcaggagcaggttgtttagtttccatgtagttgagcggttttgagtgagtttcttaatcctgagttctagtttgattgcactgtggtctgagagatagtttgttataatttctgttctgttacatttgctgaagagtgctttacttccaactatgtggtcaattttggaataggtgtggtgtggtgctgaaaagaatgtatattctgttgatttggggtggagagttctgtagatgtctattaggtctgcttggtgcagagctgagttcaatttctggatatccttgttaactttctgtctcattgatctgtctaatgttgatagtgggctgttaaagtgtcccattattattgtgtgggattctaagtctctttgtaggtcactaaggacttgctttatgaatctgggtgctcctgtattgggtgtatatatatttaggatagttagttcttcttgttgaattgatccctttactattatgtaatttccttctttgtctctgttgatctttgttggtttaaagtctgtttcatctgagactaggattgcaacccctgtctttttttgttttccattttcttggtagatcttcctccatccctttattttgagcctatgtgtgtctctgcacgtgagatgggttttctgaatacagcacactgatggttcttgactctttatccaatttgacagtctgtgccttttaattggagcatttagcccattgacatttaaggttagtattgttatgtgtgaatttgatcctgtcattatgatgttagctggttattttgctcattagttgatgcagtttcttcctagtcttcatggtctttacaatttggcatgtttttgcagtggctggtaccggttgttcctttccatgtttagtgcttccttcaggagctcttttagggcaggcctggtggtgacaaaatctctcagcatttgcttgtctgtaaagtgtttttttctccttcacgtatgaagctcagtttggctggatatgaaattctgggttgaaaatgcttttctttaagaatgttaaatattggcccccactatcttctggcttctagagtttctgccgagagatccgctgttagtctgacaggcttccctttgtgggtaacccgacctttctctctggctgcccttaacattttttccttcatttcaactttggtgaatctgacaattatgtgtcttggagttgctcttctcgagcagtatctttgtggcattctctgtatttcctgaatctgaatattggccttccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttcatgcttcatttcattcatttcgtcttctatcgctgataccctttcttccagttgatcgcatcggttactgaggcttgtgcattcgtcacgtagttctcgtgccttggttttcagctccaacaggtcctttaaggacttctctgcactggttattctagttatcctttcatctaatattttttcaaagtttttaacttctttgccacgggttcgaacttcctcctttagctcggagtagtttgatcttctgaacccttcctctctcaacttgtcaaagtcattctccatgcagcttcgttccgttgctggtgaggaactgcgttcctttggaggaggagaggcgctctggtttttagagtttctggtttttctgctctgttttttccccatctttgtggttttatctacctttgttccttgatgatggtgatgtacagatgggtttttggtgtggatgtcctttctgtttgttagttttccttctaacagtcaggaccctcagctgcaggtctgtcggagtttactggaggtccactccagaccctgtttgcctgggtatcagcagtggtggctgcagaacagtggatactggtgaaccgcaaatgctgctgcctgattgttcctctggaagttttgtctcacaggagtacccggctatgtgaggtgtcagtctgccccttctggggagtgcctcccagttaggctactcgggggtcagggacccacttgaggaggcagtctgcctgttctcagatctcaagctgcatgctgggaaaactactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttggagcttctgggctgctttgtttatctactcaagcctcagcaatggcaggcgcccctcccccagcctcactgccaccttgcagtttgatctcagactgctgtgctagcaatcagcgaggctcggtgggcttaggaccctcccagccaggtgtggggtataatctcctggtgcaccgtttgtgaagcctgttggaaaagcaaagtattagggtgggagtgacccgattttccaggtgccatctgtcacccctttctttgactaggaaagggaattccctgaccccttgcgcttcccgggtgaggcgatgcctcgccctgctttggctcacacagggtgcgctgtacccactgtcctgcacccactgtctggcactccccagtgagatgaacccagtacctcagctggaaatgcagaaatcacccgtcttctgcgtggctcaggcagggagctgtagactggagctgttcctattcggccatcttggctcccattttttttttttttttgagacgcagtctcactcctgtcgcccaggctggagtgcagtggtgcaatcttggctcactgcaacctctgcctcctgggttcaagctattctcctgcttcagcctcccgagtagctaggattacaggtgcccgtcaccacacctggctaatttttgtacttttagtggagatgggcttttgccacgttggcctgactggtctcaaactcctgacctcaggtggtccgcctgcattggcctcccaaagtgctgggattacaggtgtgagccgccgcgcccggcacttcctgtgctttcataagaacttgtactctcaccgcattatgattacaacagggcagatattctaatccccgtttttgcaggtgagaacccttgagggacagaactgatgagcaatatgcctcatgttggacaactactaagaagtgaaaactcagcaacaatgtgccatacaagcttttattacttttccctaagaaaaaattctagggataaaggaatttaaaatacgtggtgtaaattcagaaaaagacccataattagagcttaataaataaaagagattttttaacaccttaaatttataatcttattctggctaagaattccaatttccttttgccttgaggatataattgcttatatgccaaaggtataagtgaatattttgttgaggtcaacttttataattgtgttctctcaaaaaactggtgttatttgtctatctatggtttataatttctttaccgctatatgtcggtttactaagttgcaagatggttctgccactgcctgcttatacttagtactataatcattattattcctatttaactgatgcaaaaactcagctaaggtgtaaaattccctatgtttatataaccacactttccagttgataaatggatttttagaatgcaggtaaaggattatatagttagaaaaccagtattgtatcaccaccatacattactgaaggtgtcatgatgccctaccaaggatgaaatacaggttgaaagttagtaataattagcatccattcctgtattatcaacccattgcacacatatgtatccttcgatatgtagcctatatgtattgtcagcctcagtacgtactcactacattcccatgctgaattgccctctccttgaaaaaatacagaaatttaagtttgttgtggagattgtcacctgcttcttttttaaagatacacacactttgttctattttttatctaaattgcccccccacccccagttcctgaagcaagcatgtagaatattttccatgatcatatccaaagtggacctgctgcataggagagtcacattgcagttatgtgcacgtgaaaactgagataaattctcctgtctttggtgtgtttataaaatgtgctaagctttcttttaaccatgaataatttaggtatgaccctttctaagtgcaagagaatagatcaaatgctatcctagctctgtgatgatatagctattcccagcaactgaaagaaaagatcatcaaagcctcttacctttctacttactcactcacactgttagaaattatctcaaatgaaaattggccaaaggataagaattaatgtactaagactttgacagcaaatatcattaggagattgtacattccttctattttattgaacaatttctggctaggagatgtccctgaggtccttttctattggttgtattcttatattttcatgtgctgtccaagatgtttatcctgaggttaattttgtgtggataatgctaacagtccatttctgagttttagagctggctcattaatatctatgctgttcagtgtttcaacttgtgtaacaataaggctttcagtttttggatttgtactacagtacgcgtaactgcagttaaacaactggactctgttttttcttcattactctcatgatggtcattatgcagtttttgcatcaggctaaggagacaatctctggctttcattcaagataaagagcaaaatagtatcaaattcccttcaagacaaggaagagtgcctttggccgataatagttcatcatgacataaggaaaactatttcattaaaaatagaagagagaaaaaagggacaagtaggaggaaggctaggggagagatccaaaaaaagattcaattttattaatgcaaaatacccaaacttggagatcaagaaaaaaaaaaacattaaaacatcaaatatatgtttgggttttttttaattctttaaaaacacgaaaaattctgattgaggaaaaacattaaatgcatttttcaggtttatctgaagtcacagataacaatgttaatgaacagacccacatatgaataagtgaaaagacttaagaatgttttctttaaaatcaaactataactgagttcagaggcactctggattttagcaatttaaaagcaatcactgctactaatctaactatgaagaagctcgtaagatacctttaacatatggataataaaattgcaaaagtgccagacacgtgttcgagagatacacgctgagcagcatatacgtgtgcgaaaggcacaatatttcttttccatttgtatggccgtgtaactataattcaagccagcgaagatttatttatgtgacataaagactactagaataataaagagatttttaaattatgtgtatttgtgcaaatagactagaggtcaagaatacttcgatgacataaaaccaccttccctgagaaacgatgttcttgaatgagagtgcaggaattattgatgcagagttgcatagagatagtcagatttgggtggctcagcttctacaagaggaatggaaggtgtaaggtcaagtcccaaagtgttgtccagaactaggttaataatattgaacacctataccaaggaccaggcactttacgcagctacatatagaatctcatttaatccctgccataactctactgggtagatgctattatcaccctctataccaaattaaaagcaaacgtaggcataagtgtctaaagccactggacctgggctcaactcagtttgatttgatccccatatcacctgtaccttttcacagtgacatgcttacttctttataaagtctaggtcatgaatgcaggcaacctttctgaaggtttgacaatggacaaagtctgagaataaaaatagatgagtacaagtgatttggaggttagtacaatttgagaatttaatttatgaacagaattttttatacattatcaggtagccttcatcataatcaccgccagaaagaaaaatcttagaactaggagatagggtcttggtagcggcatgaacaaccttgatcgaatcaactgctttcctggttatgacttataaaaaaaggaattcaaccaaaagctacactgtaaataaactagggtgaggaatttgaagattatcttaacaatatccctaatggaagaagatgggaatgtggacaagaaacagttctctggtaggaaaaaaataatgtaattccttacatgatgaagtaaatacagtgtatgagaaaattcattcagccattcttcatgtaggaaaatccatctatgagaagaaatttaaaaataataaagagataaatagaaggaattggcccaagaggcccttagccaatatgtggatctatgtgtacatactgcttgaaagagggcaaacttcattatactttagatacacatatgctgcaactaaatcatcatggattataaatctctataaagtaaatttttaattaaaccaaggcaaatattgtttaaagctgctatcctatgttaatctcatattctacctgaaatgaattgtcatgaagaataaaatggaagcatagatagttgattatgcttcagaatataaggtaatattgttctttgcatattgtttccttttccttaccttgatttttattctgttctttactcctcctttcacattctttttaaattcataatacctacaattaaattgcaacccttggttctcaaggattctagctttcaaacaggtactcgtgcaactgagcgaacctgttgtaggcctagaaagagcaatgaactgagatgactataaagcagttctctctatgtcccctctttccactgccccagtggacacaggtaagcagctgacaaattctgccatgctttcaactggtcgtcagaagtcctctcgttagaataatattcttccttccatttattataactaaagctttactgataaggataagagctttcaaaaatgtacttttaatggggtgcggtggctcacgcctgtaatcccagcactttgggaggccgaggcaggcggatcacgaggtcaggagatcgagaccatcctggctaacatggtgaaacctcatctctactaaaaatacaaaaaattagccaggcatggtggcgggagcctgtagtcccagctacttgggaggctgaggcaggagaattgctgaacccgggaggcggatctggcagtgagccgagatcgcaccactgcactccagcctgggcgacagagcgagactccatctcgaaaaaaaaaaaaaagtactgccctgataatttgtgatcttaactatttaccaccaaatattacttaacaatgaaaacaataaataaaaataaaaaaaccaattaattcctcaaggtacctcagcagattggtaatgaaatcaaggactaaaaccttagtcttctgtatataaattcaaccctctttttagaatttaattgaaacactttgtgaacccgatcaaacatgtagtttgaacaaatctctatactttaatccagttttggtataaatgatgttttttatgtcataaagaggtgacttgttctgtcatttaaaaaatctattgagtattgtttgttttattccattttttctatattttattatattgtgaactcatccatacagacacattcagtgttgaaggtattgaaagagatgaggattctgccctcaaagaccttaacttctaagaaaagtttgcagtcttaatttgattctgctacttgtgttaggaaatagacaagtgtcatattgctatgaccttttcactgcttaaaacagatggaattgttcttttcaccgcaactttcaacaaagttgtatgtccccactctcaaccttgaaacacccttcttactgtgaatccccaaagatttctgagacagagataaaaaagcaaaattgtgtagaaggcaaatgagggagacactcagaaagaaacaaaaataactaaatcaattggagctcagcaatcttgcacagccaatacacacatgagtcgtggtacccatttattataagatagatgatttgtctttagtacattctgtgtggttatccctagcaccaaatgttttgctattcctattttactgaataagcactctttgcttagctttatttataagtctagtattttctgctcaacactttgtgaacaagtaatgtccctcattttcctgcacatgcctgatttgttccttataatgccaatgattagcatcataatccatgttcttttaagtgtatgttgaaatagatatgcctatattgtgcaccaaagaaaaagaaacaacacccaattagatcacagaaatgggttcaaaaatctttggttcataatgaattgataccacttcgtgatctaacatttaaaccttggaaagactaggttaaagtttaaaatggcaattaagagaagagagcaaaagagtgaaattgtagttttcttctatgagtgtagcaataatgagtaaaggattgaaggatttgttttaaaaaacctgttgccatttactaattgtgagtttgaaaactgtgccttattttaaactctatcttaaaataatttacttgcctgccataaaatgtctgacttatttacattttaactaaacatatcttagctgggaacttctgaaatcgctgtgaacaaggcaatgtgtcatacgtagattggaaagttatatcttttaaataaacaaaacatcttatgttgccttagcactgctgccagagtttataaaggtgaacaatcctgccttaaaagttaaggacactctggtgatcactccaagggtctgttgattgcactttttttatatccttgtaaggctttagatttcattggtccatctagaaaatgggattacctctgacataagagctcatattacatagcaattatgctttatccatagatattgtgcatttaattactgtacaactagccgaaattctttatatagttctccatttttaagtgtaactcaaagaaatatgctcaacataagcaaaattttcttcaagtaaaagaataaaaaacagttgttattgtcctataaatctaatcatggttttgttcattatacttcataaagtattttcaaatgccttatgccattaatgcttacaaaatgtctttgaggaaaatatggtagtattggccatcattatagacacagactgagtcctagtgtttcagttatttttgcctatgttggtagtaaagttgagattcaaccttggtatttttactcagcttagtattcaaaggtgaagttaatctttggtacctgttctctgtgaatcaaaatatttgcaataaatccacaagcttcaaaatgcagtatctttatgtaaactcaagtctttttaaggcctttccattttaaacttcatctattttccctgaagaaggtctacttcaacaagcattggctgtgtcctatgcatactagaaattatgctaggcatgattcgtgctagttctcaaatgttaaacaagctgtatcaggatcaactgggcaactgaaacaaacaaacaaacaaacaaacaaaaaacagcaattccaggcttacttctgaatgaagacatcagacttctaggttacagcatggggatatgggtagtaataaatttcaaatgatctgatcaagagccaaggttgcataaattaaaatacatttaaaaagaaaatataaaagaaaagagaaaatatctaggtggcaaacactgtggaaagacaaggcatattttgatttgaatcactgaaaatcacattaaatgagtgatttagaaaagaatggaggagagttgtgattcattaatttctatggcacagtttatttacggtgtttctttatttataatacatctcataatccacataatagaaaacttactcccaaaaagatttactaaactttggaaatatggagtacatgacataatggatcttaagtgcttagaccacagaaggcatttatattagtttgctaggaccaccataactaaatatctctgactggatatctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctgactggatatcttaaacaatggaaattaattttctcacagcgctgaaggctagaagtcaaagatcaatgtgccagcaggattggttatttctgagggctctccttgggttgcagacgaccgccctctttgcgcctcttcatatggtagtcccactgtaactgtgcacctctagagtcttttgtgtgtgcaaatttcctcttctttaatgggcaccagtcagattgaattagggcccacctttgtggtttcattttaacttagttacctttttaaaggacctatctccaaatatagtcacaatctaagcaactgggtgttagggattcaacatataaattttggagaacataattcagcccctaacagcttttaataaattttagttgctctgtgttttgtctgattctctacttacttctttatgtcacttacaggattccacacaacccctgtatctgctcagtttcatttgttgctgaaaggttatttgctgtaggaaatctgataacttgaaagcttgttattggagatgatttgtgtatttggggcttctagataaacattcacataaagaggaaggcgggagagtttggtgtttttaccttgaagagtgagtaggctgggaatttctcacaggttgcccaactaacaatggagatcctttcagggttggatgtttaaatggtctgtaaatctatcacatgcacaacttcctattggaactatatctaggtatggacctagatattctatgtgattgtttcagagtctgattttttactttttctgtattctagaaaattaactaataaatattttaagctgacattttaaaattgtaccttcttttccctgtggaaagaacattcatgctttattatttatgtgtctttctttccttctagctttcaagtttttcaaacatatatatctatgcttctttctgctgtcaactttagtgataaaaaagaatttttctcactgcttgtttaaattttcttcagtgagaattccaccacagaaacaaacaaacaaaacaattcaggaaatactaatgcagttttttttttaagtttaacattatgtatggttgtacatttcctgttaaattattatcaacttttcataactggttctgcccttcagcccttggaagccatttgcaagacatttctaaaacactatggaagaaatccagtaaagatagacttgtctaccaacttgacagtcattctttagaaatgcctttgggagagtatcatccattttcttcatttttccccattgagaaatgagctaaactaatttctactgcaatgttaactcatactttcatttcattcagggaacttttcaattacagttttacaaaggaaaatacaattttacgaaggaaaattgtaattttaccttcaggtttattatcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaagtaagtggatgcacatttttcttctctgttttctataatgacagagtcttggtatatgacatataatattactaaccctgactcaaggcttctattttagtgattgagcaattttgtaagttaatcataaagcctatttcattttttttttgaagtacctgtcacccttagtgctataataaaagaattctcatatttcccctctggaattaaaatttactttggatttatggaagttggatacattttaattataccactatattatttgtttacaggaatccacaatgtctgttgtatcctcagttaatcacaattcttgaagtttcacagataccattatcacactggcatgaatgtgtgacctaagaaagttagtgggttctttataatagcacacagaaaccagatatgatattgttcaaatgtagatgttgattcagtaggcctggaatggggcccaggcttctgcatttataacaagctttcaggtgataccaaactactaggccatcactttgagtagcaagattttggagtatatgaccctaatacatgaacagagctacagttagtaaagcatttctagtcattagctattgttttgtatgtatgcatgccaactatatatttatatttgcatttaactcacaaagatataactattgtttttcgttttcattgcagatttttgctgaaactgccttacattgactccaaaagattaagcatttttggaaaggtaaatagtagaaatgctgaatctatctttttatgcgtatctatgttatgtaatatcctattacacattcacaggaggccagttggttacagataagttccatattgactgggattccatacttattaacatggaaaacctcactgtagcaagatttgatggcagaggaagtggattccagagtctgaaatgtatatatataatatatgtatatatacatacatatatgtattatttgtatgtatacatatgtaattacatgcttcattatattataattcctctgtattatcctttaaaaaataacataattagtattatatacagtcagtcatttattaattcagtaactatttattgggcagttagttggcacctggtgtcagaagtagaacaacaacaggacaaaatggggctttgttttcatgaagcttgtgttccagagaggggaaacagtaaagaggtaaatgaaaaacacaatttcatatagtaataagcctcataaagaaaacaaagaaaaactgatacataaaagctaactgcagaagcgcggccagtgtcattagattgagtggtcaatttaggactctctgatgaggttatatttaaacctatacctaaataacaaatggacgctggtcaaataaatctcttgaagcagaatattctccacagaaaaaaactagcaagtatcgcaatcttaggaaaacagacacaggcttagaaactaggaaatgaccagtgtgcataattacgtcatctgtgctctctgcacgatatttacttattgcagtaactgttatgtcaggttcaacattattttgacagtgggaaaatagacctcatatagatatttattagtttgttttttatttttgttttttgttttgttttttttttttttttgagacggagtctcactctgttgccaggctggagtgcagtggcgcgatctgggctcactgcaacctccacctcccaggttcaagcgattctcctgcatcagcctcctgagtagctggggactacaagcacgtgtcaccacgcccagctaatttttgtatttttagtagagacggggtttcaccatgttggccagatggtctcgatctcttgacctcgtgatccgcctgccttggcctcccaaagtgctgggattacaggtgtgagccaccgtgcccagcctattgagcttgtttttaacacatcagtggacaatgtattataaaggtaaaaaggccaggcgcggtggctcacgcctgtaatcccagcactttgggaggccaaggcgggaggatcatgaggtcaggagatagaggccatcttggctaacacggtgaaaccccgtctctactaaaactactaaaaattacccgggcgtggtggcgggcgcctgtagtcccagctactcgggaagctgaggcaggagaatggctgatcccgggaggcagagtttgaagtgagccgagatcgagccaccgcactccagcctgggcgacagagcgagactccgtctcaaaataaaataaaataaaaagatgaaaggaaaagggggaccttgaactattttagtttacaaataaagcaaattcttggtgttcatggatttaaacatatgatattttctactattcataagtaacctagagatccatgacataaaataactggtaagtttaattggggcgtaaattttagtggtacatactgacaggtgggtgtataaaaaaccacttaagaaatgagtaaaatacaaatcagtgcaaatcacgaccatcctctctccacttcaaacatctgcagtgtatcatgcctttgcagcattctacacttgttgtcagcaatattcaacagataagtaaaaatattttgtgagcattgctcctccaacataacacaaagaagtaaataactgaaagtgcatccctagtagtaaaggttagttttttgtttttttttttaaaggaaaacatctaagaaagtgatcatcccaaagaaatggaaaccctagatatattaaaaagtgaaatgaaatcctgtctcagactgcagcactgttaagccttagggacattgtgctaggtgaagatagccagtcacagaaggacaaatactgtataattctacttattacatgaggtgtctagagtggttgagttcatgaaaaaaaagagtgaaatggttgttgccaggatttgaggggagaggaaaaagggaagctggtttttaatggatatataataatggcaagaatgtaaactagtaaagtaaaaaacaaagataaatagagaacaaccaagccagaaaatacagttcattgaaaaaaaagagagggatggaggggtgacaaaaagggagagcaagagcagtaaaggaagaatgtgagtgcaaatgagagcaaggtgctctttagtgattagccattttatgagcccatcagtttcttattagggttcttggaatttttgtctagtttcatatttgcaagatgaaaaagttctggaaatctgtttcacagaaacaaatatatacctgacactacgaaactgtgtgtttaaaagtagttaatagagtaaattttatatgttttaccacatacaaaaaagtacatgcagtagggaatattttactccttaaaagtcctgatacatgtaataatttacaaatggcttagggcctatgtatttcaatgctctgcttactgtacacataaataagcataaaggaccaaataagcttttacaaacattcatggaaatttagagaagattcaaagggttgtaaaatgcctcatggaaaagggcaacatgagctgagtggtgatcagcaggtagaggggaaggaaaagagtctcatgcaaatgcacagtgtcagtgaagggagcatgtgtggagaacatgaaatgaagtagttgactgttattagaagaatgataggcaataagaatgagaggaagactgggccgagacgatagaggatcttcattgccactgagaaattagaagctcagcatataaaccatggaaaaataacactctaggcttcacatttagaagttcaaattctttttccccaaatcgtcattgtatacttgatgtgcctcagagcaaatgactctggaaaactaaaagagtgacataggatacaaacaagtaaaaatatgaatgacttcatcttaaatggaaaaaatattccaggtcaaacaaatatgcatatctgtgactgagttataaattaaaagttgactttctcaccatgtaaaatacactgtttatcctaagattccgtagaccttgcgattcttttttcttgaaatgcactgatttcagattcaaattaggttatgctaacctcataaaacgggttggaaaacaatgttcttgctatactgattccctggaaaaatttgtttaaaattggaactagactataaagaaatttggagctattgctttctgtgtgggattaaacatttaattagtttttaaatttatgtaaccaatagaagactattaagattttgtttaatttcttctgaggtcacctttagtactttgaaaagaatattttttcacttcatataacttttcaagaatatatacaaacagcaatatataatatcctcttattatatgcttaatcatttcacttgtggcagtaatatcccattttgatttctattatgacttactagtgccttcttgcttttgctagggcactctcttgctctcatttgcactcatgttcttcctttattgctcttgctctccctttttgtctctcctccatccctcttttttttgttcagtgaactgtattttctggctggttgttctctatttatctttgattttactttgctagtttaccttcttgccattattatttttcttctactttttatatacattttttcatcaattattaagttgaatgtctagcttattaatttttcattctttctttcaaatacaagcacttaggctgggtttggtggctcacacctgtaatcccagcaccttgggaggccgaggtgggcggatcgcctgaggttgggagttcgagaccatcctgaccaacatggagaaacccctgtctctactaaaaatacaaaactagccgggcatggtggcacatgcctgtaatcccagctacctgggaggctgaggcaggagaatcgcttgaacccaggaggcggagattgtggtgagccgagatcggaccattgcactccagcctgggcaacaagagcgaaactctgtctcaaaacaaaacaaaaaacaaatataagcatttaaattaaaaatccttttgagatgctctctgaggtatttttcactactacagagtacttttattaccatatagtgaaaatatctatttgtcaggataagtctatgtcttctgaacttttcttattatttttatgtcaaattgaatgaaataattttttggtacttttctgtaacttactgactataattgaactgtggccaaagaattgatcaggataacaaaaatactttgaaatatcaattgatttatgagttagggagggaatcattgttttatctttatcaattatttaattttgtgtaattaattttcttattttacttgatcctgattagccattttatgagcctatcagtttcttattagagttcttggaatttttgtttagtgaattgatttttttttcttttttttttttatttcaacagaggtttgaggactaggtggtgtttacttacatgaataagttctttagtggtgatttctgagatttaggtgcacccatcagcagagaagtgtattgtacccagtgtgtagtctttcatcccttacccacctctcactttttccctccaagtccccaaagtccattgcatcattcttgtgcctttgcatcctcatagcttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatctttttcatataatgacttcttttcctctgggtagatacccaatagtgggattgctagatcaaatggtagttctacttttagttctttaaggaatctccacactgttttccgtagtggttgtactagtttacatttttaaaacttccatgtgtgcctaaaagtgttagtgttacatatatgtccatttaatcaaacatatccattttgatgttcaaataataaacattgattttcactatgtcctcaggaaggtgcattaaagtatccctttataatgtgaactcatcaatttctccttattaatttttctaagtacattttaaggctattattattcagttcctgcaactacagaattattatatcttctggataaatttaatcttttgttgtttttattggccaagtttatctctattaattttttgcattaaagatttttatattcaaattacaataacatccttttttcattgatacatgtttattatcagcctttccaccttattattttcagcactttccgattgatttaggtatgccctttaaacaaaaagagagagagagaaatatgtttttatctttttgccaatttctgtatttttgttgaagattgtattcatttaaatttcttctaattactgataaatttaaatgttactgttttcattatatgtgccattatctgtcctattatatttcttgtgtcttccatttatttgaattgattatttttttctctttcattcttttttctaaatataattttggtttgttcaattatattgctgagaagtattgtattgtatgactataaaataatttgtttatccattcacctacggatgaacatttgcattgtttttagttttgtgtatagttattataaacgtgtacgcttgtttttgtgtaaacatatattttcatatttatttgtaaatacataagagtagaattgttaagtcacatagtaattccatgtttacctgtataaggaatttccatactcttttgaaagtattcatactttgtattttatgttttaggaaccatataggagagtttcatttgttctacatttacgccaacacttaatatcatcagtcttttaaaatcatccacaactgatgaatagtgggatttattttattttcgtttgtagtttactgataactgataatactggacaccttttcatgtgtttattgcttcatataggtatattttaacataactgatttgttgaccattcagactgtgcaacttacactttcatattaaaatttactaagtcacagaaagcatgttacaactgcaaacctattccttccttccccttttcatcatttttaattgagatataattgacataccatgaaattcatccttatatcatatcttaacatcagatagtagtgtcttaaaatcaaatagtagtagttcttccatcttgttcttctttttcaaagttcttttaactcatctagatgtattacatttctttataaattttagaatcactttgtatcttttctaaaaagaaaatacaccatagggatttcttatgtgaattgtatcaaatctataaatcacctggcaaagaaataactgacatctaagcaatattgaagctttcatatttttaaaagataattttgtttggtgttctgttttttctagtatgtgcatagttatagatattttttcattaaccatgtttaggttgtattgggttttctgaatctatgctttggtgctttctgtcaattctagaaaattatcaattttctattagaatattgtcataacttctcatcctccttaaacacttattaaaaatgtgttaaaatctcactttaacatggttattttataaacttttcttggtgccttttggtatttaattctgtgtcatacttgcttctatagtccaataattctctcttcatgtgtgactaatggttttctatattcattgcttaaatttaaaaaaattgttactagaagtttcactgagctttctataaaaatgtttagctatattttaactcttgctttgctgatgtgtatttttaaaaatatatttagcatcattatctgatattttacatcttattaaacaaatatcttttatttttgagtattggtttcttttgcctgttatttctgctgtctctcagtcatggtgatacttttccttgtgtactgtttatttacttgtagatgagtttatctttcttggaattttatctatggggattctttgatgcttttgttgcatttgtatttatgtattatgttttatttttaattgtgtatgctgaattgggaccacacaaaccaagtgtggacttatggctcaaatttttagtcaatattaattattttttattagctcagtacaagctcataacaggaataaaaattaaaacatctcaccaatctcttttatgcagcatgggcttttattttttgtcacatttagacaatgcttttgggatctagatttatttagggtctcctttagacccattgtggattttgtttacgccatccaccaaagaaggcattagaacgaaaggtcaaacaaagtctttagcatgtgaataaaacattggtttcatgctttatttttcacgtttccagctttcagtttgtatttggcttttgtggatttatgagatttatttttagtgtttggggttgtgcctttttctaaagccaccaacttatatttgtgttttatttatttgtttggttggttggttttactttggttttctttagttgagggatcaagtggagtatctgtttcacttaatgctggaaaagaaactgccataaatatgttgttctcatcaatgaggctgaaacaagtcttccttgtaagattctaggctaagttaaatctcaatgtaaaaagcgatgtgattcatttgagatatttcctcaaggaaagaaaagatgattggcagctctagttctaggaatttgcaatttctagtcaacttcttttctttacactcactaatatttgaatgaatttccaggttctgctttttctccttttggtctaagatttaccatgtttttatgatgatatatatctatatctagctagctaaataatttcattcattattatggactttgccagcaaaaactaaacttacactctgagatacatcatactgatatatatacacctccataaagccaaaattatgaaatttaaaaaaatgctcaatgtttttgtcgtgtgtataattgtttagtttaattttttgcttttgagtatggaaatgtttaataaggagctgggatttggcgatggctgtgaggcacgttctttttttatttttaatttttttaaaattttacgttaagtaccacggtacacgtgcagaatgtgcaggtttgttacgtgggtatacatgtgccatggtggtttgctgcacttatcaacccgtcatctaggttttaagccctgcatgcattaggtatttgtcctaatgatctcctttcccttgcgccccaccccccaacaggcaccagtgtgtgattttcccctccctgtgtccatgtgttctcattgttcagctcccacttatgagtgagaacatgcagtgtttggttttctgttcttgtgttagtttgctgagaatgatggcttccagcttcatcaatgtccctgccaagaacatgatctcattcttttttatggccacttcgtattccatggtgtgtatatgctacattttcgttatccagtctatcattgatgggcatttgggttggttccaaatctttctaatccattctaatcagtgttctttaactatgtaaagtgattaaggaatagaatgatggtatttctaagaatagtctttggtcacataatatatattttttagacaatactactacctcttttctatgtattaaaatgttagtcctataaacaccaggaaagcattgattaaattaattaccttctaaacctattacatggatactagaggaaaagagaagagaaacttcagtcagtacaaaagcatagatgtcaacttttgtctttttacatccaattttatttcaatatttcacaagtattcactaaattctaaaagttgcaactattacgtaaaatgggacctaatgatatttcaactgcatttactgttatttactttccaactgcattttctgcaatatagtttaactgaaatctctttgattataagcatgcattccacctttctacctcagtgtctttgttcatgccttttaacttttttctaacagcctctaagcctacatattgctttagaattctatctcttattaagccctattcaggtgtcgtttcctccattaaccattcactcaatctctcccactggaaaacactattccctcctgtgtactcatagaacactttttagtagcttcttgtaatcattataccagtatgtaatgtattacattcatttgtgttctgttttcatttctaagtcagactgtatgctttgtcaagttagttcagttttatttgatttttttgttgcagagacatttgaattgaacttatttcataatctttctttaatttggaattccctctccctctggatatccaaactttatccttttttcaaactccaattcaaacctttcctattctgaaagtctttacctcaatttcacacatagaatgttctataaatatcaatgaagccaaggtgattgaatgtattattcaagctttttatttctttactgattatctgtctactttttctatcaactaatgagagagggtgttgaaatgtttggctatgccataagacaaaattacaacatcttagtctaaaaatcttaattgctttatttgcaattctagaattgggcaagacttcattccatcaaatagaaaaagtgtcccaatgagctgggcagaagaggctggttttatagatagaaaagaactaaagaaagaagtaacaaaaaataaaaagcagattggtcatttcaaagttactttgtgaagcaggaacagttgaaaaataactggtagcatcaggtcacttgaggttacattttgttgtcagaattaaagcagaggaaacatcattatcatgctgattgaaactggcctgtttgggaaattaggctgttaacctcttactcctgctttctaggaaggtcaagtaacaactcagtttgggtttggtgacatggaaactcagcatgagtggctccattttgatttttagtctggtccgttgaggcctagtgcagtagcttagttcaaaacaatgacttcctacaatttttatttaaaggctataattgtctgtttgccttttcctactttcagttctatcagttttggcttcatttatttccatacttttttattgtatagatacatacatgcttaggatcattatttcctcttgattagttgacctctttattgttaagaaatgaccttggccgggcatggtggctcacgctgtaatcccagcactttgggaggcctaggtggctggatcacctgaggtcaggagttcgagaccagcctggccaacgtggtaaaacaccgtctctactaaaaatacaaaaattagccgggcatgatggtaagcacctgtaatcccagctacttggaaggatgaggcaggagaattgcttgaacctgggaggcagaggttacagtgaacaaagatcatgccactgcattccagcctgggcgactttatttttggttatattatctcctttgaaatcttttttgtcagatattaatatagccactccatctttctttggattattgtaaacatgttataaatcttactccattgtttttctttttatctatttgtgtatttacatttacgtattacgtatttatatttaaagtatgtttcttataggctgcaaagagttgggtcttgcttttttattcaatctgacagactctgcatattaaatctctagattttaaataatgtatttagctctttcacctttaatgtaatcattgttattgttgcattaaggtctatcatcttgccatacactttccatttcttctgcttttagtttctttaaaattttgtctagtgtgctttatattaaaagagcattttttataataaaatttgctttgttatttgttaattataactggtctttgcattattttgatggttcctttatggcttataatgtatatttttaactaattaaagttgtcctcctgtgatattattttacttcactcttcaaggtaataagctgtaaacaggtcagtatttatgtatgtatacacatacatatatacacatacatatatatacacatgtacatgtatatgtatatgtatatgtatatatatgtacatatatatgaagtgggatatatcagaggagggcaactgtgtgtgtgtgtgtatgtgtgtgtgtatatatatatatatatatatatatatatatatgctctacagtggtatacttctgtttctctatttctgacctttatgccacagttgtcatacattttatgctacatgttataaatcccaaaatatattgttataatttttgcatttaaaagtcagttatttttatttttatttttattttattttattttatttttttgagacagagttttgctctgttgcccaggctggagtgcaatggtgtgatctcggctcactgcaatctccacctcccgagttcaagcgattctcctgcctcagcctccccagtagctgggattacaggtgtgggccaccatgcccagctaatttttctattattagtagagatgggggtttcaccgttatggccaggctggtctcaaactcctgacctcaggtgatccacaagcgtcggcctcccaaagtgctgggattacaggcatgagccactgcacccggcctaaaagtgagttatttttaaacaaatttaaatatagtgtttaaatgtttatatatttacccaggtgactaccaattccagtgttcatcatttctttgtgtagatacagatttccacctagtctcactttttcttctgcttgaagaacatcctttaaattaccttgtactccaggtgtgcaagtagtatattcttccagctctaatgtgtctttattgcactttaatcttttaaatattttattattttctgggcaaaaagttttaggttgacatttcttattctatactgtaaagatgtttactaccttctggtttgcatttttttcaataagaatatgccatcattcttaacttttttcctctgtatacaacgcatcttttctctgtagatgcttttaataatttctctttatgattaattttaatgaatttcattgtgatatgccttggtatagttttcttcatatgtcttacgcttcagtttattgaatttcttgactatctaggttaagtgtttttaacaaatttggaaattttttattattatttcaaatattttttgttgtccactttctcagggattataaatatgggtagattgggctacttgaagttgtccccaaactcactaatatgctgttcaattttttttttaaaagcatgcatttctttgtatgttccatttcagatagttctgctatgcctcaacttcattcttcaaggtagcaagctgtaacaatgctaggactgacgtgtttatttttcatcattcagggatcaatgtccttcatcagtcaatgtccaatgtcctaaaaacttctattttatatattttgtctatatttttagtcatttcatgtgggaggataaatctcatttctgctgcttcatcacgttggaattgtaaacttttaaataaaataaattgtatatttattaaccattttatatgtctctttttggattgtccatttatccattatatatgcttagtttattttgacttctggtatatatgaacatatatatttgtttccttgttgacatactaaaattttgctatattaaagatagcagtctctgttcacacttgtttgaaatatttcctcagctgcttgaattttgttaaaatttgcatatgatgaggcaaaaaactgaagttctaaaacttggcaaactcttctcaaatgctttcttgggtaatttcttccagtgattttattatttagatgtcctgtttctatcaaaaggctaaatgagtatttattatgttttctctttatttatctgagtttaatagagatgagagagatgcatagcacttgtgaggtatggtgagaatttacttatatagtttcaaatagctagccagtttcctagctccgttggttgactaaatcaacatcattaacagtgataccaactaagaattaagttctcattcatttcagggtttatttctgttgaattctgtctttctgttcttatgctaatcttacagtcttttaattataacatgcttcattataactcattttaatatttttaaaagaattttcactctttacttctctctttgaaaatattcttggctcacctgttctattatctttgtttttttcaaattctcccaaaatatgcaactggaattttttaattaaaatttgtttcaacagttataataatttaagaagaattaaaatagtcacaagatgtagctttcatctgagtcagacaatatgcacagtacatttcttttatttctttttttatatatcctagtagaattttatagctttcttaaaatatgccaaatctctctcctgctgcttttatttctaactattgcttattatttgtgtgttttaatttttattgtaaattgtgtcattttctcagtgttattttctaactagcttgttgggataatggaaaggttatgataatagcatatgtagcttttagctggccactgtttattacttattaattatggatatgacttgattgaagacattaagcaactttagtttgaataattatcctcaggacctaacctcatttaatatataataattttaattttttttaagaattatgtgtaagtgctaaatataaaacaaaactcctagaagcaaaattttatggacatagcttctttaaaaacattaatcacagccgggagcagtggctcatgcgtgtaatcccagcactttgggaggccaaggtgggtggatcacctgaggtcaggagttcgagaacagcctggccaacatggtgaaaccccgtctctgctaaaaaagtacaaaaattggctgggtgtggtggcgagtgtctgtaatcccagctactcaggaggctgaagcaggagaatcgcttgaacccagtaggtggagtttgcagtgagcccaattcccaccactgcactccagcctgggcaacaagagaaaaattctgtctcaaaaaaaaaaaaaaaaaaaattatcacaagaactgaaattaagtttagttgtcttataaacatttttttttagaacagatatcactgtgattaccaggccaaaaaaagattaattcatccaacaaacattattgaatgtacactatgtgcccagcactttttttgaagtgttggaaatacagtggtcaaagagtagaagaaaagtctttctttactgaatttagttcagtaaggagagctatatggaaaacatgtaaactaaacataattggtgaaatacataaaatgtcagatggtgagagtttgattccaaaaagtaaagaagagaaataaataaggatgccaggattagagtgaatgtggccaatttagattggaggtaaggaaaggtatcactaggagatcatgtttgaactaagagaaggcaatgtaaggagataagaactatggatatctggggaaaataaaacaaacttaaaaatgtaaatgaatatgaaagcttcttaaaactttacttagggaggtaattatttgttatgtaaagttttgtatcttttcaattgagggagggcctctcagtgtttgagtccagcttgagtcacttctaaggtttaaagcttcagtatacattatctgcagaattaagatcctgcctccttgaggcaggattaagattctgcttcaaggcaggattataggtattgtgataaaatgtgagtgattatgttaagcgaattaatagttttaatgcaaaataatagagtgtaataaaatttatcttgtatttataaaattctttatttccaattaattcattgtgtaccacaagtgaaatggttcagaaagaattacacaagtttaaattcgcacagatcacttctttctttctttctttctttctttattttgagacggagtcttactcagtcgcccaggctggagtgcagtggcgcgatttcagctcactgcaacctctgcctcctgggttcaagcaattctcctgcctcagcctcctgagtagctgggattagccaccacacctgactaatttttgtatttttagtagagatagggtttcaccatgctggtcaggctggtctccaactccttaccttgtgatccgctggcctcggcctcccaaagtgctgggattacaggcttgagccaccatgtccggcccaaataacctcttgtaaaatcccagtctgtcagtgtatcccttttactatattcataaagtcatttaaagatgatctgaaaacctggggccacagcaaacataaattttgagtaaatggcattgcagatcccacctctgcttctccaagtccttctatctattgaatttagtttcctacatcatgagtatatttcttttaagaaggaaaattctaaggaaacattcctatattttaggcttactaaattaaatttaaaaataacataaacttgttaaacttttgtaagtaatgctaaaatgcttggcaaatgggaatgacaaaacaattttaatgaatagcaaaatccgatcacgggaagaccaataaaatgcacaatgaaaacagagcagcctacactgatgatggaagtttttgatctttattaaatcaaaagtagcctctaatttactacagacgatatggtgattcccattttttaatctacctgatgatatgcattgttttgaaagttgaaagcgttcttatatctacctagaacttatatcttatttttgccctcctctgaagtaaattttccaaaaactcttttgtgatatactattgcattctgtaaatacatataaaacaggtgagaggaaggcgagccattaaaatttaacttattttcatctggggctggtggggcacacctgtaatcccagttctttgggaggccaaggcgagtggatcacttgagcctaggagttcaagaccagcctgggcagccatggcaaaacctatctgtacaaataaatacaaaaattagctgggcacggtggcacgcacctgtggtcccagctactcaggaggcggaagtgggaggtctgcttaagcctgggaggcagcggttgcgatgagcagagattgtgccatgtacttcagcctgggtgacagagtgagaccatgtctaaaataaataaaattattctaatttttgccagtgtcgatttttgtttaaaaatcaattaaagaagcatttgtggttcaattttaaatgctataaatagaattttattcaacagcttttattatcataaagacttagaaaatatttggcttcattaaatgccaaattttcatatttacaaaaatagtaaaatataactccttgtatagcagcaataatttacattcctggttttactgaagaatcacatggggagatccatcaggtgcccattctccacagattgtgattgaatgtgggtcggggagagcactggcactttttttttttaaagcttcactcatctagggaacatcggctgggactaagaagatgtttccggtaggcacctttattatacaattatgcagtaataacttgttgtatataatgtagatcagcagcatagaggtcccctgagagtttattaaaaatgcacaatcttaggtcccaccccaggtctactgaatttgaatctgtatgctgacaacactctcaagtgatttgaattaagttagaagttaagaagcattgttgtgggatctacccctcctttggaaggcactattcctgattcctagagataatcaggctatgagagacatgtgaaactgagataaataaaataaaacaaaccaacaaaaacatataatgtcatcttatatatattatttaaatgtaacataagcttttatggactggaatattcattattctatcaatgttttcaggttatataaacaaacatcataatcagctgaaagtttgcttggccatcatggtattgttaatagaaccagaaaagttgcatgcatcagctaagatgtgtgatgcattcctcactatgggaagagtcttgcctacgggaaatacttgaaatctcttggctgcaacacccttcgcccatctttatgacagagaactaggaacaatatactggaaatgctccctctagggacaacactttcaagagctgtttccacttttgctttatgatacaggttcaacgtacctaatctgaaaatccgaaatttgaaatgctccaaatccaaaatgttttgagcaccgacatcataatgccacgcatggaaaattctacacctgaccctatgtgatgggtcacagtcaaaaatgccattaaaactgtttcatgaacaaaattactaaaaatattctatacaattactgtcaggctgtgtgtataaggtatattaaagcatatatgaatttcatgtttagacttaagttttcatccctgagataacacattatgtgtaggtaaatatccctaaattttaaaagaatccaaaaatcggaaacttctgaccccaagcatttcagataagggatattcagcctttagctatttactttcttgctttgcatagcttaccccaccttcttatttttctttcttaggtaggttaatacatttacctacctaagggaaaatttaaaatgggctacttccagattttgctggcctaagactgtctctctcaatgagaatgagcaaaggcactttgaagtagcttatatctatataggataattttctttccttcagttactaatcgttaaagctttgctcaagcttctgagtactatctaaatattccagtaccagaacaatatatgctatctcagtccattcagtaatgaatgactgcattttgaacttttatgtaccaatttttaaatgatgctccaaatacacataaatgaaattctttatttcttacttcaagagtttagtgacaatgacaataaaactataacctggaccacacttgagtcatctgaaaatctttcaaaagtagacttcatcatgaacaaactgcatcagaatttctgagattgaggcctgaatgttaatattttttaatacctcccaagatgttctgatttccagtagcataaagaacattactgagagtagggctgaaaattaatttctaaaacagatagctcagtaggtcatttttttttttcagcattactgtaattattaaaatctcctctggaacttttctagtcagatcttggtctacaaaagaaaactggacatcttggcttattaaaaaacatttcaagagggtattcaaaattaaacttaaacaataatttaactcatctatctgggaacattattcattatatcccattgctttccaaaacttagttgtgtggaatatagagaagacaattttctcctttactcttcatgagtttttagctaagattccctgcaacaaaaggcagattaacaggagaaaaacaagccgggcgcggtggctcacgcctgtaatcccagcactttgggaggccgaggcgggtagatcacgaggtcaggagatcgagaccatcctggctaacacggtgaaacccgtctctactaaaaatacaaaaaaaattagccgggctggtggcgggcgcctgtggtcccagctgctcgggaggctgaggcaggagaatggcgtgaacccggggggcggagcttgcagtgagcccagggggcggagtttgcagtgaacccagggggcggagcttgaagtgagccgagatcgcaccactgcactccagcctggaccacagagcaagactctgtctaaaaaaaaaaaagcaagagaaaaacaaacagaagcttaataacataaatacctcctttgtacatgggatagaaacaagaaaaatgggcagatctctagagtagatctcaaagaattgtcttatacctcagatgcaaacactaccattctctgaaacaaaggcataaggatgtaggaaaggttttgttaagaaagatgaccaggaaaagcaaaacacaagcaaagtttgtcacgcatagtgaagtcgatttcttctccattgattgagtcttcggttatgtagttattcttctcttcctggtgcggaaagagagggagagaaagagagagagagagacccttgaaaacatctatacatttcctttatagacataaatttatcttacacaagggaaacttccagccttgtttctagtattcttcctgtgtctgcagtttctcaaaatatctagctccaaataatcctaagccagagaggcatatttagggtgaaatagtctgagtgcagccttattttggggtgacatgttctgaactctataagaaattaaaacaatctaaatttttggtgagatattttcaaaatttcattatttcttaattctacataatcatcattatttcagtattttattaaattagtggaaaattacatgtgatttaataagtgctttatttccctaacctcaaattatttggggcaatttccagatgtatagtatgaaatcatggagcaatatttgacatttggtgatgtaattaattttatattttacttaaggcttattaaaacagctgttatataacaatttaaacaaatgttcaaaaatcttaattgtacaaaatgattttggcttttttcccccaagcctgagacattctgatatgatgtacagtaccaaacattgatcaaaagctaaaaatgtctccaggcatagttgttatatataaatttgtgtgtgtgtatgtgtgtgtgtgtgtgtgagatatatatatatatatatatatatttttcccccccagggttatggtggctatattgcatcaatgatcttaaaatcagatgaaaagctttttaaatgtggatccgtggttgcacctatcacagacttgaaattgtatggtgagtactttctacagactgacctagtataatgtattgatttgtagaaaacgaaagcccaatttagaatagctcaattgagctcatttatcatatgttattagagcctgttttcagctgtttatctcctccttgattcagctgattttactaaagcatgacaattaaatgtaaaatgaagaaattaatgaaatatgccagtcaaatagtttttagtttcttctcgaatgtctgttttcttgggtcacagcctcagctttctctgaaagataccttgggatgccatctaaggaagaaagcacttaccaggtaactaatttgaaaataacaaagaaagaggagtatttttgttctaaaaaattagttaaatggcttatttagatctatagatacagatatttgtattttcctttataggcagccagtgtgctacataatgttcatggcttgaaagaagaaaatatattaataattcatggaactgctgacagtaagtattatacttgccgctgctgtttgatagggtatgaccttttacaaagggatacatctaaggacttgcttacaggaagccctgtaaaccttctgaagaagggagcagagagtcacacaaagaatcagatacatgatagaaggtgggaaaaaagaattcagagataagaggagaggaggctattcctcaaatggcagcgttgtccaatcaaactccctgtaatgatggaaatactttatcaatgttgctgaaaaagtagccactggccacttgtggccataccttgtttagtgtgactgaggaactgaattgattttatttaattttaatttaaaaaggcacttgtgtctagtgactatggttacagtgttattcagcacacctaaaatggaaaccaacctggaaaacagaaaccaaaaagctgcaagcactgacatgaaattctaatgaggttacccgcttaaatgaacttaaaaactttaaaaaggcactttcatatcatctctcattttttcatcactttaaaccttggaggtggatgtgattgatgttagtagtaataaataatatcattttatatttacatgacactcttagggaccaaagaatctatattttattatcctctgtgatattttacaacagacagctgaatatttatagcttcattcatggatgagaaaaatcaatttcaaaaaggaaacagatttatccaaggccatctggcaagtgagacaagaaagtcaaagtcttgaatcaatatttcctaaatcttgaacttaacttcttcctctttagggtgggttccactgaatgatttgcttcaagggtactatatggaaaaagagagaaagaggaactttacagtggagaaatttgacaaacatcacatcaacagtgacaagtcatgttattactgttattaaatgcccttgatatgatgtagtggggatggcactttacctccatggtttagtactccaagcccatacataacaccagtctaaccatgagaaaaccatcaggcagatccaaatgaggaaaattctatcagatatccagccagcacccctcagaactgttggggtaatcaaaaaaaaaaaaagtctaagaaactctcatagaccagaggaagtttaaaagacatgatgtctaaatataatgtgggattctgaatggaaccctggaacagaaagggtacacaggaaaacaacaataagaacaccaacaagaaaaactagtgcaccccaaataaagtgggtttagttagtggtagtatatgagtcttagtttctatttgtgacaaagtatataataatataagatgttaacaatggggaaactggaggacgggtatccaggaactctgtactatctctgcaactgttctgaaaatgtaaagcaattatagtattaatagtctattaaagaaagaggtagatgatacagtaccagtgttgggtgaaacatgatgaaagagagcgtaaaaattttgagggacatttggatgttgttctaaggtattaagaccttacatatatatcaacagtaataaaaataaatagcaattatgtactcattgtatgtcagaaaatgtgctaaaagcatttaatattatcttatttgtacttcttgcaaacacggaatagtagatgttattactttcatttaacagattgggaaaataaatattaggaaatgatataacttccttaaaagagtagacacaattgattagtaggaaggagatttgaatccatgtattgagccttttattcactgtgccctgaagccttattcatatgaataaattatattcaaggttaaattattgtatgtctacccatcatgctggactaatatattagtgctatttcaaatttctctgtcaatatgttgtagctataaaggtaaatcattgttctatctgactcactcagtcacaggcctggcgcttcacccatctaataaaatacaagcagaggttcagccctggtccctggagaggaaatgcacctgtgaatgtgtgtgagcacacacacacataggcacacacacacaggcacacacatacacataccacacaacccatacgggcctggtgaattataggtgctcagtcatgacactgtaacaccactactattaatattatcttcaaaaattaccagcaaatgaattcaatcacccagtcaaacctgtaatgttcccttttagctatagtaaacagacaaatagcaacaaatatcaatggactttgcattagaaactaagcagaaaaaaaatccaattggaaaaatccttttgcacatttattttcagctgtctccatgcagacaaataagggatcacattacctctgtcattgaccttattaattagcatttctagaagcttacatttatagagcagtttgtacttatgtagcaatgacaaggtcattttcccattaagtgccataggaagatgttgaaaaagatcttgactatctagttttttaataggtttaaatgattgtttgccattttacattctctgctgtgtggtctgattattcagcattctagagttagagcattaaagaggcttaaactattgataaggctgccctaattttgcaacgacaattaaaaatgttagcttaggctgggcgcggtggctcacacctgtagtcccagcactttgggagaccgaggcaggcagctcacgaggtcaggagtttgagaccagcctgaccaacatggtgaaaccccgtctctactagaaatacaaaaattagctgggcatggtggtgcacgcctataatcccagctactcaggaggctgaggcaggagaactgtttgaacctgggaggcagaggttgcagtgagccgagatcgtaccactgcactccagcctgggcaacagagcaagactccatctcaaaaaaaaaaaaaaaaaaggcagcttaaacatgagttacagaaatctgaagatacacaaactacaggaatgaacaccctagacagaatgtgagccaacttctgcagaaagagatttgagtgactgcaccaaatcttcatagctaccaaacccatggctattgggctgcttacttcagaatcttggatcttaggttctggcagaaggaagataaagcaagagtaaccagtatgctctatattaaatagttagtccttgtataatgagatgtgtattctattttctcagtatggggtattcttttctaattttgaataataaagcagaatgccagtatccaactgagactgtgccctagtaatcttcaaaatgaaatagatagctggtttcctgtattaatatccagaaaagacatttgccatattaaaattttttataaattttataaaatttataaaaatatgtgtaccattaggaataataaatactatccagtaaagtaaatataaacaccattctgtagagtaagtaggacttagttgtagctactgttttgcttttttgtttaatagagtgaagctcaaagttttaccattgtatttgtatttaccagctttctacctaaagccagatataaggttttttggttttttttttttttttttttttgagacggagtcttgctctgtcgcccaggctggactgtagtggcacgatctctgctcactgcaagctccccactcccgggttcacgccattctcctgcctcagcctctcgagtagctgggactacaggtgcccgccaccacaccggctaattttttatattttttaatggagatgggatttcaccgagttagccaggatggtctcgatctcctgaccttgtgatcggcccacctcggcctcccaaagtgctgagattacaggcgtgagccaccgtgcccagccagatataagtcttttaaatgtgcaatgtatgtaaaataaaacactgaatctctttgaaaaataatatgaaaaagttctcatacaagcagtgtgtttcttcagatatcataatttgatttcttgcagcaaaagttcatttccaacactcagcagaattaatcaagcacctaataaaagctggagtgaattatactatgcaggtaagctactttcttagaagaacgtgttttcctgctgtgttttttcacttgtgagatacgcaacacagcttctctattattccattctccctactattattttttaatatgttttttagttaccaaagattgtgttctctgttcctgattacaccgagaatgtggatgaactcatgctttacaagtgaattgcatgaatcctttctaaattgtcattttcctctcagacttattcatatcccaaatattgaattcttttaaaagtaacaagtttctacttcccttcttgttccttttatcttttcttccttttgttgttcctttcttccttttcttgttccttttgtcttgttcctttgtctttattattaaatatgagagtttattattaatttatttttaaatatgataatttataattctcataataaatagtggataaaaaatgtttggggaaatattacaagaaaagaagagaggataaaaggccatttgcactaccatttatgtctgtgcattcatacatttaatatatatttatcaaggacattacagtggtcactctgctctatgagtaacaagacatacattacactgtcaaggaggttccagtctgatataagagtcatagaaggaaaaagtaaagtcatttaaatttctcagcattcagaagaaccaaaagttgctcaacctgtctaaaacacaaactaccacgtttaggataatgaaatatgaagctatacagataaacaaatgtcaggtcattccataagcaatgttgaggagtatggagttttattcaaagggcaatgaggcgccatttaaacctttgtactcaggaattaatgggataatatttgtattttttatttgtattttagaaacagtaacaattttgtttacattggaaagggaattgtcaaagtaaataattgcaccagacaatgttaaagaggcaaggaagaccttatgaaaaactactgcaaaggagacaaagactgaactcaatgctctttaaataaagagctggaaagttttctaaactaaatactcctaaaaaggggaggagaggccaagggcctttagtcaaaaagaaactgtccaaagtttagtcaagctgagggcaaggttagtccatctcagtcaacataaacatgaaaaagtctaccttttatggccaacatattctaatttaaataccaaatattaattgacatgattacaattgttttaaaagtttagcatgaataacttagagtagaattaggtttgattttggtcagatattattactcaaagtttccatgacgttagggctcagaaaatgaatgcgagagacaatagcttcttggataatttgaaatcttctttctcctcaatatcttaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa

SEQ ID NO: 1004 - DNA, 95627 bp, Homo sapiens
acagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaacatccaaagcatatgaagaatctattctcctctgtatttgccacacagaaccctacctgagcaggcacccccaatttgctcaatattttgttgacttcagagaaacaaagaatggttttagaaaaagctaaggaaaaggctgatcttattcacactgactctcccagtaatccagtaagggcagctgctcagattgcagttcccacctctgacctgggatggaatataaacactggagatagatctaaccttgaacactatcaaaactgcattttgatcagcctctgcaagggagtgcccaagcaaaggagtctcagtaaggtccaggatggtcaagcagaagcctaatgagggttgctttggaattcttagaacaagtctttgaagctttcagagaataaatggatattgacccagaagccccagaaaatttgatgatagctaacatgatgtttatccaacaaagtgccccagatattcagagaaagttacaaaacgtagctgaggcattggacatgtttttgtctcaattagtgaagattgtttttaatgtatttactgatcacaagtttaaagagtggaaaataaaacacaaggaataatgaaaatggcaagctgacttgttatctgtggctctgaccctagtagtccctggaccacaacaagggccgtcatcagacactccatctatggtagaaccacctgggcccccaaaggccaataaaaacggacatcccattgcaggtcccaaccagtgtgcttactgcaacaggggggacactgagtggaaaatttctcatgccctacaaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttggattgtcagctagagtaagatcatttaaagcacagttttttgctgggcgcggtggctcactcctgtaatgccagcaccttgggaggctgagatgggcagatcacaaggtcaggagatcgagaccatcctggctaacacagtgaaaccccgtctctgctaaaaatacaaaaaattagtcgggcatggtggtgggcacctgtagtcccagctactcgggaggctgaggcagaagaacggcgtgaatcggggaggcagagcttgcaagtgagccaagatcatgccactgcactccagcctgggggacagagcaagactctgtcaaaaaaaaaaaaaaaaaaaaaaagacagagtttttctatacatccttgaatgtcctatccctttgttggggaaagtcttccttttttgttgttgttttgttttgttttgttttgagacagagtcttgccctatcgcccaggctggactgtggtggcacgattgtggctcactgcaacctctggctcactgaaacctccacctcacgagctaaagcaattttcctgtctcagcctcccgagtagctgggattacaggcgtgtgccaccacagccagctaatttttatatttttagtagagacagggtttcaccatgtttgcctggctcgtcttaaactcctgacatgaggtaatctgccctccttggcctcccaaagtgctgggagctgggattacaggtgtgagccactgctcccgtcctgttagggcagtactcttaaccaaactaaatgctaagattactttttctctgagatgattggacatccaggtgccttcagaccaagcatgtgctctgcaggccatattattacaactggagatccttgaaagtgcctgcacccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccaggtatgtttttattgttgtccatgctcatggggccgtttggaaagaaagcgggctcttaacctttgatgattaaaaaagaaaaacaattaagcatgctaaagaaatcttagcctgactaaaggcagtcttggtacccaagaaagtagctataatacactaccatggacatcagtggatggacaatttggtagcaagaaaaaaaaaatcactaggcagagcaggccactaaagaggtgaacagagaaaaaaatgcccaaagccttcctaatgccattaatccctgaaataaacttcagcctaaaatccctacctaatggaagaagatgtaaagagagaattcgattgagactttgactccaatcaaagaactcaaaatgagtggatatgtgacacggaagaaaaggttctggtgcccaagtatcttgtgacagatatcatcaaacacatacatgataccacacagtatggcaggcatgccacccttcaattgatccaggactatgtctttgggacacacttaaagaagactatccaaaaaataatttaaaaatacctacttggtgcccagaacaatcttaagactggtcctccacccccagtaccaaggattcaagcaagaggtgcagggctattagaggactggcaaattgattttaccgtgatgccaagggtagcaggaaattttaaatacttgcttgtatttttagatacattttcaagataaacaaaatcattccgctgcaagaccaagagaatgtctgagctaatgagagccttggtagagaagattaccctcaggtttaggtggcctgtctccatccagtgtgaccatagtgcaatttctgtagcctaggacaccatatattccaggccctcagcataatctggaatcttcatacagcctgcagactgaagtctactgaaaaaactcaaaagataaatcatactatataaaacaaaacaaattttagctaagatttgccaagaaactaacaacctggaataacattctgtccattgccctgctcagagtaagggtggtccctaaaagtgggcttaaattaagccctttaaaaattttacatgggagatcattcttccgttaccttctcagactaaggaatgccaataacatacacataaataaattagatattatcaaacatacacaatctttaggttgtactttaactactattcacgagtttgtggttccagcagattgtggtatccaactgacattctctttcatcccatccaacccagagactgggttctgctcaagaccaggaaaagtcgacatcctggggaccacttaaaacacagtgaaagaggccatgcaaagcatgactggtgacccattcctctgttcagcttgaaggacttagaccctggattcaccacagccatataaaacccgccccgccagattcttgtcctatcaagaaatgtagagaggccacttcaacttcagagactgtctcaaccctatctgaatggataagtaaatctttgatgggcctcaaatatcttttgaggaaaaatatcagataagtaactttaatgaaattagacaaaacatatgtcttcttgacaactacaatagttactttgagcataacaggaatgtttgttattataattattttatataaaaaggtgagataccttcctgtctattccctgccttactgaatgcttaagccatatatttacttggtcattataattgcctagataattacaattgctacccttatagacattacttcataattgccttggtcaatacaattgttagacttatagattttctagacattctatgccatgctaacatagtctcatgccactcattatgtggacattctaaaatttagaaatggtcactcttgttttaaaacttctaattatacctctcctgttactacagtgcctagacaggcatagcaacactgtagttcaactgtttcaaggtattgccactggaagaaacttaccagaatgatggatctgtcagtaactcccccaaactattcaaaataagcattttctgttagtcatacttgtcactgactttctggatgttccaaatatgactacctatctgcaccagcttctttccatggctactttccaggtccaagtaatagtacaccaagaaatcaccaccccatgtgtcaatctctctctgcctatcataaatggaaagtcattccattacataggccctccatggcccatggcatactgggcagacaaacgcagctaggagaagggaaataaaactaaaagtttctccttactatgccaaaaatatttacagtggggaatatcacacaaattctggggagcctgtaaaaaaagatccctagttcaattccatttgtctatattccccatgaaaaaatccatcaataaatgcacccttgagggctttacctgtgtgcccccttggtacatgtttatttgtggcataggatcagaccctcctctgttagggcaagcccactggtgtctcaataacctgtatattaagggctctcacttactgagatacttctcagtccatcctaatgacaaaatattctgcccattttcccaccgactccaaaagggactgccaggcatatatcaatatatctggtggcagagccttctaggcatcacgagtcctagctatggagtatacactcactgggacatgatcagaaacttattggcaaccacagaaataattgcaaaagaggctgctaagaacattgaggctgagaaaactcttcaaatttacttgcccagatagttcttgacaacggaactacacttgattttctcttggctttacagagaggagtctgtacagtgatcaataccacctgttgtacttatatcaatgcttctggtaaaataaaaaccaaactaaagaaaatatttcagcagtctcgctggagaccatatgtctctaccacagaccctatgtctgaatagttttttgagctttccgcctgcatactccatgttttccagtccatttttcaaggactcttgaagttcaagctcacaattctgtttatagggattataatttacatgattcaattaaatattacaataaaaccatagactgaagtactaacatgttcatccagcaccctaagctgggtataacagcttgcaggttgttacaagacggtttcattcctctaatcctgactctctctctgtgccccgtgtcagcaaaaagaagctagaatggccattgcccgattcataccatattagcttttacacctcagaattgagaagggatcaagcccggaaggaactgaaactgtccctaggaaagttatataaaattgattaagggggaaaaattcaactatgatttcaggaaaatcagcagtaatcactaaatcagctttccatttgtccaacttctctgtagctggtcattgattactaccctaggataaagaagcccttgtcacaagacattttggtccttttcctttctatagataaaatctaagacattgtgagatgataatctttctgcatgagtttctcctttaggttctgcatatgaaaaaaaaacctagcaacatactggtcaacaaggcaaaacctcattttcacaaaaaattaaaaaattagccgggcattatggcacaggtctgtagtaccagctgctcaggagatctgaggtgggaggaccacttgagcctgggaggcagaagttgcagtgagctgtgatcacgctactgaaatccagatgggcaacagagcaagatcatcttgctcaaaaacaaaacacacacacacacacaaacatacacacacagacacacagacacacacatcagctggtctaaagagcccagcaaaaagctgactcaggaaataatgcaggttccacatcctggtgacttcatcccccttaccctgaccaattgacaacccaaattttctagcccgtcaccctccatgatccccttaaggtctcttgcacatagccccttctcagaacagatctggggcttgagaatcctcccaattccttgtttggtgcccttgtgttgattaaagcctttctttgctgcaaaccctactgtctcagcgtattggtctattgctaaacagtgggcatgtgaacctgatagtcttataacaaaatagaatagaagctatttataggatcgatccatgcatgtgagtctatttctggacaccgttttctcttctattcttccacgtgtttgtcctttaaccagtatcatgagatcctttactcactgtagctttttttaagtcttaaaatttggtaatgtgagtttttcaacttctcttatcttttgaagaattgtttagctgttttagcccctttacctttccatatgactttagaatcagcatgttcgtatgtgcaaaacattgtgcttggttattcactagaactgggacacattcacagatgaatctggggagaactgatatgtaatagtattaaatttttcaatccatgaatattatatatcctttgatttagtaagatcatacagtcttaccctagttttttttattttaagcatacagatcctgtattttactagatttataactaaatattttgtatttcatccatcaacgaaaaattcaatttgtttaatagacagaatttattaatgctacctaatccttcttgagagagccatgatagtttgtggcttcagtaattttttaattcattcaagttcttgaatttattgacatggcattattcagaatattttttatttttcttttaatatatgtaaaaaccataatgatgtcatttctgtcattgctgttataagcaatttgtgttattttttctgatttagtctgtctaaaggtttctcaattatagagatctaaaataacaagcttttggtttccttgtttatatacatatttacttctttattatttcatctctgatctttattgtagtatttcttctgcttactttgagattaattttttctacttttactaatatctaatggtagaggctaaggttattgaagtggaacaccgtcattttctatcccaggtatttagtgacaccaatttatttcatactgctctagtgccattccacaacttttgatatatagtatatcaatcagtgtttggctggagtagggtgagtattccataaaagatttactgtgatttttggagggaggtgtgaagagggtattattaccaaaatgtggatttttttttaactccattctgtattttggctaagagaagcagctttggaacttctcaagtctgtacatctgtgagaccccaaggattacttgttttaatttttttttaagtttaggtttgttttgggtcaacttagttctttcaaggcttatttttaagcttttaaaaagcttaaaaaaccccagagatagtttgttcagaatattaagctgcttctgatgtctctactacgtgacctagatgttcaaacgagtctttctactctgattgattccatttaaatgtctccctgtgttgtgtgtgtgctctgggaatcctttacctttttgttctctggtagtgttcttcatctgataggtatcctttgtccattcttggggagttttgctctactctccagagtgtcaatattcagccaaataatctagggagttgctgtggaaatttgtagagccctttcactccatagtttcttcttttctcactctgtttcctgcagattctagtgaactcatcttctttgggaacactgagttttgtttcttctactcagcaagtgtggcactttctgctgaattctccttctccatgctgctgtttggaaaatttctcccagcataaagtcactttgatgatggaactcatctcattgtcactttttctctggaattaggtgcttcctgctttccaatgtctgaaaatgttattttcatctattttgttccatttccttatttgtggcaagaactctgttttacttgattattcttgcctggtcttttacctttttaaattgtctgtactgattgttttctatttggtttcttctcatatttggatttgtttcaaaatttatactcatgctggattttgtctggtttctttgttataatttattataaataataatttattttcagtttttattcttttcttttatagctatataatgataaatttccctctgaggattgttcgagtgtcatctcaccaagtttaatttaatatgtttttattatcattcaattcaaaatatttaatgtttcctcttctgattttctccttatccatgagttatttaaaaatgaagctgagttctgggaagcaacctagtaaacgacagtaatttctttttttgggttattattattattattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacagcagtccccacagtgtgatgttccccttcctgtgtccacgtgttctcattgttcagttcccatctatgagtgagaacatgtggtgtttggttttttgtccttgcgatagtttactgagaatgatgatttccaatttcatccatgtccctacaaaggacatgaactcctcattttttatggctgcatagtattccatggtgtatatgtgccacattttcttaatccagtctatcattgttgaacatttgggttggttccaagtctttgctattgtgaataatgccgcaataaacatacatgtgcatgtaaccgacagtaatttctatcatcagttaacagaaacagtaacttccactctttcaagttaagttctacataatttgaggaatcatcattttggcctttcaagataaataaatctgttactgttcctcgtcttctttgaactccacatgtccatttactttgaagcacacaataagaatgacatttcaaattcttggagccaaaggctatgaaaattattttggcagattttctaagatcatcacaggatctcagatactccaattggctaaatgagatttggaattgccagaagatctacaataggcaagattaaaaagtcctaagaaataatactcattgtctattgagttctgacatgctgtagaattccaaatccattagacaaacagatttccaataatttcttagaaataattgtaagtgtcttaaatagagccttgttttaaaaagtgatgaagagtcttgatgtaatgtctttggcaactctgagcttattttccttgacttaagtatttgaatgcttatggttatccaggttttcagttacaaatgactcattattttttatatttacatattacttaaattcttataaaatgttattgatcatatgcttgtctttttcttattctcttcccttttagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattagtaagtaatttattatgtttgtattgattatccagatgatacacaaaagtttactaactttagtctttttgtgggggctgatataatttcatttgaaaagataagaaaaaaaaacctgcaggaacaaagcagacatcaattttttttccttttcacattaattactcagatattagtctgtctttccattcaggcttttcctactctaaagcattctgtgttacagaaacaagttagggagctttatgtgtattctggtttaaactgattttgctttagctgagacctttatgactgttaatatatatctgttttataagattagacttttacatcaaattctttactcctagatacaaaagcaatgtttttattgaagatatggatgcctagtgcataacatcaaaataatttaaactctataatttgtagatttgacactgtaggatatgtctaatactgaatatcttccctcttagaaatttttcataaatatttaggtagtagagagacaaaatattcctagatggtaccaatttctgctctgttgtatgatttccctaccacactatctagatatttatgaagatttccctaccacactatctagatatttatgaaaattttctgggaacaattggttcaatttgtcttattttttgcaaaaccactcagtaatatgtgtgtgtgtgtgtgtgtgtgtgtatacgtatatatgtatatatatatatatatatatatatatatatatagagagagagagagagagagagagagagagagagagagagagagagagagatggagtcttgctctgtcgtcggccaggctggagtgcagtggcatgatcttggctcactgcaacctccattttccgttttcaagcaattctcctacctcagcctcctgaatagctgggattacaggcaccctccatcatgcctgcctaattttcgtatttttaatagagacagggttttgccatgttagccaggctggtctcgaactcttaatctcaaatgatcctcctgcctctcagtaatatatttgaagtaatatttaatatactcatgttaagtgaagtgaataaggtattcatgtatactgttttcattttttaatgtctgtgcttaatatgaggtctagtttacaaaaaatgttagtcctcataaaaaagctaattttatactaaatttttattaattattcttttaagattttcttattattaaagagaaaatgtcttgtataacataggaatttatattttcagtctttttctcctttttacatatgtctcaactacgaattagtttggactcttaatttacaaaattctgttatgattttctttaaaaaataatgtatacctgtaatggcctgttttattactagcattgtcataaatgctttagtataaatgaattaagaaaaatgtttttaaaatatattttggggcttaagcaatgaaaaaaaatgttgtgtagaaagatatactttcacttttgacaactattttacgacaacaaattctcaccagtcatagattatttttgtacggtacctatttattagtagatctaatcaataaagctttttcttcttagaatgggaaatactcagattgtttattagatgacattagaaatgacattctaaattttttatgcactagaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatggtaagtactggtttttcagaaattcattttcaaaatgaaaataaatctgttttccaattttaaaaatttgaattatatagaggaattgttaaggaatgttgattaaaatcaagatatctcctgatttgacataaactgggaaaagaagggagttttgaaaatatctctaaagtagtgcattaaattaatacttcctatgggccacctaccttccagatttgtgattataatataattgcttttgttaccctaaataaaagctttcaaattatttagaacctagcacttattaccaaaattatagttggttacaacttcctcagctaatttgtttttttaatttctactttacatcttctatcttgtgtgttaatttctgtactttctgagtgtagttctttattttctaaatttgaaaagttctgaagaccattacatgaatctcatttacgtttctcaatcagccatctatttttcagggttagaagaaggattggctctgtgggaaaacaagtatatgcagagtgttccaaggcaaagaaaaatatgtgcaaagctgtaaaaacaaaacaatatatttcaaggtggtaaagcagagtctatcctgctgaggctagatgggaggcaaggaaacaattatccagatcagctcaaggcatcatatcatttggattcattttatgactaatgaaaacccataaaagagttttaagaaaaggaatggtataatttgatttctagttttgttggattgttttcctggatgctgtactttttgtaggcaagaggcgacaccatgagtccaggtagggtgagaaagtgtggggactgagagagagtgatgataggggaggtgcagagcagaaggctgatttggaaaacatttaggtgatgaaaagtacaggtgatgttactaaatgttgggtgtgaaaaagagtgagattaagggactcacatgtttgttttcaattgttttctcacaagtatgtaggtaaatggcaataaccattttgtaaaatggtactgactggatagaatgcattttgagagggctttgcaacttttgacttggacacattatgattgagtcgccaatggaaaatcaaaactggatatgtgaagtgtggagttggatatgcatctagagaggagatatgcatttcggaatatcatcatataaatgatgacgctaaattggataagaatacagaatgaaaagagcaaagagctcaagatgaagccctgaaacattaccacatttatatataagacagaagagcaatagatagtaaagaaaatggggaaaaaaggaggacccagagaaacaggagaaaaaatctagaatgttgccatagacataaaaataaggaaattattaatgaaaaggtagtgtaacagattgcttaataagtcatcctgtctgaattctaattccactgcttgctgggcatgtatctttggccaacacagcaagtctatttgaagctttgttgactctttcttgttggtaaaatgtcacatatttacaaacagttctaatatttcaaaggattgtgttagttagcagactaaaatatttataaatatttattgccatagtgccttatataataaagtcaaagaagttgtaatttaattaccttaatatcattatcaaagtgataaatatttctaatttagttattatattctgttcagaaattgtgatggattaggtaaggtacaggccaatgacaagtgtaacaaaaatggattttaatagagtagaagagacagaccctacatagaatctgccaataaaaataatgagctagacattcaatacagactgtagacataactctttcaagattctggctttgaatctaataggaagatcagaatattgcttgaggaaagttgtgcactgaagggataattaaaagaaaaaagatggaagacaccagagcagatacagcaaaaggggagctgcaaaggctgaacacatgacttacatagttgccctgagaaaatgcgaggggaaaggactcacagctactgtggaggtattgtgctttggtggcaacaggactgcttacaaccttgtgacaggtggcaacaggactgcttacaactttgtgacaggagatgggaaggaaaatgagcagtaacgttggaaaatggtagaagctgatggattctgttttgaagtatgagacatggtcatctgagattgaatagtgtgtgggcgaaggaggaggaagagtactaggtagaatagaaaagttttgaaatagtcacagctgagaaagagaatgagtacattgtagatgaaaggcagtgtcaaaggtccagttaaatttgactcattcctgctgttgtaaacacctatcataggacaggagaaaatggtgaaaacacaagcacaggtctacttatccagagattttattctaatataagacagtggaaaactaaaaagagataagccaaatatccaagtaataaaaatatttaaaatatattttatgtatcactgtgtacagagaaatagaaaatccaataattgagatagaaaataggagggaaggaactggagatctgttttacataggaagtcatcgatgcaaagaatggttgaaagccatttgttatagtgagaagggtatgtgcaacagctgaggcagcgaagaacttgacctttttaataaaattcaaagatcataaaatctgaatcctggatttagtggaggagagagacatttgataacattggaagagtaggcatggatcataaagaggttgagttttgctctaattgagagggggaggcttaatttaagagactcataaatttcttttctgtgatgataggtaaatttaggttttatgaagccagaagcttttacaattttgaggggtcttcttcaaaaaagaacacaaaattgtgaatatattgcttcagtagtctttccaatcaccagacatgaaatgaaaacctaaaggagagaaagttggagtggcggacatagcagtagaagctgatgtagaaaatgtctttctattgcaaattgtacaaagacttaggatcatttgaacacataactaggaatttgctagtatagtacaggcctccaaacattaaacgaagaaataccagcttagtattcttttcaaatattcttctctcagccatgtaacagaaaactgcatgtggattgacagacatctgagtatatttcaagtgtcctaggaggtctcttctttgtggaaaggtttccacagaattgttattatggagcacttaagctaaataaggagtatgtatctcagagttaaaaattcatattaacatttcacatatctagtactaggacttagggttttgagttttagatgaagaaaaatatttctaattcatggagtgtccattcacattcttctctaaatcacgttttgtaagttattacctctatataaatacagcatttgaataatacccaataatcaagatcttaactttcctttttaagataatgcttttcacaatattacaacagacagaatttatataaaattagcacaaaatacgtgaacaaacacacatacaaaaaaaagaattgctatgtagaagattggtatagacttttaggagagaaatcccagtgattctcattcaagtgtgattttctcaaataatctgcaaaactcattaaaacaaacacaaaagcaaatttttgtagttattattttgtgacattacttttaagaatagttttaaatctaattttgtaattgtattttaataattgaggttatgatgtaattaattttctttttagtatgattctaatttatgaattctagcttgtacttttctaagttagcaagaaaggaggattctgaataagaaaaataatattttggataatatttagtaatgttgctgatttttaaaaattataaacatgtaagagataattttacacatttcttatctgaatcagaataattatcaaatttattaaacattgatataaatagtacatataacaaaaattgttatatgttaacataaatattcaggatacctagaatttgcctttccatgtgaacttgaaaatttatcttggtttgttttctttatttgtaatatattaattatgtgttttttatattttttttaacttaaaatatattagaaatgctattttgggttctttttccttgattacattaaacaaaaataccaattttaattaatttcttagtgcatatatcttcactaataaatctttgatgagaatttacctttttgtgatgtatatgtcagtcatcaagaattataaacatgatgagaccagaaatcatttgaggttgtttagtttcagttaaataaagttatcattgactctgcaatgacagatattataccatcattattctcgggatcctccccagttctattataaatttaacttcttaagatatttccatggtgttttatgatgtgttcttttatttttaaaattttaatttctatgttttatatgtttagatggtccaaatgcagttttgttgcatggatatattgcatagtggtgaagtctgtacttttagtgtattcatcacccaaatactgaacattgcacccattaggtaatttcttattcctcaccctcctgctatcctgccacatttctgagtctccaatgtctgttactcagcactctctgtccatatgtacgcattatttagctctcacttataagtgacaatatgtgggattttactttctgaatctgaattattttacctaaaataatggcctttagttttatacatgttgcttctgaaggcatgattttattctttttttttctttttattttttgttttggctgagtagtattctatggcatatatctataccacatattctttatccaatcatctgttggtggacaattagtttgattccatattattgctactgtgagtagtgaggctataaacatatgagtctgggtatcattttgatatgataattgatttcctttgggtagatacacagtagtgggattgctgggtgaaatggtagttctgtttttagttctttgggaaatgtccattctgttttccatagaggttgtactaatttacattcccaccaacagcgtataagcattcttctttctcctcactgtcaccaacatttattattttttgactatttgacagtggccactgtgtctaatgtaagatgataactcatttttttaattcgcatttctctgatgattactgatattgagtttttatttcatatttcttggtcattttcatgtcttcttttgcaaaatatctcttcatatcctttgtccactttttcatgggattattatttttttttcttgttgtgttgtttcagttctttgcagattctggatattagccctttttcagattcatagtttgcaaatattttcttccattctgaggttgtctgtttactctgtttattatttcctttgctgtgaagaaaatttttagtttaattcacaatcacccagaagcaggtcatttaattttcatgtatatggatagttttgaaaattctttatgatattgatttatagttatatttcaccaagttctgataagatacttgatattatttctaacctttaaaattttgggaacttgctttgtagctgtagcctagcatatggtctattttggagaatgttccatgcacaggtgagaaaaacatatattctgaggttgttgggtggaatgtcgttaaaatgtctgttaggtccatttgttctacagtccaatttaagtatgaggtttctttgtttatttttttgtccctgcaatctgtctagtatagtcattgggggtgtggaggttgcttgccctcattatattgctgtttatctttctacttagctctagtagcatttcatttatgaatctgagtgctgaggttttgagtgcatatatatttagaattgttatatcttcttgcttcctttatcattgtgtaatgaacttcttgtcttttttttcttgttgatttgaaatctttttttatatataaatataactataccaaatgctttttgtttctgttgttcaaaatatctgtctccatacctttaccatgagtttgtataggtttctctaagttaggtgggtttcttttgagcagcatgtggttggtttctgttttccatatttggtccacaaatctatatcttttaagtggaacatttaatctatttatgttaaaagttaatattgtcatgtgaggttttgttcttgtcattatgttagttgttacctagctggtttgtagtcccaactgtgtaattttttaataagacctgtgagttttgtacttttgcatgtctttatgatagtgagtattgaccatctatttccatgttcaggactccctggatcatttcttgtggggtgaattcctaaagtggatttctagtggtgatgaacttccttagtattagcttgtttgggaaagactttatatattcttcatttatgaagtttagtttagcaaaatacaaaatatatctctaatatatgttttttcaataaatatgaactaatctttctttaagaaccctgaaaataggacaccaatatcttctggcttgtacagtttctgctgagaagtccactgttagtcttacgagatttccgttatagttgattagatgcttttctcttgctgattttataatttttcccgttcacattgactttagatagcctgatgactatatgtttgtagaagttcatctcgcaatgcatcttcctggtgttatctgagcctcttgtataaggatttctatgtctctagcaagagggcaagaggagataaattttcctcaaaaaggtttttttagctttttcttctccctcaagaatatctataactcttaagttttctcattttttagaacgtcatttttctcaaaacctttgctcattaaaaaatgttatttgctctttatttttgtctgacagggttaattggaaagacctgtcttcaagctctgagagcaagtttttctgcttgatgtaatctgtaattaaatctttcaactatattttgtaattcttcaatgaatttttaatttccataagttctatttgttttttaaaaaatatttttagtacatttttcattcatatcctgagttttttttctaatttctttgtgttgcttttcaactttctcttggactccatttagctactttaaaataaatattttaaattctttggtatttcaaagattttattttggttaggacttattgctgaagagttagtgtgatcctttgcgagtgttgtaatacgctgttttaaatcatacttccagaaatgtttcagtggtttcttctcatccagatgaactatcccttcttatttttaagtccagtttccaacagacaggattttttttttccctttgagaatatgactacgatgtatgttgtatagggctatttggtttaggttctgggttctttcagtggtaaagactctgtttgagtaccttggttagagataacttttgtatgatggctttcttaattgctggttgtagtagttatgtactgggtgtatgacgaggcttactgcctcctgaagggctggtatggaggactacgcagaaaactaaccttgttctgcatcatgccctagtgtcagcattttgcactgggctgtgcagttcaacattcaggacagtaggtggcacggacaggtaagagccagctgcagcagaggcagatgagcctatgcttgtcactgtttatgggagactctctgttgccccaaggaatggactgatctgtgaaaggtacagtggtctgaggagctggggacaaagcgggatagatctgtaccactaagctcacccttggatgctccaaggatgagcacaagcaccagccctgacaggggtgtcaggggaagaccctggggagatacccgtagcttgtctttcttgcaagcctggcttcattgggcacatgaccagtggagttgtagccaccccctaatacccctacaatgtccgtcctctggtgtgtctacaccagtctcctttgcgagtgaccacagctatgaacacagaattggatccacgggacatgttcccctctctacatccgtgcccaagcgctgggaccattgggctcctgggatggatctatactcctcccttgcagagccaaacaccgcgtctgcgtgtctgctggaagtggcgtagtcattttcagcccacaagcaggttgctcttgcacacaggaaagtgaatgctacagtcttctttgccacaaggggtgttcctttgttgcactttccattaggaatagcctccctggtggttaaactattgggaatgctgtaactcctttgggtccagccagctatgggtgactgccacatccaagcaggtgacagggaatatttgtgcggctctggtgttatggggacagagggctgaggttcctgggtaggaaacagtccccacatgagtgcactgcaggcatgaaacctaccactgcagctcaggcccaaggggaaggcagatgaccctattcaactagtagtttggtgtaatgccctcaagaagttcccaaatctccactcacaccagtgtgtgtgttcacgaagacagaagagctctctgatggcttggatccacacggtgagctgcagggagcccagaagactcctacctacactttctatgaggtcccacagggtcctagtcaacctttgtcaggctcttgcttctgtctttttccatgctttggcttctctccatggtttctctatgacgctcctgcaccctctcttaaatatttttcaagttatgatcatttacctgtaactttggttcttctttctgaggagaacttgtgtccaaactccttagtcagtcatcttgttttcaaaaagccccaattctggtctatatgcacttttcttttttaatatgagagagtaatttcatgttttgagtaaaaaaagtaatattaaatttcattaatgtcagtgattaaaactagattcattgtaaataagttgaatttacaaattaatttttagaacagatatatttcaataccataacatttataataaagttccatttcaatttagacagcatataaaacataatatgtagcattctttacagggaaaaggatttatctgatgcccctctgtatgacccaatatcaacctcactttattgtggcatatgtaaaattaactttggcaatgattaattatatattctcatgaaattattttacctttttcaagaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaaggtgaatgcttatcttacaattgctgaaataagaattagaactttgaataccaacttttttcttattaattttgtttgggctcccattgcctgtaatctaatgaattaagtcaaatatttgcctgtgaaggacatgtattgagtactgaatacctgagattcagtcacttaagttaatctccactgtttcttgaacgatgtgctggaagtattcccagacacacaggtgttgtcggtcttagtctactttaggtttatgtttctataaaggaataactgagtctggatgatttgtaaaaatgttttatttggctcactatactcatgactataaaattcaagatcgggcatctgcattcagtgagagccacagaatgctggtagaaagggaagaggagccactgtgtccagagaacacatgatgagagaggaagcaagagagagagcagggcagtgacaggctctttttaagaaccagctcttccaggagctaatagagtgagaactcaccctgagagggggcattcatctgttcatgagagatccatacccatgatccaaacatctcccattagaccccacctgaaacactggggatgaagtttcaacatggggttggaggtgacaaacatttaaaccatactagtggctgacaatggagggatttctttgttaattttcattttgcttgaaatgtcaacatccattctggacattttatatagtgtgggctgcaacttaagtttcaccgggtgtgtctaaacaatatttaagcagcttatattcaattcagttgcttgtattgattagtcaaactttatgttgatcaaatgcttgcctcagttatgatatttttccaaaatgttatgataaaatgtttccatgaaatgtaaaaattaacatgattttcataaccacatttgctaattggttttcttgcatctttaagatatctagaagtctgagcatattttaacattttaatataccttcaatatgacaatttagtataagtaatacaatatgaacaccattcttgattgtttaggatgctataataagttacataatgaagaatacatgaataaaagaagaaaatctttccattttactgaatttttatattgtaaaacagacaatttaaccattatttacatagtatttctactatagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattggtaatgtataaaatattaatatttaaacttgtcaaaacttttgtattttgtatctaaaacacatacatcatgttttcacaataaactttttttgtaaaatttacatagtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtgggtgagaatacccttcttaaatcaacatttaacaaagtttaatatttttattgtaacaacaataattgcaactatatttttgaaatttacagatatgcctcaacatttccagtcttcaatatgagaccaatcttttgcatattgcttataattcaatatgtgtctagaaagaaaaaataaagctagtaatataattttatgaatctttctgcgtctgataacagtattgtttatatttaaaagtgtgaagcaacattttacttacaaaaattgtcatgtgaggccagggtggttgctcacgcctataacctcaacacttcaggaggccaaggcaagaagattgcttgaggccaggaggtagacactagtgtgggcaatatagcaaaagcccatctctataaaaaaaattttgtaattagttaaggtgtggtggtgcatgcctgtaatccagctacttgggaggctgaggaggaatgattgcttaaggccaggaattcgagattgcagtgagctctattgtgcattccagcctgggcaacagagtaagactctttctttaaaaaacaaaaatattaaaaaattatcatatgattaaatatgagtactaattactgagaaattataacagttttatataaaatataaatattattgttattgtatggtattcctttttaggcactgagaagcaaagaaacaaagttgacaaaatacctacttactactctcccataggattcttttctctcttaaagcttccaaaagtgataatttttcagtttgttccatatcagccaaaataagtgaatgtgctgcagggttggtgggccacaggccctctacatcagtggtatagctgagtggcatgaggtagtcagggactgagtcaggacgtaaatctcattgacggacttcacactgtaaatctcatgtcttgatcagcaagaaggcaaggtgattcacttacagtgtgacttgagatgtacaatctttaaaatcattttgcctctttgatgactaaccgggaggatcttggggaccctcattcacttttctctaaactgagatttttcctaaagttttcctgggtcctgaattctaagagtcctaatgtccaatcatacttatttatccaatgaaatatccaatgatattttgtatttcccaaagaataaaatgtcttctgataggtatctctaacatttcagcgacagaatacagggcttatattttgacataatagcattttgatgcaatgtgatcaggaataacttggttggtgaaatttataatgattaagtcataattttaccatgctaatactatttactttataactatttttatgtaatagttggtttgattcctatcatttgaattttcataaaaatatatttattttatagcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaagtaagctcttattttgttttcagaaatgtattctatttctcatttggaaaagtaataggtatgtgtgtcttttaaaaactttagctatttattattacaaatgctactgaataaggcaggtaaactagaaactaatgaaaacactgttcctaatattaactgtgccctgtgaattagttacctttagtataaacacacacacacacacacgcacacacacacacacacacacacacataaaccaggcactacatgtcatcattactgttggaggaccagtgcttctcattccttttcttgtcaacaaatgttcctgtgcctatacctctgtctatgccaataactactatgtatctgtttgtatatgtctgtatgcatgtatgtatgtatctatatctatttctgttgattcatttatttaatctatctctctgtctattcatctacctgttcatctacctaatcatctatttatctattaatttattgttcatctatcttgaaaagttagtcatattgacacatacagtttcacttgaatagtgtaggttttattccagtcttctcatattttatatctgtattttgctatccaattgtgggtttccttgcctcactaacttcaatatttttaccaatgtctgccagtctaggatatacagaaagcattgacaaccaatacaaaaactaatctgctatcaacatttcaatatgtttagagtccttaaagaagcaaataatatatatatgcagtgaagtgtacatgttctacagttttttcttgaagttttatagttttagccattctatatagatttattaaaatgatcgtatagttatcgtcctttctgttaatgggatgcatcacctttactaatttgcctatgttaaacgacctttacatttcttggattaaacccatttgatcatagtgaatgatctttttaatgtgctgtaggatttgttttcctagtatagtgttgaggggttttgtacctatgttcatcaggggattttgcctgtagttttctttttgcgttgtgtccttgtctggttttggttccagagtaatgttgggccactagaatgagttagaaaaatgatctcctcatcaaatttttggagtcgttttagaagaattggtattagtcctttctaaaatgttgttataattcagcaatgaagccatcaggtcttggattttctttgatgggaaacattttattactgacttaatctgttgcctcatgattactctgttcagattttctatttcctctgaattaatcgtcgtaggctgtgtgtctagaaatttatccatttcttctaggttatccaatttgttggcatataattgctaataacggtctctcattatactttgtatttttttgatatcagttgtaatatcacccttttcatctccgatcttgtgtttctttaagccgtatctctcttttttagttattctggttaaagctttgtcaatttttgattatctaaaaaaaaactattttcattgatattttgtactgctttgggggctctattttacttacttttactctgatctttatgatttccatccttctactaattttggaattgactagtttgttcatgtttttctgcttctttgaggtgtactactagactgtttatttgagttctttccactttcttgatataggcaattattcctaaaaacatccatcttagaactacttttgctgcatcccataagttttgctacgttttgtttccattctcctttactgaaaatatttttaaatttatttaaaatggtttgaccctatgattgtttcagagcatattgtctaattttcacctaatttaaaattttccatagttcctcctattattgatttctcatttcatacctttgttgtcagaaaagtgacttgatatgatttcagtcttcttgaatttgataagacttgttttgtggcctaacatataacatattctggggaatattctgtgcgcatttgagaagaatatgtgtttttttgttatgtggaatgttctttatatgtctgtccaatctatttggtataaattattgtttaagtttaatgtttccttattgatattctgtctggatgatctgtctcaacgttgaaagtaaaatattgatatcccctactattactgtgttgcagtccacatctccattcagattcctaaatgtttcctttatatatttagttgctttgatgttgggtgcatatataggtttataatagttgtattatcttgacaaattgaccccactatcattatataataactttctttgtacctttatacaatttttcccttgtctattttgtctgaaatgagtataactacccctgttctcttttagtttttatttttataggtttttttccatgccttcactgcaatctgtgaatttacgttacagtgaagtaagtcaattgtaagcagtttataattggatattaatttttgatttatttagtcattctatgccttttgattatagaatatattccatttccatttaaagtaattttagataggtaaggatttatagtggtaatttgttaattgtgttctggttgtttttaaaattctttgtttctttcttgcttgctttattcatggtttgatgactttctgtagccatatgcttaggattttttcttttaatcttttgtgtatctattagatgttttgcttttggctatccttaggcttgcatagcataccttataaaaggctatttgaagttgtagttatccttaggcttgcataacatatcttataacaggtattttaagctgataggaactgaattttgattacatataaaatatctaaattttactctgctcctcccatgttttctatttgatcacatgctttgcatctttcaataattcgtatctcttaacaaagtttgtagcttcagctgttcttaccacttttgccttttaacctttatgctagctgtatttacccatcactattacagtattagagtgtttgaatttcatattgtgcttacttttactagtaagttttatactttaacatcttcatgttactaattagcatcctcttctttcaccttcaagaactccctttaacatttcttgtaaggcaggaaagtgtccttatgctctctcagctttttttcaatctcagaaagcctttatcactcctttgtttttaagacagaatagtggaatctagaattattccttggcagttgttttctttcagaattttgagtatatcattccacttccttatggcctgcaaggtttctgttgagtaatccactgatagtcttgtggaaattccattttatgtaaccattcacttttcattggcttttttcaatacttggtctataacttttgataatttgattgtgttatgtcttaaagtgactatctttcattaaacttatttgatttcctttgagatttctgggtgtgggtttctatttctttcccagttgttgaaagttttctgtcattatttttttgaatatattttctgtatcgttgtgtttctttctgtttttaacatggtgataatgcatacgttattccacatggtagtattccatctggatcttaagctatcttcacttttatttatttatgtgtttattttggttctcagatttggtgattttcagtaatttgacttcaagttcactaattccttcttctccttcatctagtctgctgatgaatacctctttaaaacttttccgttcagttatagtattctcaaatttgtgatttttgtttggtattttaaaaatactttctacctctttgttgaagtagttaatttgtttttgcattgctctcttggtctcagtgagtatctttatgaccattattttgaattctttcttgagtaaaacacctatatccacttccctcaggtcaatttctggagactcatcttgttcttttgtttggagttatgatatcttgtttctttattttctttaactcacagtgtttctatgcaatagataagacaatggcctttctcagtcttatcagactggcttcatataggagaaagacctcactaatttttccagccagagattttcatgtgcctctcaagtctttgtgcggactgctgtctcttattttttgtggccccctggaggttagaatgtgccacatcttttcaggacctgggaccaacaagttaggagccaggaggtctagatgtagctgaaaatattgaagacttggctgtgtatttacttacttctattttcatagtgaaagtgaatgtgcgtgtttatctcccactctctctctgtattacaccaagtaaagaatctgtggctaatacctgtactaatattcaggctgcatgctctgatcctgaagaggtatctgcttgaaatgagtccattgtattaccagctttttgtattctgtgatgtagggcctttcaggaatgcagatctctatcatctcccagtgtgagtttgttaaggagacgatctcttgagttggagctatagaagtgatgacctttgaatgcatggctaaacttggtccaggaagaatggataaatctgaatttatcattggggcgagactcatgaagtgccaaactttggctttggctgcgggaagattattttttgtttgcgtcattagataccctgtgcaagctcgatagaggccagttcattaagtagccagtggaagtatgtgccctaagccctttcgacagagaaatggaaattgaactttctctttccttttctgcactgctccaatttggcatagcgcctggagtttttacatagcattttaagaccatctatttgctttacgatctatggagactggtatttttctaatatctgctgtgacagttaagagttttaagaggagtccttttggaggtaactgtaaaggttgtagcacttgatggatgacacaaacctttttgaggataaacaggggagctgcattttaaaaaccttttctctgcactgctcttgggcaatgaagctcctggaagtgcttacacacccatataaaacgccatttcttttttcagtggtctagatagactctggatatattttgtgccctctactcccagaactaagagctttagaatacagtccctgaatgaaagttgtaaaagttagggcactcaagtttgtgtggacaaacttgttctaagagtgattaatgtacctggatgtatcactggggtgagccacgggaaccggctagagaagtgcctgatgcaagttcattagaatccagactgcaagttttttagaattcagacctctaagtagccacaggaagaatatatcataaaacttctcgggagaaacaggggactgttttttcagccccttctctgaactgctattaaggaatgaagtttctggaagctcttcagcacttgtatcataccaccatttttcctgtgatctagagagactctcatgtgtttaatctcctctgcttccaaaattagtgaattaaaggccaaaacacaggatgctttatgtgagatccaaaaacttctccacaaggagaaactgggtttttgagattccttttctaattgtgtggtgcagtgaacaaggctggggtccatgctccattgtgttgcaacttttcttacttgttcaatgtgaatgttgtctttgttgcctgttaagtaggagtccctttactggtctttcattttctttcaggaggagttcatttatgaatagatgtttttttaggacattcttgggtggaagaagagtcaggagcttccacttctgccattttgctgacatcactccctgcctagctctttattttacccccaggaaactagagtattgcaggtatcgttaagtgctcctacacaagcaagagagaaacctgtactttaggatgctcccccaaaagctaggatgatagatgcttagttcactcttatctttcctctctgagggagaagcagtcaaaatatattggtctctgtttactttagggggttgcaggaggctttgaactggtttcttgatttctcataaagggaattgtttccagtatcgtcattgaatcagtgtgcctgtggggggaagggagagtggtggcttcctatactggcatcgtgctgatgtcactgccctctttcatcctcaatattgatcattttttaaatcttgatcattgtttttactttgtcctcaattttattaatattttcaaaaaccaattgtaatgcctttaaattttctccatttgctctgtattttttagttttattatgttttactgattttagctttgctaattttctcccttctctgtgtttctttgtccgttttctcttcttcactgattttactgttttcttccttctgatgacttcagttttaatttcacttttctcaatcttagggtgaaaaatgaaaacatggtcataaactatcatactttgaaaatataaaactttaaagctctattcttttaagcactgctttagctgtgtcccagaatgttacacacgtgtgtgtgtgtatgttctatgtgtcgggagacagagagagagagttcatttttatttgatttgaaatattttctcatttgtcttgtggtttgtctgttgatgattaattatatggaagtttattgtttaatttcaaaatatttgtttttttctagataagtgatttttgctggtttctaatttaattctcttgtgaaagaatactgggaaaatttcaatattttgaaacactcagttttttaattgctcagcacatagtctaccttgctaacggttctatttacaaataaaaatatgcatacacactaaatgtagaattaggctatactgggtcacaatgttcttcaaatttatttgccatgtcacaaaatgttaaataatctctttcttaattgtttactatcagcaaatactttaaattaaataataatgattgtggtacacattaaaatcaatgggatacagctgaaacagagatgtatttagcattataacatgcatcagaaaaaacaaataaaaaaataaaagcaacaggtactacaatctagaaggtagacaggaatgtacacccaacaaaaatagaaggaaagaatcattcaagcataaatagttgaccattaatcttaagaaaaataaattgatgagaatgttaaaaacatgtcaaaatattgaaaaacagaaataagcaaaatacttttgataaatatgaaatactttatcataagcgaaaaaagaaaactcgacattatcaataacctttaatgaagttttgttcatccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaa

SEQ ID NO: 1005 - DNA, 49688 bp, Homo sapiens
acagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaa

SEQ ID NO: 1006 - DNA, 55009 bp, Homo sapiens
gttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaa

SEQ ID NO: 1007 - DNA, 65601 bp, Homo sapiens
gttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaacttgttttctcaagtaagttagttttctgtttaattcacacaatatcagtttatagcagatcctcaaaaatcatttaatacctgtgactacaatcaaggcatatgatcattctcagactgacaaataagtagccatcattagaaatgcagacaactgagtaattatggtgactgctcttccttcagacacacacctcggggcattgcatacctgggtaccagttctggatctggaagttaggtgacaggagtagatttcaggagggcttgggagcacacaactttaagaagacacagttgctgatgtggtgggtagccatgtcattcccaaggctgccacttcactctcattcctttcccctaaaagatgcagtaaatgtgagttcagcaaatgagtatttattcagataaagacgtgctaccactgcactctggctagcgttatggaaagtggccaagtcctgggggcagtcctgtagtcactcagtggaatggtcacctttgaaaatctggtagtggctacagtgtcccctgaacaaaaggcacgttcaactttagtgctgcaaacagttttggattcaagaaaacactgaaaccacttttagatgtcttagagcagtgtatctcagggtgttgtccctgacccagaaacttaggaatgcagattcatgggccccacctccaaagggtggttctgttttgtgggtaccccatgtttctgtttgggaacactgctttaggggaaagggatgatcaggtttaaggtggtgtgagagtgcacctggagatggtttaaatgttttttaagatacctccttgcaggcagttgggagaagataaagcaggggagggagcttggtggaacgggtgcaggaagaagggacaagctggatgtgttttgaggatgggagagcatcagtccagctctgcaggtggaggttgctgagcgttgtcctatagggaactttatgcataagggaagtcaggtttagagtcctcactactataaagtggagttggtcagggctgatttgttccgattgaaaaccatgccctttgctttttgggtttacatttagatatttcccatcagagatcatgaggaatagcagtgggatttttctatttagcagccatggtgtggtcaaagctaccaaaattaaatttgaataatatacaaagttcaaattccctggcttccccgttttccatttttaaggataatttcaagtaagagagatgtaagtatttctattacatgtctgatttgaatatgagagcaacctgtctgctcctaagatgtcaggatttgtttccattttttatttccaggagtcagattccttgttaatgtaaaaatggttctgtttcctagaagttttgaatctgctatggatctaggtctggcccctcgttcttgagcttcactcttaatttcccctgggtggaacaatatcgaagagaggaggatgttagccacttccattcccaagttggtgagaatttctataaaggacacctgcttcttggattgagggtgtgcagctgtcagagaagggaagaaactaccttaactaggctgattgacatccatgtaatatttactatgagacagggagagtgtttttattctcaattctttaaatttaaaataagacaggaaatgttagtgacataagggattgttagagaaaaaaagatgggaagatccgtaaagtgaatttgttaggggcaggagaagcctgacttggcattttcctgtttaggccaggagatattaccataatgcaaatgtgaaagcctgtgttctgtctctcttaatgcttcatgtcctcttgcaaatgagactgccttcagcacagctggaattattagggtttagtctacacttacgctctacaccagagtgcaaaatcttttgtgtcttcacaaggcttgttgatgcttgttgctgtcctcactgccaaaagaaaaggttggtgacctttggactttttccacttaaagtagggtgatactactttattgagtttatggggaaaaaattataaaggtgtcaggggaagagtttgctcataatgggatatttttaggaaagtgaaggcatgcctgtaggagctaatgggaaagatgtggtcagataaagatgctaccactcctgccactgagattacttaggaggtcttgtccacatattcctgaagaagggtttaattgtgtatttggtgtgctgtgtctgacatctgtgtttgcaggtccgtgtaatctaatcaggttgaccaatagaagattttaggactgaaggattaggggagtttagagactaattctttaagttttgtgtattgagtgatgacaggtggggaacaaatctaaatgttgattactgagcataggttagggttatgtgatccaaagcagtcacacatcagataggaagtagagccaactcttagcactgggtcttttcagttacaagcgaatcgggagagggcaataccagtttttcaagtgatgatgcagagaactggactggagatgtctaaccagcaaatcattggcaaagctggaaatttcctaggcattcgcacacctcatagcaacacataagctacctgctaactccaggcctttcagtgagttcagtgtgcagttgacaaagacatttactaggattcttggtaaccatttggtcttccagtgggcctggtgcagggggctccactttgatgacccttggccccatgtttacccagttcagcctcagaagatagttgataaagtgcagaagtggcttctgaactgctttaaagccattggccatccaagtaatagaagatattgatgcaataattagcaaagtcgactggcaagaggttgcaagttttgacttggacaccaatggcctctgtgccgggatgggttaggtgtgatggaggaggcaggacttttgtaggagttctctaggtgtccctcccactcctgtgggtccctaaccctcttcgatgttgcttctgcctatgttgagggctatatgtggaatccttcttatctgcccaaaaggagatcagagattggataaaatgtttaaagtacctattgatttcaagtatctgtcaaggccctagtaggagtaatttctcttaggtaaagaaatttaaaaagcaccaaagtactgttatactgtattgcttacttagaatctttattctctacattctaggttcggaacctcacttacatggtgacccgcagggaaaagattaaacggtctgtgtgcaaagtccaggaacagatattcaatctttacactaagcttttggagcaagaaagagtttcaggtatgcattaagccctggtaggtcaaagtatagggcaggggtttgtaagctttaacactgttgaggaagaaataatcatttcttaattttcttatagaagaatttaagaagcatagacgttcatatttaaaggaagtctttaatttgaggcatcatgtttaagggaaaaagctatgaatttgccctctataaatatgggtggaatcctgtgttctctgcttactgagcaaacacatgaaagtcttttgagtctccctaatttcttcatgtgcaaaatggagatatcgcaagctacctcttggaattgagagactaaaatgaaacagtgacttatatattacacagtacttggtaaacacatcatggggatacctaacaggtttatattcagccttgggctctatctgtaacatggtaaatatggtcaatatatgttaagactgtacttaagacacagtccatttttagataatgttcacagtagattttttttgtgtagatggattgttgactatttctgagattgagcaccaaatatttatttagtgtcttctattttatattgccctgggctaggcaaacagaaaaagaaaactagggtatatacttcctctactctggacaacacatcagttacttgggagatcaagggcaaagatcaagttgggcaggttgtttaacctctctgagattccgttgatcttaaagtttgttttagaatcaagaccccttaagtgcatttgagccctatattctgtgatcataagcccccaaaagtaggtagtataaggatttcagagaagcagagctgctgagtgtggatcaggcagaattagggacccatggaacaggtaggtcttagactggacttcattggaagatagtcagcctctctcctgccttggactgccctttaaagttctagctgcaccattcttggtgcttgcgttgtgcaatcatagttgattcactcttgtttttgtgcatttgtggctttttgtcactccatctagattattatggtgcacagagaacaaagaagttgttataacctgttgtgttgaaatccaaattctggtttatctaaccaattatgtgcgactagagggagctcggtcatctgaagaaataaaaaaaggtttagggaggtttaaataatgttcttgaagtgttacatagtttgaatgcaataacttgttgatatcctagatattttcttcccaagattaagtattttccaggtgaatcaagtgtatatcattagctggaacttgcagtttaattgttaagattttaaaaataaattttctaagtagggtgtcatatgtaaaagtaggtcgattcagattccctaaggtgagctctctcttcatgattcctacctgaatacaaataaatgagatctgtttaactgccttggaagactgtctggtgcagatcaccgagcctacagcagcaaatgctgagctgggatcactaatacaagttgtgcctgtggagttgtgccattggagggctttctgcaactcttaggtcattatgtaatgagtgattccctgtaaaaataagccgtaaagagcattttcatctggtttcatttgagttatttctcatggatattgcaggcaggtttttgcatttcatggctgaggtttttactgggtgagcgaatgatattcttaataagtctgggagttattttgtggtaacagagctgtaatgtagatctgcattcagaagtcctactatttcagaaaaggaaaacaaatcttcctttcattctgatgtaagaaccataggtatgatcagttgaaaacatttatcttcctgtaggattctgttgagtaatgcagttgaaaccctttagggtgctttttttctttttccagtcctaggcttcagtcgtgttcttattcatgcctaaaggctgtctcctgcctgaagtagagcagatggtcatgatttatatgtcatttagggtccatggtttaaactctgtgattctgagagtgggtagggtcatttgctgagagtgtcctcagtggcaacagtgcttatggggggtgggagggtcatgagttggaggctctttagagacatggattacagtcaaggagatagaaatcagagttcagaaaatgttagcctcttcttaccattctcttttcctgtggcaggtgattgagtaaaagaaatatatgcagtgtgatgtgaaggttgattctaatgattgattcttgagaaagcagcatttccaaaccagcaggttgtaaaacacctcctgtggtcatgacagctctgtgttctgagtcgctagctatgtttcatttgcttgcagtgtctgtgtctggtgagcactaggttctcatatggcctcctgtctcataacctgggggctgaaccttgttttcttggtggctcatatcttatgggagacagaaaacatgagaactgctctttctagatgatcttgaggctgttgtagaatcatggtctttatgacaaacactaatgtgttatgaattcacctgctaggggtaacaactcattagtgggttgtgagatgaattcagtgggtcatgaccagtattaaaaacaagtaaagtataataggaaatgtcagagtacattatcaaatgatgagggttaatattatttcgtgaaatgtgaactcttactaggtcatgctgtggaatttagtcactgtgatttgcatcaaaaaatacgaaaaacatcaatttaacttacttcaagttgaatgacaattcagttgaatcccacaaatgtattttgcacataataataatgaacatttttggaacgcttactatgtgtcaagaattatttcacacatttcctttattcattcacatgtttacatgtacttgtcctcgtaatagccctgtgagggtacagacacatagagaaacttacaagccccgagccctgctttttgggtcctctcagtctcgtacgggaggcagaagactggaccgtggaggagcgcggcgcaggtgctgctctgtaaccaggtagagggagcagaggcagccatcagccacctgatgagttctgcatggagtccgctctgaaaatcagatcagttattttgtttggaggaggtctagttttatgaaaaattatgtgagcttcagctgttttagaaaatgtggcatattgagtctgcagattgaatggagattctcaaggcaggtcatctcttcactataaaaaccaaatttgtacaaacttggtggtgtaagtgttgtgttgttgggtggggagttcacatcaattgggccacactaagggtgtagaattttattcttttggatttgcttctgctgtaatttttctttatttgtggttttatgtttataggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 1008 - DNA, 59089 bp, Homo sapiens
cttggcccgggccaggtgtgcgccctcctcgctgcgagggggagcgggcggctgcggggagcgattttccagcccggtttgtgctctgtgtgtttgtctgcctctggagggctgggtcctccttattcacaggtgagtcacaccctgaaacacaggctctcttcctgtcaggactgagtcaggtagaagagtcgataaaaccacctgatcaaggaaaaggaaggcacagcggagcgcagagtgagaaccaccaaccgaggcgccgggcagcgacccctgcagcggagacagagactgagcggcccggccccgccatgcctgcgctctggctgggctgctgcctctgcttctcgctcctcctgcccgcagcccgggccacctccaggagggaaggtgagtcggcttccacaaggaaacatctcagccctgggctgagaatctgcctttctctgcagaccgtgatggctgaacgtacctccgaggattcccactttgtccagaaacttgttagagctcccttctcctcccctatctggggctcctccagagacggattttaaatgagactaatatataaagctatctgctttttaaaaatagtaagacaataagctgtgacaaaagagggtcttccttaccttaaaaatgttccttcttgatgtcttttttcgaccaaggggccgctatttaatcaataatgtgttgttatatacgttctttccccagcgtgtgcttttattaaaaggttttggtggcaatgtttcccatgactgtgaacaccacaaagattgcaaaggaacctcttcaataatcctgtaattgatgtttcaaatttcggatggaaaaatgagccttaatagtattagcaatacccttaacttttgcatcacgttacttttcatagtattttcatgtaatattcattcaacaggcacttactgggcacctgtgtcatatatcatttgatcttatctagggcacctagttggctgtcatgtgttagacgttaagttcatgtaaacaaaactttgtgagaacctagcaactcttaactgtaagcatgtgtcagctatggcaacattttatgggtgttttccttgtcacttagttctatggatatatgcctgtataattgccctgatgttttatgtttatattgcatcctgcatctgatggcgtttcaatcattctttcaataggtccaagaccaagagccatttccacacaagtgcatgcatgaatatgagataatgctcacatgcacatgcaattgtataagccattcccaatattattgtgcattccgggtgatgctggcctgaattggatttgagtggcatgaataatgtttgagcatgtgtttgaatgcaatgctacagtcctttttgtctaaaaaagtcttggaattaacttccaacctatcatctctgactaccattttcaaaaccatgtatgattgccaccaaaaaaaaaaaaaaggtggagataagtatgtgaaataatgaacatattaatttgcctgactagaatactattttactgtgtatatcgaaacatcatgttgtataccttaaatatatatagttttaaaaagtgataaataaaaggttctgaaaatggtcatgaagggtatgttctcttagggctgggataagaagtctcagcctaatggaagacatccccaaagtaaaaatagtctctgaatattagaatttaaagggactgcttatggatcaactacttggaatctcttgatttgaaaaatgagaaaatgaaaatgtgtttctcaaggccacacaggcagagatgaaactggctcttgatccaggggctcttaggctggagctttttgagccacattataaaagtaataaaggaataagatacatcttttatacatgataagtaatcatttaagcaattttcttgttggctatagttgagtacatatatgtgtgttagcattagggaacaaaaataaatatataggatgctatcaatgctattttaataaaatcaggcttaagaggacagagctaggattctcacttcttaaagacataccagcttctgggcatccatctaccccaagaagtcagaaataccactgaggctcattgccactttccccttccctggaggcagactaaggttttattctccctcctcagaggccttcatttttggattcaatgggaatgtgaagtttgttgccagggtagaacacacatgctttttcattcatgggatgctgggatgtgctagaagttggactgaaaatatggtatctgccatgtctcaaagtgaccgtgtctgagtgtcctgtgggctgcacatatgagaacctaaagcagtgatgttgcttcctggttgtttccttgcagtagaaattatggcaatagatgaaattggcaagacttcagggttgggctcagctaaagcacaggctttagagtcagcctgacctggctttacattttggttcattcacttactagttccttattagtaatacttggtgtctgcttcttcattgtaaaatggaggcaatagtacttcaaccttgtagagtttttgaaaggatgaacaattactgtaaagtgccttaaaatgcctggaaccacatttctttaaaaagtccaaagccaacagtacagtgtagtgaattcatttgcccagagatcagaaagaccaaggctccccttcaggataggattgcctggtgtgagataaagtggcatgtggccccagtggtctggatcttagttcatagcaggaggtatgactggagaaggattgagaaagagataagaaagatactagaaacgtagccaccaatatgcttgtgaagggctttatgtgccaggctgttcagtaggatggtgccctgtaggcaaagaagagctgtgaatgatttgtaagcaggaattagtgtgactggattcatgttttagaaaggtcactcactcgagggcttagagaatgaagtggagctagggaagccagataaatggtgattaccgtaattcaaatgagagatgatgaagactttcatcatggtaatgaaagcaaagaggaaacagattacagggacatttaggaggtgaaatctaaagaatgtggtgatccaataagtctgtgtgttagggatatgagtataggaaagttgagagaaataaggaagagtccaagatggatccaaggctttaggtttgtacatggttagacagtgatgccattaaaggatgaggactataaaagaaggatcagtctgggcacagtgactcatgcctataatcccagcactttgggaggctgaggtgggtggatcacttgagcccaggagttcgagaccagcctgggcaacatggagaaaccccacctctaggaggctaaggcaggaggatcacttgagcctgtgagggtgaggctacagtgagctgagattgcaccactgcactccagcctgggtgacaaagcgagaccctctctttttattttagtttagaagggaaatttgagatataaatttgggggcccagaggtagaaagcaaagccttgaccacagacgagattgcctaggatatggaggtaaaagaaacctcagcacttaaaaaagagatagaggaacgatggagcagaatcaggaggaatgagcactgaggatagaggaaaatcaaagaagaagagggttttgttagtcaaaggaagactgtcagcaacatggcagtaataactggtgttcagatatccaaatgtgtatatacaaagaatgaggactatcactgctggatttagccgtcaggtgagttttgaagcaattgttcttccagaacggcgaattcagaatccatgattatcatagatcactaatttggtttttcccatgccctgatgctagaaaaaagatgctgtggatagtaggaaggatccttggaaatgtttatgctccctcgtagattctgttatttaaatcattgaagtggtatagcatcatacacaaaagtgcaggctctggagtaagactgcctgggttcaaatcccagccctatcatgtaccattgtggcacatttatattttgggacttgggcaagctacctcacctgttacttagctcctacatctcagaataaggatgataaatcgatatgaccattacacaaaaatcactttgcacattgcctggtaagcacttaatacatgttaatagattactgttattgttacaactaactgccctgccagtactgaatttggtatattgctttctgtgttttaagtggtaacatttttgaagggcctcctttttactctcctttcgtcagcccaagaaggtgctgaggagcctttctgctcaagcagacatgagccccaagttttacccaacaaaacaggaacccaaagcaggttgcagtttcaagactggatctcgtatcattccttctccttgcctttttcatccaccagacctcatcacacacagattcagcaaatctattgcttctcaaaacatgctcaaatataagatgaccctacaaagatcatctctcatttcccaatgggaagaacttcccccacattcaaagaaaggatttggacaacttgattatgagaacatttagcaatacagatgtagtagtcaaatgtctctttatgtttaatttagtaaattaattacacagatatattgaaagtcacataattgataaaatattatacttagaagtgttgatttgttcactcacattttatgaagtaattatattcaaattatattcagttatattcatctcaccagatgacttgagatacagtactgtttgaatctgtttttgatgtggtcactggaaagtacatcattttcaaaacatttaaaagatagacaaattatcccttagtgtatattgtgatcttcacagcataatcactctgaaaggcttatatgcaacacctttcagcactcacaactatgaagaaatgcaccattatgagaattgtttagacagctgggcccctttcttactgataagtctccaatacattgattgaggtcattttagcttaatgtatcttccccaaacaatatttttacaataaagtaattgagaaagtaccctataatatgcaagattttgaaaggacttaagtatgatcttttttttcctgagggataattttggaaaaattaaaacctctaccttatattcaagcatgtacagagatatagaattgggttggaggtgggctggaaattcccatatgggcttaaattctgggtgttctaaactgggggcagccactggttcagcctcactggcccaagaagctgagaaagattgttgatttgtgattcgtgtttatgggaaagtcagggcataaagttaaggtgttgagagaatcctgggaatatctttcccatttaacccacttaagttcttaatggttcaaacttactgactttttttttttttttttctgtcctagagaaatttctaagggcaagacttgaatcatctattagagatcagtgtagagggctgggtgcggtggctcatgcctttaatcccagcactttgggaggccgaggcgggcggattacctgaggtccagagttcaagaccagcttggtcaacatggtgaaaccctgtctctactaaaacatacaaaaattacctgggcatggtggcatgtgcctataatcccagctactcaggaggctgaggcagggggactgcttgaacccgggaggcagagattgcagtgacccaagatcatgccactgcactccagcctgggcaacagaatgagattccatatcaaaaaaaaaagagagatcaatgtagaaataggagctccatagaatctggaatactctcatttagtcagaaattaaacctagtaggtgactgaatcattactgggctatgttttaatataatccccagataggtgatgtaatgtttgaatcatgtccaaagccaaaggctaagtcttttctgtctgtgggtgactgtatgtctgcatatgtaattccccaaaaagcatctgcttctttatgtcacaaccatggaaacagaagagaatggttcttcctccagcactgatctatggaagaacctgagtctttcccttctgttgtatcaggtgaggggtggagatcaattggccaaacgtatagggatcctgcacttattcagggcttatatttacagaattctaaccgcgtctttttatttattgtggggatatgtatctccgcattagaaaagaatcaaattgcagccaaatcatttcccacaactaacttaaaacttggacaaatcatccaaatgctcagctgcactgatgtggggcatttcatacaaagtattttatgtttcaccatgtttttctcttattacagtatcgtagaactaaaatgagagtgggcctcaggggttctctacaagagcctctcattttatgcatgagaaaaatgacacccagtgaggtaaattaactgcccaatttcttactgttggtcatagcagagctgggctccagcatgtttcatccttttataggtaggaaaattgaggcacagaagagtgactgctttgaccaaggccagatttcagttactagtttaatgttctttttctgagataactccttggcatatttctcatttttctttttttgagatggagtcttgttctgtcacccaggctggagtgcagtggcacgatcttggctccctgcaacctccccgcctcccagcttcaagcaattctcctgtgtcagcttcccgggtagctgggactttaggggtgcaccaccatgcctgactaattttttgtatttttagtagagacggggtttcactgtgttagccacgatggtctcaggtctcctgacctcgtgatctgcccgcctcggcctcccaaagtgctgggattacaggcatgagccactgtgcccagcctgaattttcattgaaactaatcttcaagcttgatggaacctttatctactgttgacataccacctgtatttctaatgaagacatctatctcgtcttttcagaagtctccatttgtgtatatgattcaatatattggcctttcctttaaaaatatcagagaacaacaggttaaaactaagcacagctctagtttgtggggcattaacaagagaacagatttcaaattaccaagttttctcttccttttgttccactctgttgtcaggttatcatgcagcttggaattgaccaagtggctcagtttaggatcgttgatagtactgtgataagactttctcttttagcaatcattgttctttaatgactgttgacattttgcatctgtatatacgtaatcacgtccagagattatttctgtctccctgctacagacccttgtaagttttggagtctttcagaaagaggtctgtttcatggccagaatgttgaccatgtaagctttatacatacttactgctgtttcaaatcatggcccattttgctcttggtaaaaggatactttttggtaggggattcctagtgtttaaaaatcgtttttcatcccaaatagcctggcctactttgggaaggcagttgatccaacagtaatctgaagctgctgctcttgccctatccaggcagttgtaccatggtaggaggggatcttcacattctgagatctgcagggagcaggggagaggccacagtggacctggcataggaagtagtagtggagaaacagcatatttgttcaactgagatgcaagatactccctgatgtagtcttcatggtccagtctcttctcaaaatgtttgttacttctctttatggatgtgtaaaggtagtttggctcataagagctcatttaattcattcttctgactttaggcaatacagtgtttttgtttttgagatggagtctccctctctcacccaggctggagtgcagtggtgcaatcttggctcctgggttcaagtgcttctcccatctcagactcctgagtagctgggattacaggcgcatgccaccaggcccagctaatttttatatttttagtagagatggagttttgccatgctggccagcctggtctcgaactcctgatgtcacgtgatctgcccaccttggcctcccaaagtgttggaattacagatgtgagccaccatacccagccagcaatacagttttaattcatcttttttctgaaaaaaaaaaaaaaaaatctgtaagtaagatgctataaatgcacgccatgcatattttcccaacattgcaaatgcacatgaattaccattgttcttttgtgaagactaagaactatataatggtatgtaagcccacacacatacctaaatgcttgtatttttgtgaagggatgtagtgatagcaaaaaatctttgcctaatctccttgtacaaaaaaagtattgttcacaaaagcagtaaggatttaaaaaggaagatttattgtttttttttaaggaatcaatgaaacataaatttaaataattgaaaaatcatggtttatacttcaattatctccaaaaggcattttagtacaaattagaatctcctttttaacttctctttattcagacacatcatagaaggtttctttccttttggtcctctttgcttcaggtatttacctctggcatccctggaatctctgattccctttatttcaactgcttcttagaggggcataggatacctttttctaggccatgcaagaaatgtccagagaacactatgctctttgaataacagttaaatgtcctttctatgctggaatgcttttctttgtaggtaacttcacagaaatgtataaccctttatttctgtggtcagaagagtgtggagttccatggaggtggttgctgtcatatagaatcttaccacaatcacttcctgagtctatgctgcagctgacagcagctgtcttgcggtagagcctttgacagtgccagctataactctaatgtcctcagtttgccttccctttcacctgtgagcttactcagactgaaccctcagttttacctttaccctccactcctttgctagtcagacaaaacttggtgtccccagtttccctgttcactgggactttcttccccctcctcattgtctgcctgggcactggtgtcccagtggagtgtcaggggaagacatctccaggtgtgaactcctgatggagtcctcaccaggctgagtcatctacagttcacacgggtacattcccaagtctaggctgtgatataatgtactatgaactctcggtgaaacaggtgtctcctctgaagccataatcattcaaaaggaaatggcagtgatctgagtttcactgactcttgatgactttggagtattcagagttgaaaaaactgacccatactttatgattcaaaattgcctgtgagattagagaactgagctctgtcattcctctcatcctagcacttcctgcctcagccttactcacattgcttggacatttaaatgtcaactggtgccgtgccctttatttaaatgaaacaaatggatcaggcaggatatggtatcagttttctggctgtggtggcttaaaatgtggctatgaaaaatttgcaaaagaagcctaaattcagctaaaagccttagtgagagaagtaccatttcagttttcttattctaattagggaacatattgtgacattctttaagaagataaaactagaagcagatattcacacattaaacaatgaagttcaaggccagtttaaatgatgaaggattcagattttgttttaaaatatctgcttaagccgacaaacatattaaaacttggaaagaaaaattccatgtaggaggttttaaaactagaaaagtccttataagcattttcatcatcacatgtaaatataatataataaaaacattcatcttttcatcttgaatgtctcagacttgaagacatggatttttgcaaagaggatcatagcttctgatgcctttgatatcaaactgataaatgacaggtagtatcttgctttagattgcatacataatatgcaatttgaatatttgtcataattatttatttttgataaaaatgattttttttttttgagatggagtttcactcttgttgcccaggctggagtgcaatggcacaatctcagctcactgcaacctctgcctaccgggttcaagtgattctcctgccttagcctcccaagtagctggtattataggtgtgtgccaccacgcccagctaattttgtatttttagtagagacacggtttcaccatgttggtaaggctggtctcaaactcctgatctgaagtgattcaccggcctcagcctcccaaagtggtgggattacaggcatgagccactgtgcctggctgataaaaatttttaaaatacattaggataaatttctatttaaaggaccctttcaataattgcttttgtactgagaacaacctttgctagatttttaaaagtgggtatatgcaactgaaactttattcaccatcttcagtatagccttttacatttggacttcccattgaaagacctcattataggtgacttcatggaggcaactgttgctatctttgaacataaaagagttgtcagtttacatgagagcagtcttttgactcagaagaagggaatggtatccaataaggtatattaagatttagtttttagtgtaacttctttgaaaaaatgaaataggagactagttgagattgtcagccccaatttgtgtctgcccaccatgatggttttcttttataaagcaagaattttaagaagcagaggaaatgaagacataaaatgaagtgtatgtgaatgaatggaagagagatgaagatgtcccagtggtgagcgttatatgaaattaggctggaaaagtagatagggtaagaccatgatagtccttgtaggcaatattgaggaattctggtgcttaacttcaaaggaaaggaaagaaactacagaatattaagcagagaagccatgatacaatttgtattttggaaagattttctgattgctgagtggagggaagcaaaagaagttgcagggaattcagctaagaagtgatggcaggcaagagatgattgaggtttggtctagatatggctatagtggagatggacttgattggatttgagatatttagtgggttatatcaacaaaattcagtgttaaataggcaggtgagaaagatggagaacctgtaaggatagcttccagctttccgacttgaaggcatggcaatcataagtttggttttaaacaggttttgtgtaaagaacttttgagataaccaattggaaatgtaaagtgagctgggcgcagtgactcgtgcctgtaatcccaacactttgggacggtgaggtgggcaaatcacttgagatcaggagttcgagaccaacctggcaaacaaggtgaaaccctgtctctactaaaaatacaaaaaattagccgggcgtgctggcgggcgcctatagtcccagctacttgggaggctgaggcaggagaatggcgtgaacctgggaggcggagcttgctgtgagccgagatcgtgctactgcactccagtctgggcgacagagcgagactccgtctcaaaaaaaaaaaaaaagtaaaagtaataagtaaataagtaaataaataaagtggatggcagacatgaggacctgaagttgaggatgaagtttgggccaaggaagtatcttcggatgtcaacaattacggtggttattgaagtccttgtcatggatgagattacccaagggagactcagactgagacgttgtggagattaaggagccctgaggagcaccgacatttagagtaggggtaaggaaaggagccagcaaagccttgaatagggaaggtcagaaggcagacagacacctggcagtatgacatcattgtatccaagggaagagagttgcacaaaggaaggagggaaaaagatttgatgtctcagaaagagaatgagggacacatgcaggaaaggaaacacagggcacatccctttcctctaaataagaaagataattgagcatcatctttttttttttctttcttttttttttttttttaattgagacagagtctcactctgtcgccaggctggagtgcagtttcgtgatctcggcttactgcaacctccacctcctgcgttcaagtgattcccctgcctcagccaccccagtagctggaactacaggtgcctgccaccacacccggctaatttttttgtgtattttagtagagacagggtttcaccatgttggccatgatggtcttgacctcctgacctcatgatctgcccgccttggcctcccaaagtgctgggattataggcgtgagccaccgtgccgggctgagcattatctttaaatggttcatagttcgactaattcacgggagattacaggtcacatcatataaacttgctgctgtttcactgaatcagttttagtgcactaagcaaccgaaatggtagcaacagcaacaaagcactacgtaatagcaaccagcacacactgtcaggtttaaacatgatgctcaaattcctagctcctgacaccgtcccacacagccgccaagtacactacctatcaaggctgcctgagcactgcaaactgatctcatgctctgaggcctgcctcatcgccttgccctcctcccacacagccctaggctcgctgcccgttgaggtggcaggcagaaagcattgcagctctggggtcatagaccacagatgggtgggcagtcctagggtggaaatagttcatctggtatgagcagcaacctgaaagtcccagacccttaatctcattgaaaatctcatgttcctctcacaattctttctgttcccatctcaccatggatttttttgcttggaacattagtttttttacactgaatgtcatatatgtagacaatggaaactttgtgtaatgtattggggaaatttgaaagtaggcttctggacgtcagggagatttctgtatgttcaggttcttgttggcttttctttttttttttttttttttttttttgagacagagtctcgtactgtcacctaggctggagtgcagtggcaccatcttggctcactgcaacctccgcctcccaggttaaaggattctcctgcctcagcctcccaagtagctgggactacaggcttgcaccaccacacccagctaatttttgtatttttagtagagatggggtttcactatgttggccaggatggtcttgatctcttaatctcgtgatccacccacctcggcctcccaaagtgctgggattacagacttttcttagagtcagactgcctatattccttccttcctttctccttccttccttccttccttctttccttccttcctccctccctctctttcttccttccttccctccctcattccctccctcaattcctttctctctccttctatccatcatgctatccaccatctttccatccatccatccatccaagcactgcattaggtacagtggggatataaggtgagaaatgctgtagaagaagtaagtcatagacataaacagtgatgacacaggatagaacgaggcaaatgctgagagaggtgaggatgaagtgctctgggctttcacgggagagagaagctgccagaaggtatccgcaaggaagtgcacaatctgatttatgcacctaaaaagaagactggctgttacctggaaatagatttagggagggtggaagcagggagtgctcctgataaaggaaatagcaagcctaaaagccagaggtgggaaagggttagtgcagcctagatctgtgcattggagcccagtgaactcttgatgaggtaaagttggaaaggttggcaggggccacatctgctgagttttgaaagaagtttggatttttaattttgtcattaccgttaaagcactaaaaagcatgatgatttcacagattatacaaagacagcgattagatcaccttagtgaaaagcagagcatgtttttcagtttagaacaatagaaagagggccgggcgcggtggctcaggcctgtaatcccagcactttgggaggccgaggcaggcaaatcacctgaggtcaggagttcaagaccagcctggccaacatagtgaaaccctatctctaataaacatacaaaatcagccgggcatggtggtgggtgcctgtaatcccagctactcgagaggctgaggcaggagaatcacttgaacctgggaggcagaggttgcagcaagccaagatcgcgccactgcactccagcctgggcgacagaacgagactctgtttcaaaaaaaaaaagaacattagaaagaggacctgcttatagaaacacaatcatatgtatgccaagtgattgaaatttctcgtaattgtatgcctcaaaagggcactgtttcttatgggaaatttaaaatgagatcccgatgaactgctactactgatgatgattatttcaaggccttgtcctgcgtacaacctgaggaaatattttctgtttccttttattctcctaaggccacagctgggaaaccgcctttgcccctttgcttcctgtcctaacctgttggagctgcgtgttttagtgaggggtgggagtgttgtgaagtgagcccgagggatcctgctcgcctcactctattgtttaaggaggggctccagctgctttgatctgcgtctctgggtgagtgtgggtggtagtgggcagtccagcctgtgtctggctgcctggcggtctttcctaagaagcaccttgagggtcagcaactgtgtgctattatagttattattataataaatgcttcagtgccagagaagtagcatacagcagtcagacgcaattaccatccacgcacgctttactagacttaaagaaatctgtgaaaatctgactcaaatgactccgtttcagatgggtttatgtaggacttgaggtaaacttgcagagtctcatttctttggctgtggagagaatgctggctggcagaatcaaggatttggagggagctggagtgagggggcagaaagaggagaggatgaaaccttgaagaagtgtccctggctttgtaccaatgaatagtcaaaggaatgatggatgggacctagaaccagagttcagtgaaagatggagagaaacctgcttgttttgtttactgaccttagaatggcttcagatctgttcagggtttgagtctgattttttaaattttattttccgatgatgtgcaatatcttaatgccagatcccgaacccatacctgggttccaacacacaaatccttgcatgagctctagaatatactgagctttttcccaccttgggcttttaggcttgctctttcctttgtcaggggcactccctgcttccaccctccctaactccatttccccataacagccagtcttctttttagatgcatacatcagatcatgcactgattcctgttcaagtaggaaaacatggataatatgatacatgcttgacacaggcaaatatctttggaaaaataaaacattagcaacccccttggctgggtgcggtggctcacgcctgtaatcccaacactttgggaggctgaggcaggtggatcacttgaggtcaggagttcacagcctggccaacagggtgaaaccctgtctctactagaaatactaaaatattccattgtatttcagaagattataaaagctctaaggtgaattttgaagtcttcatcagcatatccatattaaaaggagatgacagaagccaaaataaaagaattatgggctgacaggcaactggattaaaataagcatcagtttcattaaaaatggctaacttgaagataaatcttttgactccagcactctagaggatctaaggtgaccttgatggacagtggaagaaatcacaacatggaactccctgaataaaaatttattgacttaaaaaaaatactaaaattagctgggtatggtggtacatgcctgtaatcctggatgctcgggaggctgaggcatgagaatcgcttgaacctgggaggtggaggttgcaatgagctgagatcacaccactgcacttcatcctgggtgacagaatgagactgtctcaaaaaaagaaaaacagcaacaacaacaacaacaaaaaaaaaaaaacaaagaaaaccacacacacaaaaaaattagcaaactccttctttgaaatgttactggctcataaagtctgattgttcaagcatgcagtatagcctccctattagatgtgatgtttattaaattaataaaataaatatacatctcattgaccaaggataaaagaaggaagggggaaagggggcttaaatcagcaaaacaaaatctaccgatgaggtactttggaaataaagatgatttatcaggaaagagtaaaagaaaatctgcaataaagtgatacagacaaatagtttgatgtatttgttatgtaaacaattcataagaaaaacattgtgccataagaaaaacatagataaatggacaaagatcatgaagcagacaattatgaaaatagaactaaaacagcaaactggcatatggcactttctaccctccttcccacccatcttactacttcccaacttcctatgcctttccactgctttatatatttctccctaacaaataccactatcctaatattctctcttgatattacttatttatcttgtttattttctttccccccaaattgcatgtaaactccgtgagggctgggacatctgttggttttgtttgctactgtatgcatcccattgcctagaactcagggaaggtccaagacaaccatctatgggttttttaaagttcaacagaacattcattcattcatttgtttgttaaaaaaagactaaatgcctaccatggaccaggcactgtgtgatataatagggcttcctttttcctttttcaaaagcatgagatgtgttttctacctgttagaactgcaaagttgagtgcagagatttgcctgtggacacagctttgtttcaaaaatatatatttttttaattttggccaaaattttaaaaccaatagatttcatacacaaagctggatttctgtcttcttttaaaagaagagttgatgttgactacaacaggcatcaattgcatgtggctgcaactggcagggggtgaagtgctgcttcttacgccctttgggcagaatccccaccacttcctgttgccttactctaagcctggcagtgccctttggcaactggtagttgccaaaccatggtagtagttgggcaggtattggtcacagaataaagaccacatacaagctacattacaccgttttattaagcccagttgcaggaatattctagaattttaaatagaaaagttgtttcctgccccccgccccccctcacccctagtagcgagagtaagtaataaatggttttagggaagttagtctcaatttgggagatggtttgagagagaccatttttcaaacacattaatgatgaaaagcatcattccatgcaaaaggagcttggaacaagctctcccatcattttcttggtgggaccatttcaaagactcaatactgagttaagtgcaatatagctgggtgtttaatctcagtgcagcttggtaacttcaaagtcctgcaggcaaggctgtagagagtgtcttcacggagttctcatgcaatgcagatacccaaggccaatacattccccagacatgaggcccatacatcccctcactctagatggcattgcccttggctttaagggagacccatttgaaaggaaaggggtatgtttgcaataggcttagaatctgttgggcaggctctggaggggagatgctggctaaggacctccatccctggaaccgtaatgcaactccattgaaggctgtgcatttaaaggacaatggggcaggcatggtagctcatgcctgtaattccagcactttgggaggctgaggtgggaggattgcttgaggccaggagtttaagaccagcctgggcaataccacgagaacctgtctctaccaaaaagtaacacatttagttgagtgttgtggcatgcatctgtggtcccagctactcgggaggctgaagtgagaagatggcttgagcccgggaggttgaggctgcagtgacccgtgatcacaccactgcactccactctgggtgacagagtgagactctgtctcaaaaataacacaaaagaaaataggctgggtatggtggtgcacacctgtaattcccagcactttgagaagccaaggtaggcggattgcttgaatccaggagtttacgaccagactgggcaacatggtgaaaccccgtctctacaaaaacaaaaaacaaacaaacagaaaaaaaaaaaaaaaccactacaaaaattagttgggcatggtggcacacgcctctattcccagctacttgggaggctgaggttggagaatcgcttgagcccaggaggttgaggctacagtgagctgagattgtgacacagcactccagcctggacaacagagtgagatcctgtctcaataaaaataaaaattaaaataaaagaaggacacctattattttcaaagtagagctttagaggaggagacagaagagggatgtgatagaaaaagattataacaagtttatatattttgaaaagattgctctgaataaatatataatgagctgcccttatgaagttaatttttaccaccacaaagcatgttcttttttttttcttttttgagacagaattttgctcttgtcacccacagtagagtgcaatggcacaatctcagctcactgcaacctcctcctcccaggttcaagtgattctcctgcctcagcctcccaagtagctgggattacaggcacctgccaccactcccagctaatttttgtatttttagtagagacggggtttcactatgttggccaggctggtctcaaactcctgacgtcaggtgatccaccctccttggcctcccaaactgctgggattacaggcgtgaaccactgtgcccagcccatgttctaaataagaaaggcacaatgaaaaatttgtagttattttgagattgcttccaaaaggcatccagggcagggagggcattggctcattgggttagccagatgaagaacctcgcaaggactgctgaacagtgaatttagctcttgtacgtgcatagtcatgtacttggtacaaatttcacagcacatgacagctgtgtggcacatctgttggagatccaaaaaatcagtttcacaagcattggttgggaaagattcagcttggcactagttctgagaaaagccctgggactttgaattgtgtgcaaatgtaatatgctgtaagttcactgaaatgttagtctttgcccatgggataaaaatatctagtcctgttacaagccaagctgtttaaatcacacttgcagtactggtcatatgaagaaggatactggaaattagaatttgttcctaggatggtagtcaagaagaatctagaaattatgacataggaagtggttgaaagacttggagatgacagatctgtagtccaacttgaacaggaaaagactaaggagggagatgccatagctatcttcagattcacaaaagcctgatgacgcagggccctttggatgtaaaacaacacccaaagattatgtctgttggataaataaaagaataaaaagagagtaggggtgtgtgtgtgtgtgtgtctgtgtgtgcctgagtgctgtatgtatctgtgtgtgttgtgtgtgtatgttttcaggcaagagcaaaaacacatgatgaaaattacagaaagagaggtagatttaaaacaccatataaaaatgttactgtttgtaacaaccaagctgaatgaccctctattagggatttataaaaagaatgtctacatgcaatggtaaactcaatcttgagaaggaacataaaatggaaagatgagggctttggagtcagacacatctgggagcaaattacatctttgccatttagctgtgtgactttaggcaagatacctagcctctctgagtatttgtttttccatctattaaatggggataataaaacccatgttaaaatgttgtgagaattaactgagctgtcgaatgtaaagtcctagaaacagtatgctttggataagtgttagctgacttttctagattagatgtcatccaaagtagaaagagtgagttatagaaattactgtaaggcagtcacttagcaggtccattagatgtacgtggtcaccgctgggcacggtggctcacgcctgtaatcccagcactttgggaggccgaggcaggcggatcacctgaggtcaggagtttgagaccagcctagccaacactggcgaaaccccatctctaccaaaaatataaaaattagctgggcatggtggtgcgcacctataatcccagctacttgggaggctgaggcaggagaatcacttgaacccaggaggcagaggtttcagtgagctgagatcatgccactgcactccacactccagcctgggcgacagagcaagacttggtctcaaaaaaaaaaaaaaaaagatgtacattgtccccttgtattgtcagtgcctgacacagagcctgcacagggagccactcagcaggtgatggcacatctgttgactttattgtcagcactatggttaagtcacgccctagaaacatattctcaatatggcagcatggccaacagagacagcctgtgtagggaagggaggttggtgttcgcatcaggcagaggttcaaatctcagttctccactgggtggagttacttcacctttccgagctgcatgtttctcttctgaggcagtacgtgtttcatggagtgagtgatgaaatcgcatatgcaaaggcatttgatattcttttcccagagggatcctctttacaatccagggaggcagataatgcagtctgtatggaagaaaaaacaagattcagaaaattgaagtgatgtgcccaaggaaatagcagaattggtatttgattctttccttttaacctgaaggcccatcatctctctctccgagaccatgacggaaacattttttggtgtctcagtgtgccgggtactatgctgggtgtttccgtgtttcgcttctttgctgttcgggtccttatggagatgttagtcactttgcgagtctctttggaacatctgcaggatgggcttcctagatacttgagaaaggtcattcttcatgggacacttggctttgggaggagacatgtgcccagacggtcacgtccactcctttgccttgacgggcaccggtgggatgggtgttgtgtatcttgagcagcgacaccatcggctaatagctgtgctgagtccgcagctgcccatcctcaggtctccgtgagcccacacacttgctctgtgggattgcagtgttttgaaatgaactccttgcaaacatttaaatcagaaatatccgcataaaaatgtaatttaacattttgggtttctctcgaggaactggacagtctggcaaccctgagcccatgttctcccagacagcagcccaccagcattgcatagtgcctacttcctttaagtggagcaggcgtccccggggtccctgcactgccaattgcactcccatatcttcctcccgcaaggagtgtaggttaccatatagtactcatgcataatttctatcaataataacataaacacctgctagaacagttcctgaggtgtttttttttttttttgacgatctcttttgtatgcttcctccccagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggtagctgaaaaggacggaaagagggagagggagatggagcagtggggagacaagagggaaggaaggaaggaggaaaagaagaaggaagggaacaacggaggaaaaagaaagaaaacagggaaagcaagcaggccaagagggagatgttcaacctcaccaacaactgggaacctaccagacattggtctttttagcagtttcaatctgaaaggaaacatgtttctcttaagtaggggttggtggaaccagttgggaccttgagggcatgttgtcttgaattctaatacaaagagtcacattattaacttttccaggcaggtgacagtcttttgcaagcagatgacaaaggaagcttgcactctttcagggatagttcttcatatccatagccatccatttgaccaacctcttgaaaaataaggaattagaaagatctgtttctagtgctgtgctaggtgctagcaatatgaagttgtactaataaaggagacagacaagtaaacaggaaaattgaagtctttcattaggttgctaaaaagataaaacaaaataacaaataggaaacacctaatggggtggctggttcataggagagctagtttgtttttttgttttgttttgtttttttgagacagggtctcacactgttgtccagactggagtgcagtggtgccatctcggctcactgcaacctccgcctcctaggttcaagcgattcccctgccttagcttcctgagtagctgggattacaggcacccaccaccacgcccagctaattttttgtatttttagtagagatggggtttcattatgttggccaggctggtctcgagtgcctgacctcgtgatccacttgcctcagcctcccaaagtgctaagactacaggtgtgagccaccgcgcctggctagttgtttttttttttttttttaaagtatcccacacagtgctatattcatataactgtaggtctttgctgtacacacagatacatacactgtgctgtattcattgtggacagacagtaaagacaagttagtaaatataaagggggagagagaggtggttctgtaaataagattttttttttaaacggttcatttgtctattatctttctggcattatctacttttctttgctagaaagtgtttaacagcatcctgtgataaatattgatccacttaaagcatacagccttattgcatggcaatgacttagtgtagtaggtctgtggaaccaactgatagctgcagcttgaaagaatctaaaaatgggcagattctggtgcagccatgagttgctggtagagtggtttgggagtcttatagaaaactgggtgaccctgtggtgagataggcccatatcgcagcagtcaccccccaaattcacctaagttgctgtcacaatgtggtttgactcagattagtttagctttgttgtgtggaatttgcatccagaatcttttggatttagcagtcctccctatgaatcaaagaacttcataaaaaaattaaaagacaaattattgcattttaatgggcatttaacctctctgaagagctcctattgccttaggtcatgcagcttcattgtgagtcaccagagttgggtcatcccagtgaaatgatcagtgagaatgaaactagaaatttaattggctcagcttgaaagcctggcctgaagacaaggttattagtctcagggtagaccaggaacctgctgcctagcacagaaggatggtaaagaaggatttaccatgtcatctcttctgtttcagcatgtagtctactgcttgcccagtggtaagggcaagtgaaactggctccttctttttatttgggtaatagatatcccagactcagtgggaacagcttggcaggaagtggtggagcccagtattgatttatgtcttatatgatagttaacatgtgccatgtgccaaccctgggccaggcacttttctaggtgcttttaatccagtaattaattaatcttcacaaataactaaagagggggctatgttttttcccatttcacaaatgatgtagcagagacttagggagggaggggaagaaacttgtccaaggtcatagagctaaggggcagagtaagagttcaggaccaggtttgttgacatcaaaggtaataatgtagagtacagtggtgggttatggagccaggcagccagggtgcaaatctggacacaaccaccatcatcattaggtcactctgggcaggttccttaacctcttgctgctccagcatccccatctgttaaagagtgttcatgatattcatgtcatgggatcctgtggagataaaatggtgtttgacaagcacatggcgggcaactcagtaaattgtgaattgatgtagttgtttttcttattaagacagtggggaaactgagacctagaaaaattaatgaatggcctaaagtcttccagcaactgattgcaagaactaaagttgtaagccagatcttctgatcaagaataattctcttattccctccatatgaaagaaaaaaaaatcagaatggcatttttcaatgcccaaaagcagacaatttatgtgtacacaaaaagcttgatggatattatttcctaagatctgactaatgctttataattttccaaaacattatcatagatgatgtccttcttagtcctcataacagtctgacaacaatgtgttaacacatccactgttaaagagatgaagaaactgaactttcagggtccaaactgcagaggctgaaagacacattggtgacagagactgttcccaccatgtgctgtccccagctgctcctcagctgcacatgtcaccaaaccactagcacaagtttaattccctatgtgatttctcagtatcccaattagccagaggatatttttcactttcagataataacttgacagggaaatctgttgtatattccatttcaaatgcaaaataacatgtcttacaaaaaaatgctatcattacatgtatgtcaaatgaagccaatggcattaataaaccccagagtagtcaccaattttggactttatatcgatttcccaaaaatgcagaaattaggcttatttttagattatgactttgtgggctcagcaacagggctgagttaccttcagctcttccaaccacatatttaagccctgataaccttttgcagatactttgaaattcactgcgtgtgcaagttttttcctcccatgacagctaagtttttgaggtctatgtgatattggacttactctcttaattttatatttttttacatatctttgatgcttacagtgtattattcagactataacatttgagtaattatttaaaacatgtttttaaatgcaagtgtatatatttttaaaagggttctcaaaaggatgcaaattctctgtttatatgttttgtttatttgtttttattgggtttgttgttgttgttttgagacaagatctcactctgtggccaaggctggagtgcagcggctccatcatggcttactgcagcctcaaactcctgggctcaagcagtcctcctgcctcagcctcctgagtagctcggactactggtgtgttccaccatgcctgactaattttttatttttttgtggagacagggtctatgttgcccaggctggtctcaaattcctgggctcaagaaatcctcctgcctcagtctcccctaactgctggtattacaagcatgagccaccatgctcggccctaaattttaaatatttatcattttttaataccttcctgagtcttcaaatgcatgtaggctatatctatataaagcatgaatgtgcttactgggacacaaatttgaaacaggaagttattccttatctattctttaaaaccaattgttcacaatccctaagtacagttcatgatgtgggaattggggcaggttgttttttttttgagtgagactttgaagaaccagtgctattattttggaagttttggaacatgaaataagtcagtcatattcagagttagagcctgaattacttcttcccccactttattaaaataattcatttctgaaaaactactgcagggagagttttctgaagttgaaagtgtaataaatttggatgcagaaaaaatgtgtttctgatccccaaatcagcatccattcatgttaaaaacaaccaaatttcatcatgagggacttctatttaacattacttatcagagcattattcaaaaaggaattttccttccttctgctgaccactcacagagcaatgatcatgaagtctctaaacatcaaaccaaatagcctctcttcattctcatcttatttaaaagctctcttgccttaggctctgaaaaccttccttctctcctcctcccctcaccctccttagacctctcctccctgccttccattgctcattgtttgattagaccctgccctgagacttctccctctccaatcatcctctcttaatagatgggctctatctctgtcctcaccacttcccctcctctctccatctacttctggactgatctcacatttactatggcttcctattcagcctgagtgttgagggctcctagatcttcatctctagactctgagctccagatgaacatttccaccttttatatgcccctagaaactcaagttcatatacccaaaactaaactcattatcttctcttgataattcaacctgaggtcttggtcctcctcctgttttccctggtttggtaaatagcatcacagtccagccaggtgtgcactctggggacctgagtgtcatcaatgtgatcctctctccctcatcattcctaacccaagagtcacctaaatctgtttgttctatatccacagtggctctcacaatgcttccctccttctcttctcactcagacccctctaatccaggccatcatggcatgggaggagacatgctgatcttgccttctccaagccatcctgcagactgctctagagttctctttctaagtgcaggtctgaacttgtcactgcctgcctaaacctctgagagttcctattatgcagaaattgatctgttattctgctgtgaacttttaattcactactaaatagcgtgagctaatacatataaagtgcctaactcaacatctaaggagatgctcaaaaaatgtcatttatgctattatcactgaaggctccttcaagccttgcaaagttgatatgtagatgttcatagactcaaactgtaaatgtgactcatttatttcacattccacatgctgcataaagtcttcatacaggcacagaaccgatatctttatcgatttgaattctactagtaaattaaaagttcacagaaagataataaatttaaaaaacaaacatgtagcgactggtcaatgttcccttggcttcatagactatggatactaatcattacagatacttaagatataggctgggtgccctgggtcatgcctataatcccagcactttgggaggctgaggctggtggatcatgaggtcaggagttcgagaccagcctggccaacatggtgaaatcccgtctctactaaaatacaaaaaattagccaggtgtggtggcacatgcctgtagtcccagctactcaggagactgaggtaggggaatcgcttgaaccagggaggcagaggttgcagtgagccaaaaaaaaaaaaaaaaaaaaagatatacagatcatggccaggtgcggtggctcatgcctgtaatcccagcactttgggaggccaaggcaggcagatcacctaagattgggagttcgagaccagcctggccaacatggagaaaccccgtctctactaaaaatacaaaactagctgggcgtggtggcgcatgcctgtaatcccagctacttgggaggctgaggcaggagaatcgcttgaacccggaaggtggaggttgctgacctaggcaacaggagcaaaacttcgtctcaaaaaaaaaaaaaaatacagattattttacaattccactgaattgcaggggaattataaggtagctgaggtgtacctagctagccttccacctcatcttttggctttctctcagctccttccacaacagctcagccctcctccttggcatatacacattagttgaacagatttctgggcacctgccttgtgtcaggcaccatgctgggcagtgggaatacggcaggtgacataaggtgagatcatcctaagtcaagtagggctgaggactggggaaggggtgggatgggattttagatgcaggagtcagagaagatttctctagaaaagtaatatttaatcaagacctgagtgctgagaatgtgccaactaggggaagtctgaggaaagagcattccagactgagggagcagcaagtgcaaataccttgagggaagctgcttagcactttgcctgaaccaagagagctgggtcgctggaacctagtgaaggagggtaggagatgaggtaagagaggtagggtcttgcagatcatgatatgaagttggcatcttattctgcttagagtgggggccactggaggacctaactatcgaattacatttttaaagaatatcctggcttctctgtggagtgtggagaggcaaggatggaggcagggaggagagtgcaaggcagggcctgggtgagagaaggtggagctggaatgggagtgagtgtggaaaggcaggtggtgagacctggcagcatcccacagtgacacattttgttgccctgagtttttcatgaacactcaatctgagaggacccatttacaactaggagcatatctgtaaaaagtggaatcataagacaagtacagtcccctaagtaaggcacacagggtacatctcacttgggggcgtaccacaggggacactctctagcactcctggcaggtggatagttttggttaatagccctttttatgctcttaaaaatcataccacataagcactgacccttaaaagatgactttgcctgccagggataagggagaatgctgctcactttcagatacaaactctcttctaggaggccaatgtgctcattcacaaattttccttgagatcttaaagatttgatggacttcttttaaaaagcagtgagcaatatgctacctactgtcacaatcagagcagacaaagacaaatgcttttatgagtaatttaattcctctccctgaggaagacatcctcagctgtcagcaccatccccggtgacacgcaggcgatgtgaagtgactgttaaaagcagcagatggtgcttcttacttcgtgtttacggagcacccatagggtgatagttgcttccaatgccgcatacattaaaatatttcttcttcttctttcctttcccctaccttgtgggtttcaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctgtgagtatttgcatcccaccatggctgtcactaactcagtgatgacaattatataaaccttagcaaacacttgtatttactgagcccctaccctgtgccaaacactgctttgagagtacatcatttgggctatctactttaatcctcacaatacccctaagaggttgggattatcattatatgcatttcaaagataaaaaacttaaaccatatgaggttaagttgcctgatgttaccggtgaggctggacctaatacttaagctcagagttttgggtccagagcctatgtccttttctctggcaattgcttccctctagatgaactggaagggaggcaacaagtccttcaagtaacctgggacccattttggccccagtgaatttgggtggaactgttctgcataatcttgatcccctttagtttggaatatcctgtatccctgctcggatattttttggaagatgagcatgcattaaatgtcacataaccaatctgcagagatgcagagctggcaagtgttgggatggcttggcaggggcttggcagtgaagcattgggcattggctagcaaggctcccacagaggaggcgcgtcccattgcccactttgctggctccttgctgggacaggagctgccctccagccatactgcattgtcccagttgtcaaggtcccaagttgtcatactctcttggcatttgttctggtccggccttccctgaccctttcagatggtcttcagagatcacccctgccccactcctcctttgtaacccttttaaaacataaccctctgttagctccgcctccccgccccaattcagaatgagataaaacttatcaaggtcctgcaaggtcctcctccctctccaccctcagcctaggtgcctgcttggtttctcgtcactttcctccctgctccctgcactccgcagggaagccacaatagctttccttcccttcttcaaagagccaagtgcatgtggccttggcacatcctggagagctctgccttccccgaagccgtgcagcgcctcctgctccatccccaccccactatctcctcacagaggccttcctgcagcagtcccacccctctgtgttctcactctgctgtttcactccatatcttattttctattcatgtttgtccatttctcccactaaaatgtaagccccctgtgactctgtcttgtttgcttctgtgtccccatgcctggagtgggaagaggcaccttgaggatgtccagtgcatctgcagctggccctgtgcctgctgcccttgcgatccacacacctgacctggcataggactcctatggaatggggactgttcctatttctcttagcatccccggttctgagcacccggtagatgctgaatacgtgtttgtcagatggtccagataagcagtagagagggagctaagaaggaaggaggccgtgagaattcaaagataaagattggcaaagaaattccagccataagcattgctagacttggcatgtgactggatgaggaatgtgagggagaaggaggggtcaagggtgctccaggtttgtgcaggatttgggtgggatcatagggcaggcagaggaggaacggatcagtagagaagagacaataaacttggtttttgagcaatgagataaaacacatgattgcgtgcaaagtgggtgacagaagcagggatggatgagatagggagattgtgccagaattcagtgaaagctctgataccttcattgagaaaatcttgccacaaacaaacaaacaaacaaacaaacaaacaaaagtctattaaacccagcaatcccagcaattccactcctaggtatacacccaagagaaatgagaaggtagatatctgcacaaaaacttgtacacacacattcacagcaacattactcataatagctgaaaagtgaaaacagtaaccaaaaagaatatatgtattctgtcaccaaaaagaatttatgtactgacacatactatgacatagatgaacctcaaaagcatcatgctaagtgaaagaagccagtcacgaaagaccacatatggtataattccattgataggaaatgtctagaataggcaagtctggagagacagaaagtagactggtggctgccgagggctggaggtgggactggagggaagagatgtggcagggtgggggacacaactgctaaagggcacaggatttctttccggaatgatcaaaatgttctaaaattaatattgacggtgatggctgtacaactctgagaatcagctaagaaccattggattgtacattttaaatgggtgaattgcatggcatatgaattatatctcaattgaggaattaccaacagaaagaactgaatggaataaaatagcaggtagatggaattaatcatgataaaaagcagacatcatttaattaaacaatagggaaacaaatgataatttttttaaaaaatgtaaactgagccaaacagtgaaccaaagtaaactaaacagttgagtgatgaacttggtttacattctggcacaaacccctgctctctttaggagtggcagacagttctcggcccagctgctacccaccaagtacactctgagcagcactgtgtaggcaagtgagtccttaagtgtgtgagagaggtccgcacgggcgaggatggctaggagaagcctcatcgaagaaggactgcccagcttcgtgatgtttgctcatgagcagttgatttttatgtgcatagttgtgaagcatttggaagcatgtccctaattttctttttcttcttccccagagactccaagtgtgactgtgacccagctggcatcgcagggccctgtgacgcgggccgctgtgtctgcaagccagctgtcactggagaacgctgtgataggtctgtgtgaaccgtggccctacaaacagcagagagagtcccttgccaactagcatgagaattaatcctccgagtgtaattatggaaaagggatacttgacaaacgttgatgaccttcttcctgctctctgtcctcaaaaactaagcttttacaacaacaacagcaaaaacacacacacacactgagcacccaaatctcactggactccatactctgctctgggcaccctctctttattttgactttgggagaggcacaggaccccagagattcctcccaccagctggctccaaatcccaggtgctctgtatgaggcagtaatcaatagtgagatcctgggacacaggctggttgcaggaaaggcctggcctaattaaacatgctgcgaaaattcttgtaagagggcctatcacagcatatggccatatataaccatcgtgtacagaagaggcactgccctggggataggatggcagttacatgcacacacatgaatgggcatggggctgggaggaggtaagagccctttgggccaagccacactggaggaggtggagcagtgaggcaccatccccccaagctgccggtgcaggacgtgccttaagtacaactgtgctctggctttaaactcttccctcccagaggctgttgagcagagggctgtgaggctggcgtcagaagcaaaggcttcctcctcatttccttaaaagtaagaaagcagttctttggcaccctgccagtcacttatacctgcacagaggaaatgtcaaatacactcctagcttgtgttttcaggggtttctggctgctgaggtgaaggcagggacataaagtttaagtgttaaaaaggaagtcacttgttgaaagcctttttaatttcaaaataaaagacagaaatagaatgccacataaaagaaatgttatcaccaccaatggtaagaaatagacctctgctaaaactgcgtcccagtgacaatgcccccctcctccctagaagtgaccactattctgacttttatggtaatcgctttctttctttgcttcataatttatgaccccagtgtgttcctaaacacaatcatttagttttgcctaattcccttcctttcccttcttttgtcttccctccccactcctcccctcccatccttccttgtttttttaagctcttttaatcagcaggtttcttctccatagaaaccataataattcttttaactcttgctcttagagaaaaaacaaagcttgtttagttacaactgttctctgaagcacctgctcttcacagctaccctgcttttctgtgatactgtactcagaacattccccccaacatgtggtgcagtggcttagactacatgatttggagacagatgtacatgaatttcaatcttgcctcagccatgtacctgctatatgtcaagagtttcttaacctcttggccttagtctcctcatctaagaaaattggaaatagcaattcctcatagggttggagggaggttaaatgagagaacacacacaaggtgcctggcacaacataagtgctaaataaataatcattgaaactatcgttatttcacattatttcatgtggaaggatgtagttaacttgagcagaggacaaacaagtcctccccagcttcccctgccttcttctctgtgactccagcatcgaggatgcccctgttagtcgtggttcttatagaagccactggagggattgagctgggagcagaggtggaatgcaagcttacacctggcttttggagagtgtcttagccatcctttttctttgtcatatcctcacctgcccttttccccagtgagccagagcccaggtacaagagtcagagatggggatcaatacctaagtggtcttggggagggggtcaatagagctgagtggtgctgaggcaggagcctcacctttcctggtccccacctcccagtctttgtcaccattaaacagtagctccaggacagggcagcattgcatagccctgcccacacccattctgctcatctgaccaccactcaatttcctaccaaggactggccgactactcagatgccagaccaccaagacaaatgtggctctgttctacaaaggaacagaaagtgaatgtttcttatgccgtctaatttaggggggtcgtgattgtccatctggtggtctgggggtgggggtgatatgcaaaatctggtatttccctcctctgaaaattaatagggccaaatggaagagaaggtagagaggctgactcattcatcatattttttctatagaataaaaaataacctataatatcctgatttctacaatgccactgcaggtgtcgatcaggttactataatctggatggggggaaccctgagggctgtacccagtgtttctgctatgggcattcagccagctgccgcagctctgcagaatacagtgtccataagatcacctctacctttcatcaaggtaaagccttctattttctaggttttagttttttaatgttgtacagggctttgtgtttagagacaaccacctccgcattcacaggatggattctctttagaaattctcttatagtattgaatgtacattattttgtcagggcactcaggcatatcctgatgtcttgaaaaagtcataggctgaaaatagttcattcatactagtgaatataacttaaaagaataactaaaaaagagactagatttttatttccctgaattttccatccccatctatttcaaaaccacgaaggaatcattcatttggtttggagagtgtatgagtcttcctggaattcacgttcactaataatgctgttttcacatataataaatgagctgatttatgtgaaattagttcccaagctacagaacactataaaaatattggaaactgatattatttcaacattaagtctgagtttccctttgaaaagactggacccgggccaagcgtggtggctcacacctgtaatcccagcactttgggaggccgagacaggtggatcacgaggtcaggagatcgagaccatcctggctaacatggtgaaaccccgtccctactaaaaatacaaaaaaattagccgggcgtagtggtgggcacctgtagtcccagctactcgggaggctgaggcaggagaatggcgtgaacccgggaggcggagcttgcagtgagccgagatcgcgccactgcactccagcctgggtgacagagcgagactccgtcttaaaaaaaaaacaaatgaaaaaaaaatgaaaagactggaccctctcacttcattaaggtgagagctttttatataaatacaaaaaaatgcaaattacaggcagaagaaaacctgctatcttatcacgagtcagactcaaagatgagaaatcatagcagctgcgggatgggagcaggtgaagttgagagccacatagagagatacatgcagaattttaaggaccatttgcaaatgtggaaatattgagaaaaccccactttctactcaccactaggacttgtcggcaagcaaatctttctttgtttaacttaatagatgatgagggcttgtccaatgcagactgattatgtttgtgttccagatgttgatggctggaaggctgtccaacgaaatgggtctcctgcaaagctccaatggtcacagcgccatcaagatgtgtttagctcagcccaacgactagaccctgtctattttgtggctcctggtatgtgaggaataatgtctcctatagaggccagcttataggactaggaagtcaagatagagaaattgagttagaaattgtggaaaccatataactttgggttcagggtagcagcatctccgggtagtgcaaccccagaagagagatgggggctaagcctgatttgagagtcactaaggaatggcccaacagagcagaatgtggtgtcccagaggtcagaccctggttgagctacctcctttaatcaaatgggaagtttctacgtttaccaccaaggcaagaaaccaaggactgtggccaaacctatgggtctattgagaagtaggtggaaagcaaaaacaaagcatttcttaaaacttcaaatacctgtaagttaaaaaaaaaaaaatcaatcagtggtacgtgccttggtggaaaagcgctggctagaattccgatcccagttcgtttccttagctcatatgtgattcttgggcaagttgttctcttaacttctctgaacttcagttttctctactgttaaatgggaatactaatgtctgcctcccagaattattgccagcaaatgtgatgatatttgtgaaggcattctgtcaactaaagcattatgtaacaagttgtgctatgctgataggcctgggatttttacaaaacagtctgtcataagggccacatcatgaatcacctaatagatggaattgtcttataacaaggccctcttatcatttcagtaactaaccctccttcatagcccaaagtgtcatagccatgtccagtaccaggtcctgactctcctagcaaggagttttggggcagcatgacacaggacttcaacagaaattgccgacaccagtgcaaacttgcatgtgtttgcctctccagtttcacaactgatctcaatcttttaaaactctgtttcacagccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggtaaaaagagagaccataagtaggtcaattagagcaaactatgattgaagttcaagtttgttctttattcattcaatcatcattcatttgttcaacaagcctttctgagcaccttttacgtaccatgaaggttgctatgtgctgagaaaggacatgattccttccctcaagcagctgacaggctaatgggagagaaaaatgaatagataattacagtgcagtttgtcaagggacagaaataggcaaggtggacacagaagttctgagcacataaaggaggcatgactgacccacactggaatgatgaaggaaagcttcccaggaccacatgacaaatgtgaaaggcagccctctaaggaaagagaagggaggaaaggttaacaaggcagaggaaatgcaatgcttgaagaaggtttgtgcatttagaaaattccaggtggttgagcacgagtgaagcatgaagtcggcgataggagtgcagtgagaagtgaggtaggagaaagaggtgggagtgactttatggatggctttgtgtgtgtctacagggattgcacagtatcctgcagaatagggattctgcatggtgtttgcagagaggttggggaagggagctgtgcctactaagtgctcagtagtgcactggaggctgggaaataaagatggaacatggtctttgccttccaagagctcatggtctagtacaatgtataacatgtcaaaaagcaagcataatacagtaggataattgctttaggggtggtgcatgttcatggggtcttggaaagtgcccgattctgcctggaggagtcagggaaaccttcaggaggaggcaatgtgtggtctaagaatggaaaggtccacagggcttttccagggagaaaagtcagagaagggcaaccttcacatgtgaatatatgtggggatgcagaaaggcataatataggggagaactggcaagcaatatttatagctggaatacagcatgcataaggaagatgggtagatacatttgcaaaggttggaaaaggacccatcatgttgggccttgtgtgtcatgtcaaggagcttagatcttgtccatgctggaaagacgatgcagagccattgagagattgttaagtcaagaagtgtgatcgtcaggtgtgaaggctaggtgcaactacaggcaccatatagatgatagtttgggtcgggtccttaactggaccatcagaacacattcagagtggctcaactgagagtggttaggtgcctaacccaaggcaggggtaatggcaatagggaaaagaagacccacagaacacaaacaaagaattgatcaaatatccgagtatacgtgttctaatgatacacacacacacacacacacacacacacacacacagctctcctgcctggaatactcgttcccaccttccaggctttgtgaacttactctttgagattcagcttacatgttcttcctttgtattagccttctcagaatcccagctaaagttacagtcactttgtttttccatggtactctgtgcatgcatctgttatagcattcatggcattgtattataactgtgtctacccacctgactcccctggctggatgtgatcatctctccctgttgtctttgtgtcctccagcctgacatagcttctagcccaaaccaagtgcacagtcaacttttatttaacaaatcagtgaatgaaacgaaggtgggtagggttgttcctggatgagtaaaaaacaaaacaaaatttagaagaacagcacaggggctggtgatatgttacagtgagccaaaatgatgccaaattaaaaagtattaagtgtggacaatgtaaaagtggaaactgatttttgaaaaaagtaagtaaaatgtgctcagataacaaataaatgattttttttaaaaaaaatgaatagtagctcttgagaatcagaacttctggaacgtggagatgttcctaatactagcttatgggtggccaagaatagaaagtggtgtctgagaacttgcgatcatcatggtttcaggtgatgtcacccctggatctggacttcccacactgggatgccctccatcacttcctctggggtttgtcctccccatggagtgaggaaggtccaagtacatgcctatgaaaaggtggctctcagtcctatgcccccttctaagcaggactgggaaggggcttagctgttcccgtatcctcaggcataatttataacaggtaggtatgtggtaagaatcggatttttaaagcttttgattttaaattatgcaggttaaatgagcatccaagcaataattggagcccccagctgagttactttgagtatcgaaggttactgcggaatctcacagccctccgcatccgagctacatatggagaatacagtaagtggctacgagaaattaatttctttcttcttaggtgttagtttaatttgattcagctctctaaggtggcggcagtctccaaacaagtagataagttacttgatgatcctgacttagaatcactgattcaatctgaatttttatattctagaagcttttttagaagaaatgtttctctaaaaagatgtcagcacccagcaccaatgaagagtaaatgatgctgtcttgctaaaagggccactgaatttttattaaagatgattaagtgagaaagataatctacaataaatggacacatttccttagctaggaaatggcacctacaacacagtcttatttattccttgagcagcttttccttttgagattatactccatgctagcctgtctgagtcatcatgtattctattaattccttttttttttttttttgaatttcacatgttgggtcctcctaatctcaactggaattatttaacaagagttccttaagcttttctgcactcactcacctaaaaaggaagcgtggctagcatgcaccatttccatgtcactgatgcagtaaataaagtcggaagcagaaaggtgtaacaatgtattgactcttactgtatgccagatagattataatatatgaattatctaatttaattttcacaacggacataagagataaataccaccgttacttcttgtctatagttgatgaaacacagtcatggagaggctaagtgacttgcccaatttacacagctagtgagggtggattcagaatttaagccctgggttttctgaccccagagcctgtgtgctcagtcacagtgggagactgccatacctctctacatggcatgatatatgaacaccacctgtctttgttagggagttaagaaaaataaaatcccaagagagatctgacttgagatctttagactgtaccacttgcaacttctaacctgttctctcgattgcaggtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggtgagtgaaatgacacctggaccaggtggctggggtgtcatgtggaagagagagagctgtgtaagaaagaccatggctgaactcacatcagaggtgggaaaggattaaggagagcagagctggagtcagggaagatggacatggtgccttattacactcaatcctcttcactgtggaaatgccacaaagttgtgagaaaggtgccaggttacaggaaatggtcgtcatggttcagtgctgggtagaagagttggtgtcgagttccaagaattgtgtggggagatcaaagacaagtccgggtctaaatgaatgtgccgacaaatggtgtcaggccacagagaacatggggaacagtgttaagttatggatagtaaaagaagtgagtgtctactttgcataggggagtgagggtgagattcagggtcttggccatgtttagatttggttctatgggaggggtgaatgccagtgctcaggcactttggggaaggcttcagaaaggaaggctttgacattctacactctgacccatgttgaaggaaatgtattgtctgaccctgctcacttctctgcccctccactcttctcctacccccaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtaaggccatgggtctgctctgccacctgcctcttcctgtcctgatgccatgaatgtgtgcaaatagcttccattccgaggaattcctaggaaattataatgacttcgggttcacccaaatgtgctcactctaaagataatatcttaaagataagatattgcaatgcccaagaggtgaagtggattaagcaagagcagagtgcaattatgggagaaaacacctaaagctgttttgagaggtttgtcattagaagatgacattttcagaccaagcacatggtttgtttcttaatgaactaagataacgagggaaaacttagtgacttcttaaatgtcacatccttctgctggtcaatctgaaagaagaatggattcttcagcagcagttttgggggtattgctcaaaaccttactacttctgtggagctgcctgctttttcccagccagctagttaagcctcctagtggcgctactgtgttctgcaacctgcagtgggcatggagagagagggccagccctgccttgcatgcctgctcctgagggctttgttctggggtccctagggaagcacatttctctggctcttctagagggtgactcgcaactttaggcctctgcgtctggtcttcctcctgatggatgtcgacctaggcttggtcatttgttccttcccaggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgaggtaggactccaccccaggcaggctgtgtctgtgcgtgcctgtgtacgtatgcacttgcttgccatctaagcagggacaatggcagttcatatcatgatgttactttgattctctgaccaaactggcctgtgagcaccctgggcctttcttcctctgtcaaaggccttaagacaggtttaccctgtagccaggctctggaagacagagctgggttaaagctgggtgggagaagtgaaaaaggtcaggtttacattcctacgcggaaaaggatgtaacacggggccacatcctatgcccaatcccaaggcagggaggcagggaagtggctgccaaacctgttgtaggagagtaataaatgacttgagagtaagcctaagcaaactcaagtgggaaggggagtgggctgtaaaatagtttaagagactctctcaggaagtcagcgtaattgatgtgtagaaaggtaacagtcaacagttctcctaacaagacagcttcaaagcagcagctatagtggagcattcctgaggcctgctgcagatcaaagcatgaatgtgcagactggtcctcttgcccagcgtttctttcaaatctttgcacatgttatattttagaggcaagttcagttctagaggagctggcctgccccacagactcacccctcagtcccaggctgaccttggtgcccagaactcaggagtttgtttaccctaactttgtttataaagtccagaatggggccgggaatggtggctcacacctgcagtcccagcactttgggaagctgaggtgggtggatcacctgaggttgtgagttcaagaccagcctggccaacatggtgaaaccccatctctactaaaaatacaaatattagctggacgtggtggtgggtgcctgtaatcccagctactcaggaggccgaggcacaagaatctcttgaacccaggaggcagaggttgcagtgagccgagatcatgtcactgcactccagccgggcaacagcgcaagactccatctcaaaaaaaaaaaaaaaaaaagtccagagccactctggacacccaggttggaagactcttggttcctcatgaagacccagaggtttgcatggagctcacagcctcccactcacaccagagtctccaccttgaagtgcttgaggacctctgcaacctgaggcttctacttagtggtacaaatcccttcaggaattctaggccagaccagcccagaccccaaactctgggttagctgtgatatgctagaaagcaccttatgagaggaaaagcccatatgacaccaacaggactgagttcaagtccagttttgtaacatacctattatattatgctaattatgccaattaatccctctaagcctcagtttccttatatgtgtgattaatatttaactcgaagtggtggatacaagaaagcacactataaacactataattctagttatatattctaactatattctgtctttagttttagctgtaattctaggttactaacagaaatttcactggctttacaccacacatttcttcactcaaccatcctttatcaagcacataccatgtacccagtgtggacctagatactgaggccataatggtgaataagtcatcccaactctcgaagagtccgtatgataataaggaagatacacaaatatgtatgcaaataatgataacacacttagatacgtaatcagcgttttgtgagcactgaagatagaacaactcagagaatcactgtaatcatcagagaagtgtctcacccactatcatatccttaactcctataacagaacctggcttaatcaatttggttgaatgagtaaaggtattgctttcttaactgtatttcctacaccaaaggccgcagaacagaggaaagaacattggctctgcctgacctctcattgtagcttgccatttacttgccatgtaacctcaggcaaattagtcaacttccctgagctcacattcctcatctgcaaaatagagggggatgtctacatctggcacgtaatgggcccagaagaaatgttattcaccttgaaagcaaagccagagtgcttgcagaatatctaataggcttttagtttaacagggggaggaaaatgagtgctgccagaaaggctgtaatctccctgcatccacacacaccaggcaaacctgccacatgattcctaagacctatctgtattaagaaggtgcatggaggtataaaaggattctctgctgttggaggcttgatctccttccttgtatctttgctctacctccactttctagactagtttgatgtgaatgctccatttgtcttttgtctctagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcaggtatgcattcttccccttaccacccccaaccccacagaatcaaatccttaagtgtccactgggtggttctgtcacagatctaggacactcctagtctcctgaggatgggagtagtgattactatttctgtctttaaaaattgctgcattaaaaaaattctgtataatgataatacttcaggtttatgtctttatatataccattttcaaaacctcttttgcagatactgtttcatttggtactcatgataacttagttgagttgaaaggaaaagtattctgacctcagttttcactggtcaaataaagtctcaaaatacttgaaatttttcaaagtgatatgggtaggtggaactgggaatcccacccatgtcccctaacttagttcagggctcttcccactataatatttcactttccagctcgatttcttttcaacagatgtctttgtaaaacaaatgaagaaaaacataaacataaaagatatcaggagtccagaaagtatcaaggcttcccaaaaaggaatggcctccagaaatttctcatttgaattacagagaagaatgaacttgatgttcttgttaattattaactatttttcttcctggaatgaggattggggaagacaaaggcccaaacagaactccaaatgtagagcaaactcaacttgtttttcaaactgatctatttaacaagccttttacgcacttcctttgtgtcaggcactgttctcttgtctctagcttgcaactgctttcactttacaaatattaactgcattttgagctttatagatgttaacccaggtagtccaagtaataactttaggagacactattcttattttcattatcctaattttatagataaagaaagtgacttgcccaaggtcatacagctagtgagtagtgaggccaggattcaaactcaaggactctctaggctccagggtctaaaattttaaccaccatgacatgctaagcatttctggacttttagtattatcccctgggtacctggtattggatgatcccttgggtacatggtctccaccctcgttctgatctttcctgtgtggtttcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgatgaaggccaacttcccttcagacagaagagaattcatagtcctagaaggaatggctacgttaggtcatagaatcttctatggatatcagttcagcagttatctccagccagcccttgcagaagtggaaggactgtctgtggcattccccctgggatctgaatgatggtgataaaagaatggttggatgcatttctctattgggtttttgtcatttgaccataagccagtcaaccctccgttatgtttgctaactctatgctgacccagaaagtgctcatgctccctttccttctttgcgttcaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactgtaggtttttgctgggctagagtattgagaatactgctgtgttgggagacctacttgtagatctcactgactcaatttctgtctctcagtggctcactttctgtttctgatctacctgacaggttgttggacttcttttccttgcaacagtcacatctatttatgtctttggccttctgaagtttcctattttactgcattatgttcttctcctaagttcatttatttctaactacatcctcatcttggccctgcctcacctcccttctgcatatctcctagcttgttagctcccagagggcaggatttactttagttcatatttactttctcagcctacaacacagtgtatagctgtggtaaatttctagtgtatgaatgaatggataaatgaatgaatgaatgaaaaaggaaggaaggaaagaaggaagaaaggatggaggaagggacagagggaaagaagaacaaaggaagagagtagggaaggaaggaaggaaggaagacatggttttgaaaatgggaaaaaaatgctgccagtatgattttcttgatgtagtttgtaatgtggtaggagggagagatttgattgagcactcttctatttctgaataaagaaggttatggtaacaataatgtaaatggatgggtgggagatgaatagaggaagtggaatgataatcagatactataatgaggaagtcacattaaaaataatgtgtattgattgtttcctttattacagaaatgtttgttgtagaaaataaataaaaattctctatgatcccattactatcaaataaccactgttaaaatttggaatatattctactggactttaaattcatataaaaaatgtacatgtatatatttttatttttattttttttggcttccagcaggaaaagaatttttattttactttgttgttgttttggatttttttatgtatatatattttaatgcatctatatctatatacagacttttttgaacttggatttctttgctcttgtctatacatactttttttttcttttttttttttcgagatggagttttgtttttgttgcccaggctggagtacaatggtgcgatctcggctcactgcaacctccacctcccaggttcaggcgattctcctgcctcagcctcccaagtagctgggattacaggcatgcaccaccatgcctggctaattattgcatttttagaagggacggggtttcaccatgttggtcaggctggtcttgaactcctgacctcaggtgattcacccgccctggcctcccaaagtgctgggattacaggcatgagccaccacacccggcctatacatactttttaaaaatagaataatggtgaatagaggcatggtgtaagtgtcagggtgtggaaccctgtgtggctaatgacaagtggttctgacaggacagatgcacctgcttaagttccatggccaagtgcaaagccttaaccgattcgccttaaccgattctccttttcccacagaacattcctgcctcagaccactacgtggggccaaatggctttaaaagtctggctcaggaggccacaagattagcagaaaggtgagcagcattagagggcacctctgcttcaagccgtctctgcaaggccagacttgaataagagtgtagggtattagggacccaagcatcgtatttattctctccaggctcctttgcagccattccctaccttgaaaccagtttttaaccacttggcttttattgtatgtaagtggccactgggcagggtcatttggcaggagttgggggtgagggtgtttctttcccacatttccctatgactcacagtatggctgtgttgtatgtcagatgtgattcctcgggccacgtgaaatgaatcagcccttggaagagaaagctctgcagctttcagggactcccacaccaagcctgggaacaagtagcaacgagttgttttttagcctgtgggggccaagactgcagagggggaacttcctcctgaaaaccggctctgcagggccccaatgataacacgcagctcccttcatccttggctctgactagaaatcctacggtgtttaagaggtttgctggtagcggtctgctcagcagggtggcaggctctgttaatcccaagtggaattcagtcagcggaagagggctgatttgtatattttgtaacatgagctgcctcctgagctcgtttttaattttgtttctttgggttttttttaaagaagcactttttagaaccaggaggaaccaaaagtatccagggaatttttatagacatgctttgtccccctagtggtgggcccagtttagagctgaagcgaaagtgcgtaaaggttggatcctgggtgaaataagacctagaggtttcttcctgcagcaaacagcttacagatgcagtgttttatcacctgagactgctcccacccatctccacactccaccccgctccgggactccagtgattatgccataaacggaaaagatcactacaaggtctatgacataaggcgaattctccaaaacactttctgcttcttgacagcacctctaattccatgtaatttgagtcagttctgtagggtttttctaaatcagaccagctcccgtactctttgcccttcgtgtaactgaacaacctaaaggaagccctttgcgtgaaaactcttattcttttgtttttaatcctttcagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaagtacgttcctacgggtcctcccgtggctcattataccttggatactcccagggcaaaatgctaaccgtacttgaggggcaccatgctagttgtaaaaaacatattattaatgataataagagggccgaaatcatgggagttttactttggggaaaagcagatatttttaagactggaagaaaaaaagattggttagtctaaataaaattaatgttttgattgagattacaatactgggaggtatggtcaccctctggtgtttgaagggtgtgaataaacccatctgatggcatggggagatataaaaatacagaaatatatttctgttatcaagaagtggggaatttgggattgaatttttctgacccaacctgtgtaaattaaaaggcttatgtttagtggagagggacaagtatctgataaataattttgtttggttcttctggttattctaactacatactttcaagacaacagggtgaaattttgcttttgttaaaaaaaaagggggggccaggtgtggtggctcactcttgtagtcccagctacttgggaggctgaattgggaggattgcttgagcgtgggaggatgaggctatagtgagctgtgatcacgccactgcactccagcctggacaacagagtgaaaccctgtctcaaaaaaaaaaaaaaaaaagaattctcaaagtcctctttttattaccgccccctccccacccccaacaccagattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtgagggcatctggcctgtgtgcttgatatacaggagggccataaatactttcttttctgggggtgccataatattgttcaaacattcagctttttctccatgttgaccatttctgttttagagtgggaagagtatttagccttctcattacccatttgcttgttcttaaaccacaatcctagtctctggaaaggatttgacccatgctaaacctattactggataaaagttttatgtatcttccttagttctggggattgttgaaacctgtggaaaatttttataaagtttttttgtttacgcttgagtccaacctatagtatatctctatgtatagccactctgagatgacttcttctcaaaagttttgcattgtttctgccatcagttcctttaacaattccaaacttattcgattaagaagattttgtttactacctatagaaaaaaaaattcacaatccccatggatatatgttcccatgaatatataaactaacatgtaaacatttaaaaaatgaaaaagaacagagacaaagcctgtttgacattgaggggacctgctgccttactttcattgggcatactgactcatttttgttaggttttgggcctggatggctagtgactattttcttggcttcttaaggctgttgctattttcaaacaatggtgccaggtcctaacaaggctggtgtggtaactggtaagcagaagtcagactccctggtttctttgggctcataggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagaggtattcttttgttaattcattcactcaataaagatgtattgaatgcccaccatatgaataaatatggcaagaagaataatcaaaagctctctgaccaggcacggtgacttatccctgtaatccccgcacttttggaggccaagccaggaggatcgcttgaactcaggagtttgagaccagcgtaggcaacgtagtgaggcccccatctctacaaaaaataaaaaataaaaaaatagctgtgcatgatgacacgtgcctatagtcctagctacttgagaggctgaggcgagaggatcacttgagctcatgagttcgaggctgcagtgagccatgattacaccactgtactccagcctgggtgacagagcaagaccctgtttctggaaaaatcaacaatgaaggcactgcttatggaagaagtaacagttgcagagatcttggtgtgattagctcagttccacccagtcggtcagccctcaaacctaggaataggacctaggcctcttgggtctaattttggtctagctcagtctactacttggcttcaggaaatatctagagtttaaaattatgatttataaaaccgttcctgtccctgatggtggactagagtttctctatatggaatgtgttgtggacttataaagtttgctctgtcccagattgtagaggggtttgctacagcacccctagactctgcagtgaatcacaatgatctgctgtcatgaagagaaatgtgtcagagtgattttgccagcaggaatgtacttcctctaatcttgttctatctgcctttttacagaaatcagatcagctgctttcccgtgccaatcttgctaaaagcagagcacaagaagcactgagtatgggcaatgccactttttatgaagttgagagcatccttaaaaacctcagaggttagtacttcatggttcaggtcacttgagtattttaagtgtatagtcatgaccaatttcctttgaattctcatatgtctctctaagtggcaggtatattgggatattaatagatccttagtaaatatctttctaaagaaaatcttaatgcattaatatttaatgtagtagtaataatagagctagatgtcagaagccttgagttctgatctctgctgggccacctaaccaggccagactagctgtgtgaccataggcaagtcatgtaacctttccagaacctagtatcttcctctttaaagagacgaggttaaactatgtgttctctaagttctctcacagatgcaacataccactactgtacagacatttttccttttcctgtgtagtctggttggttccagtatggaactgatatgtttctttgtggtgataacagagcaacctttgtcactgcatctagatcccaggagatttagatttgtgcctcgcagagatttcattaaaatttcaggcttcttcactaaagcacaaaagagaaacattcccaaaattttggaattttcttcatggaaagtacttctctacccattcaaacctaaccccaattcttatcattggagcttagggcttaaaactctggcttgatgctttggacttcaaagattctacctgcttctgatgcactcttcagtttcaatactcttgcagtgctgtggaactcagggcaggctgattgtcggtttctctaagcaacggagtaattataacccctccaatgcatcttttaagaaagttaattccagccgtaacttcccacaccgtcatccccagtcagtaataacactctttcaggaatttttctttacaacatcagcccctttcactcatttgtaaatttgctttcatcttcacggcagttttttcttttcttcatttcagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggtaaagagaaatcgacatgtgtgttggtgccagtagcaccaaacacaagggtggtgtggagggaaaaagaacattgagcttattttaacctctgaggctcagagccctgttgtggcccatgggagccccagattaaaagactatggtagcaaagacgcatgacagagaatgatgtgtttttttgtcctccgggttttcccaaatggttcctaactctgttcaacatttggtgagcattgaactgagagagaagcactgtctggccgctgaccttcctagtcatacccccagattagcttgtttgaggcagagcttggcaaagtacccctgtccctaagtctgattctctcattattcatctaatttactccatcagggcccggctgccgctgtattttttctatggttgtctttgggatgtttttgtgcctcacccctatctctccttccgtccctggctccttttcttctctcaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgagttcctgttgctttccacgggagatccctttcaacttgccaaaatggaaaataccttttcaaggctggtttgtgcttatttgtcctcaggtgattacagaagcccagaaggttgataccagagccaagaacgctggggttacaatccaagacacactcaacacattagacggcctcctgcatctgatgggtatgtgaacccacaacccacaaccttccagctccatgctccagggctttgctccagaacactcactatacctagccccagcaaaggggagtctcagctttccttaaggatatcagtaaatgtgctttgtttccaggcccagataactttcggcaggttcccttacatttactggaccctgttttaccgttgctaagatgggtcactgaacacctattgcacttgggggtaaaggtctgtgggccaaagaacaggtgtatataagcaacttcacagaacacgagacagcttgggaatcctgctaaagagtctggcctggaccctgagaagccagtggacagttttaagcagaggaataacatcaccactgtatatttcagaaagatcactagggcagccgagtggaggaaagcttgaagagggggttagagagaaggcaggttgagactacttaagatattgttgaaataattgaagagagaaatgacaggagcctgctctaaggcagtagaatggtggctgggaagatgtgaaggaagattttcccagtctgtgaagtcaagaatcacttgccggccgggtgtggtggctcacgcctgtaattctagcactttgggagactgaagcgggtggatcacccgaggtcaggagttgaagaccagcctggccaacatggtgaaaccctgtctctactaaaagtacaaaaattagctggatgtggtggtgggcgcctgtaattccagctactcaggagtctgaggcaggagaatcgcttgaacccaggaggcggaggttacagtgagccaagattgcaccactgctctccagcctggggaacagagcaagactgtctcaaaaaaaaaaaaaaaaggaaaaataaaaaagaatcacttgccgattttacatttgttcctccccaaaccaaagttataccttgatgtaaccagtgggaggaacttgagctgcttgggtaaataacccagaagaaatgtgatgagagtaggcctgtgagataattttaggaagatctgatggcacagcgtggaagaaaatcaggtttccctacagaatcgctcccaaaagaaaacttattttggttaaatttctggatttaggtagagctgatatcaaaccctcatttggtctgttttatcaagcttggactgcagcagatgtggaactagagattcgtcacagattccagtaacatttaggaaaatgtttggctctgctattccagttcagtagaacaacttcgaaactggatttttctgtagggtgtcatcatcaccctgagatgccaatgtcatctgtgttgttatagtcttgggtctgctttgtgatccaatgagcccaaaagagtaaaatgccctcaaaggattgagaaaaaaaaaaggaaaaaacaaaacaaaggaaaacaaaaccttcccaattgagactttagcagcgttgtttagtgttctaaaaaaaaaagaaaggcaatgaaactaatgagacctgtaaagagaatatgagagagtagggagagcagggtagatggaagctattaaacatttactatgtgtcagatgttttcatggtgtaatatcatttgtcttgtaaaagtcctctgtggtgggttttatcatttttattattttatttcatgaaggactgaactgaggctcagaggttaataatgccccacaggtcatgtagtaaattgtagaggcaggatccaaactgatatctttttgcctccaatgctcgtgttcttttctagtaactcatgccaccttcccatagacaaggttattttgttcccaagcttacttaacttcctctgcatgtcgtaaaatcctaaattcctaaattctccctgaccccaagtgaaagatccatttggatcaacatttttgttacagtgttgtttctactctgtgtgctctcttaagtcctggagcaatatgagattaattgttctaggtataataaactcatgcagtcaaatactatcacttcagctcacatatgtgaggcaacttgaccttgagttcgaattgaccaaggccactcaaacctatttgaactaaatgggtctggccaggtacccttcatactgacattagttttagatagtctaagggtaacacatgcttgaacaaacgtgattttattttaaattggaaataaaataacatctagtcagatgactgctgtttcaggctggaatgatgtctgacatcaatttctagcagctggaatccattccccaagtggcaaagcgtaccttggcctctataaccctgaagctcagccagtttcttaaggtcttctaatagaaaacagcaagatatttcttaagggtggttcagaaagcataatttggagttgattctaatcctagcagtgacctatgttaggcaaatgccttggatagtgctcagtcccctatgaccttcagtcctcttttttttttttttcatagcataaactattgaccttaacacgaaaggaaaactccagacatcacgttgctgaactagatagctcagagtcttgaacagtgttgttcatagcccagtaaataggctagccctctcagaactctttctaggtgatttctaatttaaaataagctttaaaattcatggtatactatttgctctaggcaagtggaaatgggaattagttatgggtatagaagggcacgggtgttcaaggagatctaactacagcttttctatgttaacttgtgtctcattccttgaaatagaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgcctggggtcagtttctgatttactaaactctaagcctatgatggtaccaaagtaatggaaatgaaaatgccacagaaatggcaataggtcctagagttagcatcttcagttcccacttctgagcatcttacttcgcccattccaaccatacaggattgatgatgctgtcaatgagatttttatgaggtttaactgatgctgtcttctaagcataaagctttattt

SEQ ID NO: 1009 - DNA, 55233 bp, Homo sapiens
cttggcccgggccaggtgtgcgccctcctcgctgcgagggggagcgggcggctgcggggagcgattttccagcccggtttgtgctctgtgtgtttgtctgcctctggagggctgggtcctccttattcacaggtgagtcacaccctgaaacacaggctctcttcctgtcaggactgagtcaggtagaagagtcgataaaaccacctgatcaaggaaaaggaaggcacagcggagcgcagagtgagaaccaccaaccgaggcgccgggcagcgacccctgcagcggagacagagactgagcggcccggccccgccatgcctgcgctctggctgggctgctgcctctgcttctcgctcctcctgcccgcagcccgggccacctccaggagggaaggtgagtcggcttccacaaggaaacatctcagccctgggctgagaatctgcctttctctgcagaccgtgatggctgaacgtacctccgaggattcccactttgtccagaaacttgttagagctcccttctcctcccctatctggggctcctccagagacggattttaaatgagactaatatataaagctatctgctttttaaaaatagtaagacaataagctgtgacaaaagagggtcttccttaccttaaaaatgttccttcttgatgtcttttttcgaccaaggggccgctatttaatcaataatgtgttgttatatacgttctttccccagcgtgtgcttttattaaaaggttttggtggcaatgtttcccatgactgtgaacaccacaaagattgcaaaggaacctcttcaataatcctgtaattgatgtttcaaatttcggatggaaaaatgagccttaatagtattagcaatacccttaacttttgcatcacgttacttttcatagtattttcatgtaatattcattcaacaggcacttactgggcacctgtgtcatatatcatttgatcttatctagggcacctagttggctgtcatgtgttagacgttaagttcatgtaaacaaaactttgtgagaacctagcaactcttaactgtaagcatgtgtcagctatggcaacattttatgggtgttttccttgtcacttagttctatggatatatgcctgtataattgccctgatgttttatgtttatattgcatcctgcatctgatggcgtttcaatcattctttcaataggtccaagaccaagagccatttccacacaagtgcatgcatgaatatgagataatgctcacatgcacatgcaattgtataagccattcccaatattattgtgcattccgggtgatgctggcctgaattggatttgagtggcatgaataatgtttgagcatgtgtttgaatgcaatgctacagtcctttttgtctaaaaaagtcttggaattaacttccaacctatcatctctgactaccattttcaaaaccatgtatgattgccaccaaaaaaaaaaaaaaggtggagataagtatgtgaaataatgaacatattaatttgcctgactagaatactattttactgtgtatatcgaaacatcatgttgtataccttaaatatatatagttttaaaaagtgataaataaaaggttctgaaaatggtcatgaagggtatgttctcttagggctgggataagaagtctcagcctaatggaagacatccccaaagtaaaaatagtctctgaatattagaatttaaagggactgcttatggatcaactacttggaatctcttgatttgaaaaatgagaaaatgaaaatgtgtttctcaaggccacacaggcagagatgaaactggctcttgatccaggggctcttaggctggagctttttgagccacattataaaagtaataaaggaataagatacatcttttatacatgataagtaatcatttaagcaattttcttgttggctatagttgagtacatatatgtgtgttagcattagggaacaaaaataaatatataggatgctatcaatgctattttaataaaatcaggcttaagaggacagagctaggattctcacttcttaaagacataccagcttctgggcatccatctaccccaagaagtcagaaataccactgaggctcattgccactttccccttccctggaggcagactaaggttttattctccctcctcagaggccttcatttttggattcaatgggaatgtgaagtttgttgccagggtagaacacacatgctttttcattcatgggatgctgggatgtgctagaagttggactgaaaatatggtatctgccatgtctcaaagtgaccgtgtctgagtgtcctgtgggctgcacatatgagaacctaaagcagtgatgttgcttcctggttgtttccttgcagtagaaattatggcaatagatgaaattggcaagacttcagggttgggctcagctaaagcacaggctttagagtcagcctgacctggctttacattttggttcattcacttactagttccttattagtaatacttggtgtctgcttcttcattgtaaaatggaggcaatagtacttcaaccttgtagagtttttgaaaggatgaacaattactgtaaagtgccttaaaatgcctggaaccacatttctttaaaaagtccaaagccaacagtacagtgtagtgaattcatttgcccagagatcagaaagaccaaggctccccttcaggataggattgcctggtgtgagataaagtggcatgtggccccagtggtctggatcttagttcatagcaggaggtatgactggagaaggattgagaaagagataagaaagatactagaaacgtagccaccaatatgcttgtgaagggctttatgtgccaggctgttcagtaggatggtgccctgtaggcaaagaagagctgtgaatgatttgtaagcaggaattagtgtgactggattcatgttttagaaaggtcactcactcgagggcttagagaatgaagtggagctagggaagccagataaatggtgattaccgtaattcaaatgagagatgatgaagactttcatcatggtaatgaaagcaaagaggaaacagattacagggacatttaggaggtgaaatctaaagaatgtggtgatccaataagtctgtgtgttagggatatgagtataggaaagttgagagaaataaggaagagtccaagatggatccaaggctttaggtttgtacatggttagacagtgatgccattaaaggatgaggactataaaagaaggatcagtctgggcacagtgactcatgcctataatcccagcactttgggaggctgaggtgggtggatcacttgagcccaggagttcgagaccagcctgggcaacatggagaaaccccacctctaggaggctaaggcaggaggatcacttgagcctgtgagggtgaggctacagtgagctgagattgcaccactgcactccagcctgggtgacaaagcgagaccctctctttttattttagtttagaagggaaatttgagatataaatttgggggcccagaggtagaaagcaaagccttgaccacagacgagattgcctaggatatggaggtaaaagaaacctcagcacttaaaaaagagatagaggaacgatggagcagaatcaggaggaatgagcactgaggatagaggaaaatcaaagaagaagagggttttgttagtcaaaggaagactgtcagcaacatggcagtaataactggtgttcagatatccaaatgtgtatatacaaagaatgaggactatcactgctggatttagccgtcaggtgagttttgaagcaattgttcttccagaacggcgaattcagaatccatgattatcatagatcactaatttggtttttcccatgccctgatgctagaaaaaagatgctgtggatagtaggaaggatccttggaaatgtttatgctccctcgtagattctgttatttaaatcattgaagtggtatagcatcatacacaaaagtgcaggctctggagtaagactgcctgggttcaaatcccagccctatcatgtaccattgtggcacatttatattttgggacttgggcaagctacctcacctgttacttagctcctacatctcagaataaggatgataaatcgatatgaccattacacaaaaatcactttgcacattgcctggtaagcacttaatacatgttaatagattactgttattgttacaactaactgccctgccagtactgaatttggtatattgctttctgtgttttaagtggtaacatttttgaagggcctcctttttactctcctttcgtcagcccaagaaggtgctgaggagcctttctgctcaagcagacatgagccccaagttttacccaacaaaacaggaacccaaagcaggttgcagtttcaagactggatctcgtatcattccttctccttgcctttttcatccaccagacctcatcacacacagattcagcaaatctattgcttctcaaaacatgctcaaatataagatgaccctacaaagatcatctctcatttcccaatgggaagaacttcccccacattcaaagaaaggatttggacaacttgattatgagaacatttagcaatacagatgtagtagtcaaatgtctctttatgtttaatttagtaaattaattacacagatatattgaaagtcacataattgataaaatattatacttagaagtgttgatttgttcactcacattttatgaagtaattatattcaaattatattcagttatattcatctcaccagatgacttgagatacagtactgtttgaatctgtttttgatgtggtcactggaaagtacatcattttcaaaacatttaaaagatagacaaattatcccttagtgtatattgtgatcttcacagcataatcactctgaaaggcttatatgcaacacctttcagcactcacaactatgaagaaatgcaccattatgagaattgtttagacagctgggcccctttcttactgataagtctccaatacattgattgaggtcattttagcttaatgtatcttccccaaacaatatttttacaataaagtaattgagaaagtaccctataatatgcaagattttgaaaggacttaagtatgatcttttttttcctgagggataattttggaaaaattaaaacctctaccttatattcaagcatgtacagagatatagaattgggttggaggtgggctggaaattcccatatgggcttaaattctgggtgttctaaactgggggcagccactggttcagcctcactggcccaagaagctgagaaagattgttgatttgtgattcgtgtttatgggaaagtcagggcataaagttaaggtgttgagagaatcctgggaatatctttcccatttaacccacttaagttcttaatggttcaaacttactgactttttttttttttttttctgtcctagagaaatttctaagggcaagacttgaatcatctattagagatcagtgtagagggctgggtgcggtggctcatgcctttaatcccagcactttgggaggccgaggcgggcggattacctgaggtccagagttcaagaccagcttggtcaacatggtgaaaccctgtctctactaaaacatacaaaaattacctgggcatggtggcatgtgcctataatcccagctactcaggaggctgaggcagggggactgcttgaacccgggaggcagagattgcagtgacccaagatcatgccactgcactccagcctgggcaacagaatgagattccatatcaaaaaaaaaagagagatcaatgtagaaataggagctccatagaatctggaatactctcatttagtcagaaattaaacctagtaggtgactgaatcattactgggctatgttttaatataatccccagataggtgatgtaatgtttgaatcatgtccaaagccaaaggctaagtcttttctgtctgtgggtgactgtatgtctgcatatgtaattccccaaaaagcatctgcttctttatgtcacaaccatggaaacagaagagaatggttcttcctccagcactgatctatggaagaacctgagtctttcccttctgttgtatcaggtgaggggtggagatcaattggccaaacgtatagggatcctgcacttattcagggcttatatttacagaattctaaccgcgtctttttatttattgtggggatatgtatctccgcattagaaaagaatcaaattgcagccaaatcatttcccacaactaacttaaaacttggacaaatcatccaaatgctcagctgcactgatgtggggcatttcatacaaagtattttatgtttcaccatgtttttctcttattacagtatcgtagaactaaaatgagagtgggcctcaggggttctctacaagagcctctcattttatgcatgagaaaaatgacacccagtgaggtaaattaactgcccaatttcttactgttggtcatagcagagctgggctccagcatgtttcatccttttataggtaggaaaattgaggcacagaagagtgactgctttgaccaaggccagatttcagttactagtttaatgttctttttctgagataactccttggcatatttctcatttttctttttttgagatggagtcttgttctgtcacccaggctggagtgcagtggcacgatcttggctccctgcaacctccccgcctcccagcttcaagcaattctcctgtgtcagcttcccgggtagctgggactttaggggtgcaccaccatgcctgactaattttttgtatttttagtagagacggggtttcactgtgttagccacgatggtctcaggtctcctgacctcgtgatctgcccgcctcggcctcccaaagtgctgggattacaggcatgagccactgtgcccagcctgaattttcattgaaactaatcttcaagcttgatggaacctttatctactgttgacataccacctgtatttctaatgaagacatctatctcgtcttttcagaagtctccatttgtgtatatgattcaatatattggcctttcctttaaaaatatcagagaacaacaggttaaaactaagcacagctctagtttgtggggcattaacaagagaacagatttcaaattaccaagttttctcttccttttgttccactctgttgtcaggttatcatgcagcttggaattgaccaagtggctcagtttaggatcgttgatagtactgtgataagactttctcttttagcaatcattgttctttaatgactgttgacattttgcatctgtatatacgtaatcacgtccagagattatttctgtctccctgctacagacccttgtaagttttggagtctttcagaaagaggtctgtttcatggccagaatgttgaccatgtaagctttatacatacttactgctgtttcaaatcatggcccattttgctcttggtaaaaggatactttttggtaggggattcctagtgtttaaaaatcgtttttcatcccaaatagcctggcctactttgggaaggcagttgatccaacagtaatctgaagctgctgctcttgccctatccaggcagttgtaccatggtaggaggggatcttcacattctgagatctgcagggagcaggggagaggccacagtggacctggcataggaagtagtagtggagaaacagcatatttgttcaactgagatgcaagatactccctgatgtagtcttcatggtccagtctcttctcaaaatgtttgttacttctctttatggatgtgtaaaggtagtttggctcataagagctcatttaattcattcttctgactttaggcaatacagtgtttttgtttttgagatggagtctccctctctcacccaggctggagtgcagtggtgcaatcttggctcctgggttcaagtgcttctcccatctcagactcctgagtagctgggattacaggcgcatgccaccaggcccagctaatttttatatttttagtagagatggagttttgccatgctggccagcctggtctcgaactcctgatgtcacgtgatctgcccaccttggcctcccaaagtgttggaattacagatgtgagccaccatacccagccagcaatacagttttaattcatcttttttctgaaaaaaaaaaaaaaaaatctgtaagtaagatgctataaatgcacgccatgcatattttcccaacattgcaaatgcacatgaattaccattgttcttttgtgaagactaagaactatataatggtatgtaagcccacacacatacctaaatgcttgtatttttgtgaagggatgtagtgatagcaaaaaatctttgcctaatctccttgtacaaaaaaagtattgttcacaaaagcagtaaggatttaaaaaggaagatttattgtttttttttaaggaatcaatgaaacataaatttaaataattgaaaaatcatggtttatacttcaattatctccaaaaggcattttagtacaaattagaatctcctttttaacttctctttattcagacacatcatagaaggtttctttccttttggtcctctttgcttcaggtatttacctctggcatccctggaatctctgattccctttatttcaactgcttcttagaggggcataggatacctttttctaggccatgcaagaaatgtccagagaacactatgctctttgaataacagttaaatgtcctttctatgctggaatgcttttctttgtaggtaacttcacagaaatgtataaccctttatttctgtggtcagaagagtgtggagttccatggaggtggttgctgtcatatagaatcttaccacaatcacttcctgagtctatgctgcagctgacagcagctgtcttgcggtagagcctttgacagtgccagctataactctaatgtcctcagtttgccttccctttcacctgtgagcttactcagactgaaccctcagttttacctttaccctccactcctttgctagtcagacaaaacttggtgtccccagtttccctgttcactgggactttcttccccctcctcattgtctgcctgggcactggtgtcccagtggagtgtcaggggaagacatctccaggtgtgaactcctgatggagtcctcaccaggctgagtcatctacagttcacacgggtacattcccaagtctaggctgtgatataatgtactatgaactctcggtgaaacaggtgtctcctctgaagccataatcattcaaaaggaaatggcagtgatctgagtttcactgactcttgatgactttggagtattcagagttgaaaaaactgacccatactttatgattcaaaattgcctgtgagattagagaactgagctctgtcattcctctcatcctagcacttcctgcctcagccttactcacattgcttggacatttaaatgtcaactggtgccgtgccctttatttaaatgaaacaaatggatcaggcaggatatggtatcagttttctggctgtggtggcttaaaatgtggctatgaaaaatttgcaaaagaagcctaaattcagctaaaagccttagtgagagaagtaccatttcagttttcttattctaattagggaacatattgtgacattctttaagaagataaaactagaagcagatattcacacattaaacaatgaagttcaaggccagtttaaatgatgaaggattcagattttgttttaaaatatctgcttaagccgacaaacatattaaaacttggaaagaaaaattccatgtaggaggttttaaaactagaaaagtccttataagcattttcatcatcacatgtaaatataatataataaaaacattcatcttttcatcttgaatgtctcagacttgaagacatggatttttgcaaagaggatcatagcttctgatgcctttgatatcaaactgataaatgacaggtagtatcttgctttagattgcatacataatatgcaatttgaatatttgtcataattatttatttttgataaaaatgattttttttttttgagatggagtttcactcttgttgcccaggctggagtgcaatggcacaatctcagctcactgcaacctctgcctaccgggttcaagtgattctcctgccttagcctcccaagtagctggtattataggtgtgtgccaccacgcccagctaattttgtatttttagtagagacacggtttcaccatgttggtaaggctggtctcaaactcctgatctgaagtgattcaccggcctcagcctcccaaagtggtgggattacaggcatgagccactgtgcctggctgataaaaatttttaaaatacattaggataaatttctatttaaaggaccctttcaataattgcttttgtactgagaacaacctttgctagatttttaaaagtgggtatatgcaactgaaactttattcaccatcttcagtatagccttttacatttggacttcccattgaaagacctcattataggtgacttcatggaggcaactgttgctatctttgaacataaaagagttgtcagtttacatgagagcagtcttttgactcagaagaagggaatggtatccaataaggtatattaagatttagtttttagtgtaacttctttgaaaaaatgaaataggagactagttgagattgtcagccccaatttgtgtctgcccaccatgatggttttcttttataaagcaagaattttaagaagcagaggaaatgaagacataaaatgaagtgtatgtgaatgaatggaagagagatgaagatgtcccagtggtgagcgttatatgaaattaggctggaaaagtagatagggtaagaccatgatagtccttgtaggcaatattgaggaattctggtgcttaacttcaaaggaaaggaaagaaactacagaatattaagcagagaagccatgatacaatttgtattttggaaagattttctgattgctgagtggagggaagcaaaagaagttgcagggaattcagctaagaagtgatggcaggcaagagatgattgaggtttggtctagatatggctatagtggagatggacttgattggatttgagatatttagtgggttatatcaacaaaattcagtgttaaataggcaggtgagaaagatggagaacctgtaaggatagcttccagctttccgacttgaaggcatggcaatcataagtttggttttaaacaggttttgtgtaaagaacttttgagataaccaattggaaatgtaaagtgagctgggcgcagtgactcgtgcctgtaatcccaacactttgggacggtgaggtgggcaaatcacttgagatcaggagttcgagaccaacctggcaaacaaggtgaaaccctgtctctactaaaaatacaaaaaattagccgggcgtgctggcgggcgcctatagtcccagctacttgggaggctgaggcaggagaatggcgtgaacctgggaggcggagcttgctgtgagccgagatcgtgctactgcactccagtctgggcgacagagcgagactccgtctcaaaaaaaaaaaaaaagtaaaagtaataagtaaataagtaaataaataaagtggatggcagacatgaggacctgaagttgaggatgaagtttgggccaaggaagtatcttcggatgtcaacaattacggtggttattgaagtccttgtcatggatgagattacccaagggagactcagactgagacgttgtggagattaaggagccctgaggagcaccgacatttagagtaggggtaaggaaaggagccagcaaagccttgaatagggaaggtcagaaggcagacagacacctggcagtatgacatcattgtatccaagggaagagagttgcacaaaggaaggagggaaaaagatttgatgtctcagaaagagaatgagggacacatgcaggaaaggaaacacagggcacatccctttcctctaaataagaaagataattgagcatcatctttttttttttctttcttttttttttttttttaattgagacagagtctcactctgtcgccaggctggagtgcagtttcgtgatctcggcttactgcaacctccacctcctgcgttcaagtgattcccctgcctcagccaccccagtagctggaactacaggtgcctgccaccacacccggctaatttttttgtgtattttagtagagacagggtttcaccatgttggccatgatggtcttgacctcctgacctcatgatctgcccgccttggcctcccaaagtgctgggattataggcgtgagccaccgtgccgggctgagcattatctttaaatggttcatagttcgactaattcacgggagattacaggtcacatcatataaacttgctgctgtttcactgaatcagttttagtgcactaagcaaccgaaatggtagcaacagcaacaaagcactacgtaatagcaaccagcacacactgtcaggtttaaacatgatgctcaaattcctagctcctgacaccgtcccacacagccgccaagtacactacctatcaaggctgcctgagcactgcaaactgatctcatgctctgaggcctgcctcatcgccttgccctcctcccacacagccctaggctcgctgcccgttgaggtggcaggcagaaagcattgcagctctggggtcatagaccacagatgggtgggcagtcctagggtggaaatagttcatctggtatgagcagcaacctgaaagtcccagacccttaatctcattgaaaatctcatgttcctctcacaattctttctgttcccatctcaccatggatttttttgcttggaacattagtttttttacactgaatgtcatatatgtagacaatggaaactttgtgtaatgtattggggaaatttgaaagtaggcttctggacgtcagggagatttctgtatgttcaggttcttgttggcttttctttttttttttttttttttttttttgagacagagtctcgtactgtcacctaggctggagtgcagtggcaccatcttggctcactgcaacctccgcctcccaggttaaaggattctcctgcctcagcctcccaagtagctgggactacaggcttgcaccaccacacccagctaatttttgtatttttagtagagatggggtttcactatgttggccaggatggtcttgatctcttaatctcgtgatccacccacctcggcctcccaaagtgctgggattacagacttttcttagagtcagactgcctatattccttccttcctttctccttccttccttccttccttctttccttccttcctccctccctctctttcttccttccttccctccctcattccctccctcaattcctttctctctccttctatccatcatgctatccaccatctttccatccatccatccatccaagcactgcattaggtacagtggggatataaggtgagaaatgctgtagaagaagtaagtcatagacataaacagtgatgacacaggatagaacgaggcaaatgctgagagaggtgaggatgaagtgctctgggctttcacgggagagagaagctgccagaaggtatccgcaaggaagtgcacaatctgatttatgcacctaaaaagaagactggctgttacctggaaatagatttagggagggtggaagcagggagtgctcctgataaaggaaatagcaagcctaaaagccagaggtgggaaagggttagtgcagcctagatctgtgcattggagcccagtgaactcttgatgaggtaaagttggaaaggttggcaggggccacatctgctgagttttgaaagaagtttggatttttaattttgtcattaccgttaaagcactaaaaagcatgatgatttcacagattatacaaagacagcgattagatcaccttagtgaaaagcagagcatgtttttcagtttagaacaatagaaagagggccgggcgcggtggctcaggcctgtaatcccagcactttgggaggccgaggcaggcaaatcacctgaggtcaggagttcaagaccagcctggccaacatagtgaaaccctatctctaataaacatacaaaatcagccgggcatggtggtgggtgcctgtaatcccagctactcgagaggctgaggcaggagaatcacttgaacctgggaggcagaggttgcagcaagccaagatcgcgccactgcactccagcctgggcgacagaacgagactctgtttcaaaaaaaaaaagaacattagaaagaggacctgcttatagaaacacaatcatatgtatgccaagtgattgaaatttctcgtaattgtatgcctcaaaagggcactgtttcttatgggaaatttaaaatgagatcccgatgaactgctactactgatgatgattatttcaaggccttgtcctgcgtacaacctgaggaaatattttctgtttccttttattctcctaaggccacagctgggaaaccgcctttgcccctttgcttcctgtcctaacctgttggagctgcgtgttttagtgaggggtgggagtgttgtgaagtgagcccgagggatcctgctcgcctcactctattgtttaaggaggggctccagctgctttgatctgcgtctctgggtgagtgtgggtggtagtgggcagtccagcctgtgtctggctgcctggcggtctttcctaagaagcaccttgagggtcagcaactgtgtgctattatagttattattataataaatgcttcagtgccagagaagtagcatacagcagtcagacgcaattaccatccacgcacgctttactagacttaaagaaatctgtgaaaatctgactcaaatgactccgtttcagatgggtttatgtaggacttgaggtaaacttgcagagtctcatttctttggctgtggagagaatgctggctggcagaatcaaggatttggagggagctggagtgagggggcagaaagaggagaggatgaaaccttgaagaagtgtccctggctttgtaccaatgaatagtcaaaggaatgatggatgggacctagaaccagagttcagtgaaagatggagagaaacctgcttgttttgtttactgaccttagaatggcttcagatctgttcagggtttgagtctgattttttaaattttattttccgatgatgtgcaatatcttaatgccagatcccgaacccatacctgggttccaacacacaaatccttgcatgagctctagaatatactgagctttttcccaccttgggcttttaggcttgctctttcctttgtcaggggcactccctgcttccaccctccctaactccatttccccataacagccagtcttctttttagatgcatacatcagatcatgcactgattcctgttcaagtaggaaaacatggataatatgatacatgcttgacacaggcaaatatctttggaaaaataaaacattagcaacccccttggctgggtgcggtggctcacgcctgtaatcccaacactttgggaggctgaggcaggtggatcacttgaggtcaggagttcacagcctggccaacagggtgaaaccctgtctctactagaaatactaaaatattccattgtatttcagaagattataaaagctctaaggtgaattttgaagtcttcatcagcatatccatattaaaaggagatgacagaagccaaaataaaagaattatgggctgacaggcaactggattaaaataagcatcagtttcattaaaaatggctaacttgaagataaatcttttgactccagcactctagaggatctaaggtgaccttgatggacagtggaagaaatcacaacatggaactccctgaataaaaatttattgacttaaaaaaaatactaaaattagctgggtatggtggtacatgcctgtaatcctggatgctcgggaggctgaggcatgagaatcgcttgaacctgggaggtggaggttgcaatgagctgagatcacaccactgcacttcatcctgggtgacagaatgagactgtctcaaaaaaagaaaaacagcaacaacaacaacaacaaaaaaaaaaaaacaaagaaaaccacacacacaaaaaaattagcaaactccttctttgaaatgttactggctcataaagtctgattgttcaagcatgcagtatagcctccctattagatgtgatgtttattaaattaataaaataaatatacatctcattgaccaaggataaaagaaggaagggggaaagggggcttaaatcagcaaaacaaaatctaccgatgaggtactttggaaataaagatgatttatcaggaaagagtaaaagaaaatctgcaataaagtgatacagacaaatagtttgatgtatttgttatgtaaacaattcataagaaaaacattgtgccataagaaaaacatagataaatggacaaagatcatgaagcagacaattatgaaaatagaactaaaacagcaaactggcatatggcactttctaccctccttcccacccatcttactacttcccaacttcctatgcctttccactgctttatatatttctccctaacaaataccactatcctaatattctctcttgatattacttatttatcttgtttattttctttccccccaaattgcatgtaaactccgtgagggctgggacatctgttggttttgtttgctactgtatgcatcccattgcctagaactcagggaaggtccaagacaaccatctatgggttttttaaagttcaacagaacattcattcattcatttgtttgttaaaaaaagactaaatgcctaccatggaccaggcactgtgtgatataatagggcttcctttttcctttttcaaaagcatgagatgtgttttctacctgttagaactgcaaagttgagtgcagagatttgcctgtggacacagctttgtttcaaaaatatatatttttttaattttggccaaaattttaaaaccaatagatttcatacacaaagctggatttctgtcttcttttaaaagaagagttgatgttgactacaacaggcatcaattgcatgtggctgcaactggcagggggtgaagtgctgcttcttacgccctttgggcagaatccccaccacttcctgttgccttactctaagcctggcagtgccctttggcaactggtagttgccaaaccatggtagtagttgggcaggtattggtcacagaataaagaccacatacaagctacattacaccgttttattaagcccagttgcaggaatattctagaattttaaatagaaaagttgtttcctgccccccgccccccctcacccctagtagcgagagtaagtaataaatggttttagggaagttagtctcaatttgggagatggtttgagagagaccatttttcaaacacattaatgatgaaaagcatcattccatgcaaaaggagcttggaacaagctctcccatcattttcttggtgggaccatttcaaagactcaatactgagttaagtgcaatatagctgggtgtttaatctcagtgcagcttggtaacttcaaagtcctgcaggcaaggctgtagagagtgtcttcacggagttctcatgcaatgcagatacccaaggccaatacattccccagacatgaggcccatacatcccctcactctagatggcattgcccttggctttaagggagacccatttgaaaggaaaggggtatgtttgcaataggcttagaatctgttgggcaggctctggaggggagatgctggctaaggacctccatccctggaaccgtaatgcaactccattgaaggctgtgcatttaaaggacaatggggcaggcatggtagctcatgcctgtaattccagcactttgggaggctgaggtgggaggattgcttgaggccaggagtttaagaccagcctgggcaataccacgagaacctgtctctaccaaaaagtaacacatttagttgagtgttgtggcatgcatctgtggtcccagctactcgggaggctgaagtgagaagatggcttgagcccgggaggttgaggctgcagtgacccgtgatcacaccactgcactccactctgggtgacagagtgagactctgtctcaaaaataacacaaaagaaaataggctgggtatggtggtgcacacctgtaattcccagcactttgagaagccaaggtaggcggattgcttgaatccaggagtttacgaccagactgggcaacatggtgaaaccccgtctctacaaaaacaaaaaacaaacaaacagaaaaaaaaaaaaaaaccactacaaaaattagttgggcatggtggcacacgcctctattcccagctacttgggaggctgaggttggagaatcgcttgagcccaggaggttgaggctacagtgagctgagattgtgacacagcactccagcctggacaacagagtgagatcctgtctcaataaaaataaaaattaaaataaaagaaggacacctattattttcaaagtagagctttagaggaggagacagaagagggatgtgatagaaaaagattataacaagtttatatattttgaaaagattgctctgaataaatatataatgagctgcccttatgaagttaatttttaccaccacaaagcatgttcttttttttttcttttttgagacagaattttgctcttgtcacccacagtagagtgcaatggcacaatctcagctcactgcaacctcctcctcccaggttcaagtgattctcctgcctcagcctcccaagtagctgggattacaggcacctgccaccactcccagctaatttttgtatttttagtagagacggggtttcactatgttggccaggctggtctcaaactcctgacgtcaggtgatccaccctccttggcctcccaaactgctgggattacaggcgtgaaccactgtgcccagcccatgttctaaataagaaaggcacaatgaaaaatttgtagttattttgagattgcttccaaaaggcatccagggcagggagggcattggctcattgggttagccagatgaagaacctcgcaaggactgctgaacagtgaatttagctcttgtacgtgcatagtcatgtacttggtacaaatttcacagcacatgacagctgtgtggcacatctgttggagatccaaaaaatcagtttcacaagcattggttgggaaagattcagcttggcactagttctgagaaaagccctgggactttgaattgtgtgcaaatgtaatatgctgtaagttcactgaaatgttagtctttgcccatgggataaaaatatctagtcctgttacaagccaagctgtttaaatcacacttgcagtactggtcatatgaagaaggatactggaaattagaatttgttcctaggatggtagtcaagaagaatctagaaattatgacataggaagtggttgaaagacttggagatgacagatctgtagtccaacttgaacaggaaaagactaaggagggagatgccatagctatcttcagattcacaaaagcctgatgacgcagggccctttggatgtaaaacaacacccaaagattatgtctgttggataaataaaagaataaaaagagagtaggggtgtgtgtgtgtgtgtgtctgtgtgtgcctgagtgctgtatgtatctgtgtgtgttgtgtgtgtatgttttcaggcaagagcaaaaacacatgatgaaaattacagaaagagaggtagatttaaaacaccatataaaaatgttactgtttgtaacaaccaagctgaatgaccctctattagggatttataaaaagaatgtctacatgcaatggtaaactcaatcttgagaaggaacataaaatggaaagatgagggctttggagtcagacacatctgggagcaaattacatctttgccatttagctgtgtgactttaggcaagatacctagcctctctgagtatttgtttttccatctattaaatggggataataaaacccatgttaaaatgttgtgagaattaactgagctgtcgaatgtaaagtcctagaaacagtatgctttggataagtgttagctgacttttctagattagatgtcatccaaagtagaaagagtgagttatagaaattactgtaaggcagtcacttagcaggtccattagatgtacgtggtcaccgctgggcacggtggctcacgcctgtaatcccagcactttgggaggccgaggcaggcggatcacctgaggtcaggagtttgagaccagcctagccaacactggcgaaaccccatctctaccaaaaatataaaaattagctgggcatggtggtgcgcacctataatcccagctacttgggaggctgaggcaggagaatcacttgaacccaggaggcagaggtttcagtgagctgagatcatgccactgcactccacactccagcctgggcgacagagcaagacttggtctcaaaaaaaaaaaaaaaaagatgtacattgtccccttgtattgtcagtgcctgacacagagcctgcacagggagccactcagcaggtgatggcacatctgttgactttattgtcagcactatggttaagtcacgccctagaaacatattctcaatatggcagcatggccaacagagacagcctgtgtagggaagggaggttggtgttcgcatcaggcagaggttcaaatctcagttctccactgggtggagttacttcacctttccgagctgcatgtttctcttctgaggcagtacgtgtttcatggagtgagtgatgaaatcgcatatgcaaaggcatttgatattcttttcccagagggatcctctttacaatccagggaggcagataatgcagtctgtatggaagaaaaaacaagattcagaaaattgaagtgatgtgcccaaggaaatagcagaattggtatttgattctttccttttaacctgaaggcccatcatctctctctccgagaccatgacggaaacattttttggtgtctcagtgtgccgggtactatgctgggtgtttccgtgtttcgcttctttgctgttcgggtccttatggagatgttagtcactttgcgagtctctttggaacatctgcaggatgggcttcctagatacttgagaaaggtcattcttcatgggacacttggctttgggaggagacatgtgcccagacggtcacgtccactcctttgccttgacgggcaccggtgggatgggtgttgtgtatcttgagcagcgacaccatcggctaatagctgtgctgagtccgcagctgcccatcctcaggtctccgtgagcccacacacttgctctgtgggattgcagtgttttgaaatgaactccttgcaaacatttaaatcagaaatatccgcataaaaatgtaatttaacattttgggtttctctcgaggaactggacagtctggcaaccctgagcccatgttctcccagacagcagcccaccagcattgcatagtgcctacttcctttaagtggagcaggcgtccccggggtccctgcactgccaattgcactcccatatcttcctcccgcaaggagtgtaggttaccatatagtactcatgcataatttctatcaataataacataaacacctgctagaacagttcctgaggtgtttttttttttttttgacgatctcttttgtatgcttcctccccagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggtagctgaaaaggacggaaagagggagagggagatggagcagtggggagacaagagggaaggaaggaaggaggaaaagaagaaggaagggaacaacggaggaaaaagaaagaaaacagggaaagcaagcaggccaagagggagatgttcaacctcaccaacaactgggaacctaccagacattggtctttttagcagtttcaatctgaaaggaaacatgtttctcttaagtaggggttggtggaaccagttgggaccttgagggcatgttgtcttgaattctaatacaaagagtcacattattaacttttccaggcaggtgacagtcttttgcaagcagatgacaaaggaagcttgcactctttcagggatagttcttcatatccatagccatccatttgaccaacctcttgaaaaataaggaattagaaagatctgtttctagtgctgtgctaggtgctagcaatatgaagttgtactaataaaggagacagacaagtaaacaggaaaattgaagtctttcattaggttgctaaaaagataaaacaaaataacaaataggaaacacctaatggggtggctggttcataggagagctagtttgtttttttgttttgttttgtttttttgagacagggtctcacactgttgtccagactggagtgcagtggtgccatctcggctcactgcaacctccgcctcctaggttcaagcgattcccctgccttagcttcctgagtagctgggattacaggcacccaccaccacgcccagctaattttttgtatttttagtagagatggggtttcattatgttggccaggctggtctcgagtgcctgacctcgtgatccacttgcctcagcctcccaaagtgctaagactacaggtgtgagccaccgcgcctggctagttgtttttttttttttttttaaagtatcccacacagtgctatattcatataactgtaggtctttgctgtacacacagatacatacactgtgctgtattcattgtggacagacagtaaagacaagttagtaaatataaagggggagagagaggtggttctgtaaataagattttttttttaaacggttcatttgtctattatctttctggcattatctacttttctttgctagaaagtgtttaacagcatcctgtgataaatattgatccacttaaagcatacagccttattgcatggcaatgacttagtgtagtaggtctgtggaaccaactgatagctgcagcttgaaagaatctaaaaatgggcagattctggtgcagccatgagttgctggtagagtggtttgggagtcttatagaaaactgggtgaccctgtggtgagataggcccatatcgcagcagtcaccccccaaattcacctaagttgctgtcacaatgtggtttgactcagattagtttagctttgttgtgtggaatttgcatccagaatcttttggatttagcagtcctccctatgaatcaaagaacttcataaaaaaattaaaagacaaattattgcattttaatgggcatttaacctctctgaagagctcctattgccttaggtcatgcagcttcattgtgagtcaccagagttgggtcatcccagtgaaatgatcagtgagaatgaaactagaaatttaattggctcagcttgaaagcctggcctgaagacaaggttattagtctcagggtagaccaggaacctgctgcctagcacagaaggatggtaaagaaggatttaccatgtcatctcttctgtttcagcatgtagtctactgcttgcccagtggtaagggcaagtgaaactggctccttctttttatttgggtaatagatatcccagactcagtgggaacagcttggcaggaagtggtggagcccagtattgatttatgtcttatatgatagttaacatgtgccatgtgccaaccctgggccaggcacttttctaggtgcttttaatccagtaattaattaatcttcacaaataactaaagagggggctatgttttttcccatttcacaaatgatgtagcagagacttagggagggaggggaagaaacttgtccaaggtcatagagctaaggggcagagtaagagttcaggaccaggtttgttgacatcaaaggtaataatgtagagtacagtggtgggttatggagccaggcagccagggtgcaaatctggacacaaccaccatcatcattaggtcactctgggcaggttccttaacctcttgctgctccagcatccccatctgttaaagagtgttcatgatattcatgtcatgggatcctgtggagataaaatggtgtttgacaagcacatggcgggcaactcagtaaattgtgaattgatgtagttgtttttcttattaagacagtggggaaactgagacctagaaaaattaatgaatggcctaaagtcttccagcaactgattgcaagaactaaagttgtaagccagatcttctgatcaagaataattctcttattccctccatatgaaagaaaaaaaaatcagaatggcatttttcaatgcccaaaagcagacaatttatgtgtacacaaaaagcttgatggatattatttcctaagatctgactaatgctttataattttccaaaacattatcatagatgatgtccttcttagtcctcataacagtctgacaacaatgtgttaacacatccactgttaaagagatgaagaaactgaactttcagggtccaaactgcagaggctgaaagacacattggtgacagagactgttcccaccatgtgctgtccccagctgctcctcagctgcacatgtcaccaaaccactagcacaagtttaattccctatgtgatttctcagtatcccaattagccagaggatatttttcactttcagataataacttgacagggaaatctgttgtatattccatttcaaatgcaaaataacatgtcttacaaaaaaatgctatcattacatgtatgtcaaatgaagccaatggcattaataaaccccagagtagtcaccaattttggactttatatcgatttcccaaaaatgcagaaattaggcttatttttagattatgactttgtgggctcagcaacagggctgagttaccttcagctcttccaaccacatatttaagccctgataaccttttgcagatactttgaaattcactgcgtgtgcaagttttttcctcccatgacagctaagtttttgaggtctatgtgatattggacttactctcttaattttatatttttttacatatctttgatgcttacagtgtattattcagactataacatttgagtaattatttaaaacatgtttttaaatgcaagtgtatatatttttaaaagggttctcaaaaggatgcaaattctctgtttatatgttttgtttatttgtttttattgggtttgttgttgttgttttgagacaagatctcactctgtggccaaggctggagtgcagcggctccatcatggcttactgcagcctcaaactcctgggctcaagcagtcctcctgcctcagcctcctgagtagctcggactactggtgtgttccaccatgcctgactaattttttatttttttgtggagacagggtctatgttgcccaggctggtctcaaattcctgggctcaagaaatcctcctgcctcagtctcccctaactgctggtattacaagcatgagccaccatgctcggccctaaattttaaatatttatcattttttaataccttcctgagtcttcaaatgcatgtaggctatatctatataaagcatgaatgtgcttactgggacacaaatttgaaacaggaagttattccttatctattctttaaaaccaattgttcacaatccctaagtacagttcatgatgtgggaattggggcaggttgttttttttttgagtgagactttgaagaaccagtgctattattttggaagttttggaacatgaaataagtcagtcatattcagagttagagcctgaattacttcttcccccactttattaaaataattcatttctgaaaaactactgcagggagagttttctgaagttgaaagtgtaataaatttggatgcagaaaaaatgtgtttctgatccccaaatcagcatccattcatgttaaaaacaaccaaatttcatcatgagggacttctatttaacattacttatcagagcattattcaaaaaggaattttccttccttctgctgaccactcacagagcaatgatcatgaagtctctaaacatcaaaccaaatagcctctcttcattctcatcttatttaaaagctctcttgccttaggctctgaaaaccttccttctctcctcctcccctcaccctccttagacctctcctccctgccttccattgctcattgtttgattagaccctgccctgagacttctccctctccaatcatcctctcttaatagatgggctctatctctgtcctcaccacttcccctcctctctccatctacttctggactgatctcacatttactatggcttcctattcagcctgagtgttgagggctcctagatcttcatctctagactctgagctccagatgaacatttccaccttttatatgcccctagaaactcaagttcatatacccaaaactaaactcattatcttctcttgataattcaacctgaggtcttggtcctcctcctgttttccctggtttggtaaatagcatcacagtccagccaggtgtgcactctggggacctgagtgtcatcaatgtgatcctctctccctcatcattcctaacccaagagtcacctaaatctgtttgttctatatccacagtggctctcacaatgcttccctccttctcttctcactcagacccctctaatccaggccatcatggcatgggaggagacatgctgatcttgccttctccaagccatcctgcagactgctctagagttctctttctaagtgcaggtctgaacttgtcactgcctgcctaaacctctgagagttcctattatgcagaaattgatctgttattctgctgtgaacttttaattcactactaaatagcgtgagctaatacatataaagtgcctaactcaacatctaaggagatgctcaaaaaatgtcatttatgctattatcactgaaggctccttcaagccttgcaaagttgatatgtagatgttcatagactcaaactgtaaatgtgactcatttatttcacattccacatgctgcataaagtcttcatacaggcacagaaccgatatctttatcgatttgaattctactagtaaattaaaagttcacagaaagataataaatttaaaaaacaaacatgtagcgactggtcaatgttcccttggcttcatagactatggatactaatcattacagatacttaagatataggctgggtgccctgggtcatgcctataatcccagcactttgggaggctgaggctggtggatcatgaggtcaggagttcgagaccagcctggccaacatggtgaaatcccgtctctactaaaatacaaaaaattagccaggtgtggtggcacatgcctgtagtcccagctactcaggagactgaggtaggggaatcgcttgaaccagggaggcagaggttgcagtgagccaaaaaaaaaaaaaaaaaaaaagatatacagatcatggccaggtgcggtggctcatgcctgtaatcccagcactttgggaggccaaggcaggcagatcacctaagattgggagttcgagaccagcctggccaacatggagaaaccccgtctctactaaaaatacaaaactagctgggcgtggtggcgcatgcctgtaatcccagctacttgggaggctgaggcaggagaatcgcttgaacccggaaggtggaggttgctgacctaggcaacaggagcaaaacttcgtctcaaaaaaaaaaaaaaatacagattattttacaattccactgaattgcaggggaattataaggtagctgaggtgtacctagctagccttccacctcatcttttggctttctctcagctccttccacaacagctcagccctcctccttggcatatacacattagttgaacagatttctgggcacctgccttgtgtcaggcaccatgctgggcagtgggaatacggcaggtgacataaggtgagatcatcctaagtcaagtagggctgaggactggggaaggggtgggatgggattttagatgcaggagtcagagaagatttctctagaaaagtaatatttaatcaagacctgagtgctgagaatgtgccaactaggggaagtctgaggaaagagcattccagactgagggagcagcaagtgcaaataccttgagggaagctgcttagcactttgcctgaaccaagagagctgggtcgctggaacctagtgaaggagggtaggagatgaggtaagagaggtagggtcttgcagatcatgatatgaagttggcatcttattctgcttagagtgggggccactggaggacctaactatcgaattacatttttaaagaatatcctggcttctctgtggagtgtggagaggcaaggatggaggcagggaggagagtgcaaggcagggcctgggtgagagaaggtggagctggaatgggagtgagtgtggaaaggcaggtggtgagacctggcagcatcccacagtgacacattttgttgccctgagtttttcatgaacactcaatctgagaggacccatttacaactaggagcatatctgtaaaaagtggaatcataagacaagtacagtcccctaagtaaggcacacagggtacatctcacttgggggcgtaccacaggggacactctctagcactcctggcaggtggatagttttggttaatagccctttttatgctcttaaaaatcataccacataagcactgacccttaaaagatgactttgcctgccagggataagggagaatgctgctcactttcagatacaaactctcttctaggaggccaatgtgctcattcacaaattttccttgagatcttaaagatttgatggacttcttttaaaaagcagtgagcaatatgctacctactgtcacaatcagagcagacaaagacaaatgcttttatgagtaatttaattcctctccctgaggaagacatcctcagctgtcagcaccatccccggtgacacgcaggcgatgtgaagtgactgttaaaagcagcagatggtgcttcttacttcgtgtttacggagcacccatagggtgatagttgcttccaatgccgcatacattaaaatatttcttcttcttctttcctttcccctaccttgtgggtttcaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctgtgagtatttgcatcccaccatggctgtcactaactcagtgatgacaattatataaaccttagcaaacacttgtatttactgagcccctaccctgtgccaaacactgctttgagagtacatcatttgggctatctactttaatcctcacaatacccctaagaggttgggattatcattatatgcatttcaaagataaaaaacttaaaccatatgaggttaagttgcctgatgttaccggtgaggctggacctaatacttaagctcagagttttgggtccagagcctatgtccttttctctggcaattgcttccctctagatgaactggaagggaggcaacaagtccttcaagtaacctgggacccattttggccccagtgaatttgggtggaactgttctgcataatcttgatcccctttagtttggaatatcctgtatccctgctcggatattttttggaagatgagcatgcattaaatgtcacataaccaatctgcagagatgcagagctggcaagtgttgggatggcttggcaggggcttggcagtgaagcattgggcattggctagcaaggctcccacagaggaggcgcgtcccattgcccactttgctggctccttgctgggacaggagctgccctccagccatactgcattgtcccagttgtcaaggtcccaagttgtcatactctcttggcatttgttctggtccggccttccctgaccctttcagatggtcttcagagatcacccctgccccactcctcctttgtaacccttttaaaacataaccctctgttagctccgcctccccgccccaattcagaatgagataaaacttatcaaggtcctgcaaggtcctcctccctctccaccctcagcctaggtgcctgcttggtttctcgtcactttcctccctgctccctgcactccgcagggaagccacaatagctttccttcccttcttcaaagagccaagtgcatgtggccttggcacatcctggagagctctgccttccccgaagccgtgcagcgcctcctgctccatccccaccccactatctcctcacagaggccttcctgcagcagtcccacccctctgtgttctcactctgctgtttcactccatatcttattttctattcatgtttgtccatttctcccactaaaatgtaagccccctgtgactctgtcttgtttgcttctgtgtccccatgcctggagtgggaagaggcaccttgaggatgtccagtgcatctgcagctggccctgtgcctgctgcccttgcgatccacacacctgacctggcataggactcctatggaatggggactgttcctatttctcttagcatccccggttctgagcacccggtagatgctgaatacgtgtttgtcagatggtccagataagcagtagagagggagctaagaaggaaggaggccgtgagaattcaaagataaagattggcaaagaaattccagccataagcattgctagacttggcatgtgactggatgaggaatgtgagggagaaggaggggtcaagggtgctccaggtttgtgcaggatttgggtgggatcatagggcaggcagaggaggaacggatcagtagagaagagacaataaacttggtttttgagcaatgagataaaacacatgattgcgtgcaaagtgggtgacagaagcagggatggatgagatagggagattgtgccagaattcagtgaaagctctgataccttcattgagaaaatcttgccacaaacaaacaaacaaacaaacaaacaaacaaaagtctattaaacccagcaatcccagcaattccactcctaggtatacacccaagagaaatgagaaggtagatatctgcacaaaaacttgtacacacacattcacagcaacattactcataatagctgaaaagtgaaaacagtaaccaaaaagaatatatgtattctgtcaccaaaaagaatttatgtactgacacatactatgacatagatgaacctcaaaagcatcatgctaagtgaaagaagccagtcacgaaagaccacatatggtataattccattgataggaaatgtctagaataggcaagtctggagagacagaaagtagactggtggctgccgagggctggaggtgggactggagggaagagatgtggcagggtgggggacacaactgctaaagggcacaggatttctttccggaatgatcaaaatgttctaaaattaatattgacggtgatggctgtacaactctgagaatcagctaagaaccattggattgtacattttaaatgggtgaattgcatggcatatgaattatatctcaattgaggaattaccaacagaaagaactgaatggaataaaatagcaggtagatggaattaatcatgataaaaagcagacatcatttaattaaacaatagggaaacaaatgataatttttttaaaaaatgtaaactgagccaaacagtgaaccaaagtaaactaaacagttgagtgatgaacttggtttacattctggcacaaacccctgctctctttaggagtggcagacagttctcggcccagctgctacccaccaagtacactctgagcagcactgtgtaggcaagtgagtccttaagtgtgtgagagaggtccgcacgggcgaggatggctaggagaagcctcatcgaagaaggactgcccagcttcgtgatgtttgctcatgagcagttgatttttatgtgcatagttgtgaagcatttggaagcatgtccctaattttctttttcttcttccccagagactccaagtgtgactgtgacccagctggcatcgcagggccctgtgacgcgggccgctgtgtctgcaagccagctgtcactggagaacgctgtgataggtctgtgtgaaccgtggccctacaaacagcagagagagtcccttgccaactagcatgagaattaatcctccgagtgtaattatggaaaagggatacttgacaaacgttgatgaccttcttcctgctctctgtcctcaaaaactaagcttttacaacaacaacagcaaaaacacacacacacactgagcacccaaatctcactggactccatactctgctctgggcaccctctctttattttgactttgggagaggcacaggaccccagagattcctcccaccagctggctccaaatcccaggtgctctgtatgaggcagtaatcaatagtgagatcctgggacacaggctggttgcaggaaaggcctggcctaattaaacatgctgcgaaaattcttgtaagagggcctatcacagcatatggccatatataaccatcgtgtacagaagaggcactgccctggggataggatggcagttacatgcacacacatgaatgggcatggggctgggaggaggtaagagccctttgggccaagccacactggaggaggtggagcagtgaggcaccatccccccaagctgccggtgcaggacgtgccttaagtacaactgtgctctggctttaaactcttccctcccagaggctgttgagcagagggctgtgaggctggcgtcagaagcaaaggcttcctcctcatttccttaaaagtaagaaagcagttctttggcaccctgccagtcacttatacctgcacagaggaaatgtcaaatacactcctagcttgtgttttcaggggtttctggctgctgaggtgaaggcagggacataaagtttaagtgttaaaaaggaagtcacttgttgaaagcctttttaatttcaaaataaaagacagaaatagaatgccacataaaagaaatgttatcaccaccaatggtaagaaatagacctctgctaaaactgcgtcccagtgacaatgcccccctcctccctagaagtgaccactattctgacttttatggtaatcgctttctttctttgcttcataatttatgaccccagtgtgttcctaaacacaatcatttagttttgcctaattcccttcctttcccttcttttgtcttccctccccactcctcccctcccatccttccttgtttttttaagctcttttaatcagcaggtttcttctccatagaaaccataataattcttttaactcttgctcttagagaaaaaacaaagcttgtttagttacaactgttctctgaagcacctgctcttcacagctaccctgcttttctgtgatactgtactcagaacattccccccaacatgtggtgcagtggcttagactacatgatttggagacagatgtacatgaatttcaatcttgcctcagccatgtacctgctatatgtcaagagtttcttaacctcttggccttagtctcctcatctaagaaaattggaaatagcaattcctcatagggttggagggaggttaaatgagagaacacacacaaggtgcctggcacaacataagtgctaaataaataatcattgaaactatcgttatttcacattatttcatgtggaaggatgtagttaacttgagcagaggacaaacaagtcctccccagcttcccctgccttcttctctgtgactccagcatcgaggatgcccctgttagtcgtggttcttatagaagccactggagggattgagctgggagcagaggtggaatgcaagcttacacctggcttttggagagtgtcttagccatcctttttctttgtcatatcctcacctgcccttttccccagtgagccagagcccaggtacaagagtcagagatggggatcaatacctaagtggtcttggggagggggtcaatagagctgagtggtgctgaggcaggagcctcacctttcctggtccccacctcccagtctttgtcaccattaaacagtagctccaggacagggcagcattgcatagccctgcccacacccattctgctcatctgaccaccactcaatttcctaccaaggactggccgactactcagatgccagaccaccaagacaaatgtggctctgttctacaaaggaacagaaagtgaatgtttcttatgccgtctaatttaggggggtcgtgattgtccatctggtggtctgggggtgggggtgatatgcaaaatctggtatttccctcctctgaaaattaatagggccaaatggaagagaaggtagagaggctgactcattcatcatattttttctatagaataaaaaataacctataatatcctgatttctacaatgccactgcaggtgtcgatcaggttactataatctggatggggggaaccctgagggctgtacccagtgtttctgctatgggcattcagccagctgccgcagctctgcagaatacagtgtccataagatcacctctacctttcatcaaggtaaagccttctattttctaggttttagttttttaatgttgtacagggctttgtgtttagagacaaccacctccgcattcacaggatggattctctttagaaattctcttatagtattgaatgtacattattttgtcagggcactcaggcatatcctgatgtcttgaaaaagtcataggctgaaaatagttcattcatactagtgaatataacttaaaagaataactaaaaaagagactagatttttatttccctgaattttccatccccatctatttcaaaaccacgaaggaatcattcatttggtttggagagtgtatgagtcttcctggaattcacgttcactaataatgctgttttcacatataataaatgagctgatttatgtgaaattagttcccaagctacagaacactataaaaatattggaaactgatattatttcaacattaagtctgagtttccctttgaaaagactggacccgggccaagcgtggtggctcacacctgtaatcccagcactttgggaggccgagacaggtggatcacgaggtcaggagatcgagaccatcctggctaacatggtgaaaccccgtccctactaaaaatacaaaaaaattagccgggcgtagtggtgggcacctgtagtcccagctactcgggaggctgaggcaggagaatggcgtgaacccgggaggcggagcttgcagtgagccgagatcgcgccactgcactccagcctgggtgacagagcgagactccgtcttaaaaaaaaaacaaatgaaaaaaaaatgaaaagactggaccctctcacttcattaaggtgagagctttttatataaatacaaaaaaatgcaaattacaggcagaagaaaacctgctatcttatcacgagtcagactcaaagatgagaaatcatagcagctgcgggatgggagcaggtgaagttgagagccacatagagagatacatgcagaattttaaggaccatttgcaaatgtggaaatattgagaaaaccccactttctactcaccactaggacttgtcggcaagcaaatctttctttgtttaacttaatagatgatgagggcttgtccaatgcagactgattatgtttgtgttccagatgttgatggctggaaggctgtccaacgaaatgggtctcctgcaaagctccaatggtcacagcgccatcaagatgtgtttagctcagcccaacgactagaccctgtctattttgtggctcctggtatgtgaggaataatgtctcctatagaggccagcttataggactaggaagtcaagatagagaaattgagttagaaattgtggaaaccatataactttgggttcagggtagcagcatctccgggtagtgcaaccccagaagagagatgggggctaagcctgatttgagagtcactaaggaatggcccaacagagcagaatgtggtgtcccagaggtcagaccctggttgagctacctcctttaatcaaatgggaagtttctacgtttaccaccaaggcaagaaaccaaggactgtggccaaacctatgggtctattgagaagtaggtggaaagcaaaaacaaagcatttcttaaaacttcaaatacctgtaagttaaaaaaaaaaaaatcaatcagtggtacgtgccttggtggaaaagcgctggctagaattccgatcccagttcgtttccttagctcatatgtgattcttgggcaagttgttctcttaacttctctgaacttcagttttctctactgttaaatgggaatactaatgtctgcctcccagaattattgccagcaaatgtgatgatatttgtgaaggcattctgtcaactaaagcattatgtaacaagttgtgctatgctgataggcctgggatttttacaaaacagtctgtcataagggccacatcatgaatcacctaatagatggaattgtcttataacaaggccctcttatcatttcagtaactaaccctccttcatagcccaaagtgtcatagccatgtccagtaccaggtcctgactctcctagcaaggagttttggggcagcatgacacaggacttcaacagaaattgccgacaccagtgcaaacttgcatgtgtttgcctctccagtttcacaactgatctcaatcttttaaaactctgtttcacagccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggtaaaaagagagaccataagtaggtcaattagagcaaactatgattgaagttcaagtttgttctttattcattcaatcatcattcatttgttcaacaagcctttctgagcaccttttacgtaccatgaaggttgctatgtgctgagaaaggacatgattccttccctcaagcagctgacaggctaatgggagagaaaaatgaatagataattacagtgcagtttgtcaagggacagaaataggcaaggtggacacagaagttctgagcacataaaggaggcatgactgacccacactggaatgatgaaggaaagcttcccaggaccacatgacaaatgtgaaaggcagccctctaaggaaagagaagggaggaaaggttaacaaggcagaggaaatgcaatgcttgaagaaggtttgtgcatttagaaaattccaggtggttgagcacgagtgaagcatgaagtcggcgataggagtgcagtgagaagtgaggtaggagaaagaggtgggagtgactttatggatggctttgtgtgtgtctacagggattgcacagtatcctgcagaatagggattctgcatggtgtttgcagagaggttggggaagggagctgtgcctactaagtgctcagtagtgcactggaggctgggaaataaagatggaacatggtctttgccttccaagagctcatggtctagtacaatgtataacatgtcaaaaagcaagcataatacagtaggataattgctttaggggtggtgcatgttcatggggtcttggaaagtgcccgattctgcctggaggagtcagggaaaccttcaggaggaggcaatgtgtggtctaagaatggaaaggtccacagggcttttccagggagaaaagtcagagaagggcaaccttcacatgtgaatatatgtggggatgcagaaaggcataatataggggagaactggcaagcaatatttatagctggaatacagcatgcataaggaagatgggtagatacatttgcaaaggttggaaaaggacccatcatgttgggccttgtgtgtcatgtcaaggagcttagatcttgtccatgctggaaagacgatgcagagccattgagagattgttaagtcaagaagtgtgatcgtcaggtgtgaaggctaggtgcaactacaggcaccatatagatgatagtttgggtcgggtccttaactggaccatcagaacacattcagagtggctcaactgagagtggttaggtgcctaacccaaggcaggggtaatggcaatagggaaaagaagacccacagaacacaaacaaagaattgatcaaatatccgagtatacgtgttctaatgatacacacacacacacacacacacacacacacacacagctctcctgcctggaatactcgttcccaccttccaggctttgtgaacttactctttgagattcagcttacatgttcttcctttgtattagccttctcagaatcccagctaaagttacagtcactttgtttttccatggtactctgtgcatgcatctgttatagcattcatggcattgtattataactgtgtctacccacctgactcccctggctggatgtgatcatctctccctgttgtctttgtgtcctccagcctgacatagcttctagcccaaaccaagtgcacagtcaacttttatttaacaaatcagtgaatgaaacgaaggtgggtagggttgttcctggatgagtaaaaaacaaaacaaaatttagaagaacagcacaggggctggtgatatgttacagtgagccaaaatgatgccaaattaaaaagtattaagtgtggacaatgtaaaagtggaaactgatttttgaaaaaagtaagtaaaatgtgctcagataacaaataaatgattttttttaaaaaaaatgaatagtagctcttgagaatcagaacttctggaacgtggagatgttcctaatactagcttatgggtggccaagaatagaaagtggtgtctgagaacttgcgatcatcatggtttcaggtgatgtcacccctggatctggacttcccacactgggatgccctccatcacttcctctggggtttgtcctccccatggagtgaggaaggtccaagtacatgcctatgaaaaggtggctctcagtcctatgcccccttctaagcaggactgggaaggggcttagctgttcccgtatcctcaggcataatttataacaggtaggtatgtggtaagaatcggatttttaaagcttttgattttaaattatgcaggttaaatgagcatccaagcaataattggagcccccagctgagttactttgagtatcgaaggttactgcggaatctcacagccctccgcatccgagctacatatggagaatacagtaagtggctacgagaaattaatttctttcttcttaggtgttagtttaatttgattcagctctctaaggtggcggcagtctccaaacaagtagataagttacttgatgatcctgacttagaatcactgattcaatctgaatttttatattctagaagcttttttagaagaaatgtttctctaaaaagatgtcagcacccagcaccaatgaagagtaaatgatgctgtcttgctaaaagggccactgaatttttattaaagatgattaagtgagaaagataatctacaataaatggacacatttccttagctaggaaatggcacctacaacacagtcttatttattccttgagcagcttttccttttgagattatactccatgctagcctgtctgagtcatcatgtattctattaattccttttttttttttttttgaatttcacatgttgggtcctcctaatctcaactggaattatttaacaagagttccttaagcttttctgcactcactcacctaaaaaggaagcgtggctagcatgcaccatttccatgtcactgatgcagtaaataaagtcggaagcagaaaggtgtaacaatgtattgactcttactgtatgccagatagattataatatatgaattatctaatttaattttcacaacggacataagagataaataccaccgttacttcttgtctatagttgatgaaacacagtcatggagaggctaagtgacttgcccaatttacacagctagtgagggtggattcagaatttaagccctgggttttctgaccccagagcctgtgtgctcagtcacagtgggagactgccatacctctctacatggcatgatatatgaacaccacctgtctttgttagggagttaagaaaaataaaatcccaagagagatctgacttgagatctttagactgtaccacttgcaacttctaacctgttctctcgattgcaggtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggtgagtgaaatgacacctggaccaggtggctggggtgtcatgtggaagagagagagctgtgtaagaaagaccatggctgaactcacatcagaggtgggaaaggattaaggagagcagagctggagtcagggaagatggacatggtgccttattacactcaatcctcttcactgtggaaatgccacaaagttgtgagaaaggtgccaggttacaggaaatggtcgtcatggttcagtgctgggtagaagagttggtgtcgagttccaagaattgtgtggggagatcaaagacaagtccgggtctaaatgaatgtgccgacaaatggtgtcaggccacagagaacatggggaacagtgttaagttatggatagtaaaagaagtgagtgtctactttgcataggggagtgagggtgagattcagggtcttggccatgtttagatttggttctatgggaggggtgaatgccagtgctcaggcactttggggaaggcttcagaaaggaaggctttgacattctacactctgacccatgttgaaggaaatgtattgtctgaccctgctcacttctctgcccctccactcttctcctacccccaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtaaggccatgggtctgctctgccacctgcctcttcctgtcctgatgccatgaatgtgtgcaaatagcttccattccgaggaattcctaggaaattataatgacttcgggttcacccaaatgtgctcactctaaagataatatcttaaagataagatattgcaatgcccaagaggtgaagtggattaagcaagagcagagtgcaattatgggagaaaacacctaaagctgttttgagaggtttgtcattagaagatgacattttcagaccaagcacatggtttgtttcttaatgaactaagataacgagggaaaacttagtgacttcttaaatgtcacatccttctgctggtcaatctgaaagaagaatggattcttcagcagcagttttgggggtattgctcaaaaccttactacttctgtggagctgcctgctttttcccagccagctagttaagcctcctagtggcgctactgtgttctgcaacctgcagtgggcatggagagagagggccagccctgccttgcatgcctgctcctgagggctttgttctggggtccctagggaagcacatttctctggctcttctagagggtgactcgcaactttaggcctctgcgtctggtcttcctcctgatggatgtcgacctaggcttggtcatttgttccttcccaggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgaggtaggactccaccccaggcaggctgtgtctgtgcgtgcctgtgtacgtatgcacttgcttgccatctaagcagggacaatggcagttcatatcatgatgttactttgattctctgaccaaactggcctgtgagcaccctgggcctttcttcctctgtcaaaggccttaagacaggtttaccctgtagccaggctctggaagacagagctgggttaaagctgggtgggagaagtgaaaaaggtcaggtttacattcctacgcggaaaaggatgtaacacggggccacatcctatgcccaatcccaaggcagggaggcagggaagtggctgccaaacctgttgtaggagagtaataaatgacttgagagtaagcctaagcaaactcaagtgggaaggggagtgggctgtaaaatagtttaagagactctctcaggaagtcagcgtaattgatgtgtagaaaggtaacagtcaacagttctcctaacaagacagcttcaaagcagcagctatagtggagcattcctgaggcctgctgcagatcaaagcatgaatgtgcagactggtcctcttgcccagcgtttctttcaaatctttgcacatgttatattttagaggcaagttcagttctagaggagctggcctgccccacagactcacccctcagtcccaggctgaccttggtgcccagaactcaggagtttgtttaccctaactttgtttataaagtccagaatggggccgggaatggtggctcacacctgcagtcccagcactttgggaagctgaggtgggtggatcacctgaggttgtgagttcaagaccagcctggccaacatggtgaaaccccatctctactaaaaatacaaatattagctggacgtggtggtgggtgcctgtaatcccagctactcaggaggccgaggcacaagaatctcttgaacccaggaggcagaggttgcagtgagccgagatcatgtcactgcactccagccgggcaacagcgcaagactccatctcaaaaaaaaaaaaaaaaaaagtccagagccactctggacacccaggttggaagactcttggttcctcatgaagacccagaggtttgcatggagctcacagcctcccactcacaccagagtctccaccttgaagtgcttgaggacctctgcaacctgaggcttctacttagtggtacaaatcccttcaggaattctaggccagaccagcccagaccccaaactctgggttagctgtgatatgctagaaagcaccttatgagaggaaaagcccatatgacaccaacaggactgagttcaagtccagttttgtaacatacctattatattatgctaattatgccaattaatccctctaagcctcagtttccttatatgtgtgattaatatttaactcgaagtggtggatacaagaaagcacactataaacactataattctagttatatattctaactatattctgtctttagttttagctgtaattctaggttactaacagaaatttcactggctttacaccacacatttcttcactcaaccatcctttatcaagcacataccatgtacccagtgtggacctagatactgaggccataatggtgaataagtcatcccaactctcgaagagtccgtatgataataaggaagatacacaaatatgtatgcaaataatgataacacacttagatacgtaatcagcgttttgtgagcactgaagatagaacaactcagagaatcactgtaatcatcagagaagtgtctcacccactatcatatccttaactcctataacagaacctggcttaatcaatttggttgaatgagtaaaggtattgctttcttaactgtatttcctacaccaaaggccgcagaacagaggaaagaacattggctctgcctgacctctcattgtagcttgccatttacttgccatgtaacctcaggcaaattagtcaacttccctgagctcacattcctcatctgcaaaatagagggggatgtctacatctggcacgtaatgggcccagaagaaatgttattcaccttgaaagcaaagccagagtgcttgcagaatatctaataggcttttagtttaacagggggaggaaaatgagtgctgccagaaaggctgtaatctccctgcatccacacacaccaggcaaacctgccacatgattcctaagacctatctgtattaagaaggtgcatggaggtataaaaggattctctgctgttggaggcttgatctccttccttgtatctttgctctacctccactttctagactagtttgatgtgaatgctccatttgtcttttgtctctagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcaggtatgcattcttccccttaccacccccaaccccacagaatcaaatccttaagtgtccactgggtggttctgtcacagatctaggacactcctagtctcctgaggatgggagtagtgattactatttctgtctttaaaaattgctgcattaaaaaaattctgtataatgataatacttcaggtttatgtctttatatataccattttcaaaacctcttttgcagatactgtttcatttggtactcatgataacttagttgagttgaaaggaaaagtattctgacctcagttttcactggtcaaataaagtctcaaaatacttgaaatttttcaaagtgatatgggtaggtggaactgggaatcccacccatgtcccctaacttagttcagggctcttcccactataatatttcactttccagctcgatttcttttcaacagatgtctttgtaaaacaaatgaagaaaaacataaacataaaagatatcaggagtccagaaagtatcaaggcttcccaaaaaggaatggcctccagaaatttctcatttgaattacagagaagaatgaacttgatgttcttgttaattattaactatttttcttcctggaatgaggattggggaagacaaaggcccaaacagaactccaaatgtagagcaaactcaacttgtttttcaaactgatctatttaacaagccttttacgcacttcctttgtgtcaggcactgttctcttgtctctagcttgcaactgctttcactttacaaatattaactgcattttgagctttatagatgttaacccaggtagtccaagtaataactttaggagacactattcttattttcattatcctaattttatagataaagaaagtgacttgcccaaggtcatacagctagtgagtagtgaggccaggattcaaactcaaggactctctaggctccagggtctaaaattttaaccaccatgacatgctaagcatttctggacttttagtattatcccctgggtacctggtattggatgatcccttgggtacatggtctccaccctcgttctgatctttcctgtgtggtttcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgatgaaggccaacttcccttcagacagaagagaattcatagtcctagaaggaatggctacgttaggtcatagaatcttctatggatatcagttcagcagttatctccagccagcccttgcagaagtggaaggactgtctgtggcattccccctgggatctgaatgatggtgataaaagaatggttggatgcatttctctattgggtttttgtcatttgaccataagccagtcaaccctccgttatgtttgctaactctatgctgacccagaaagtgctcatgctccctttccttctttgcgttcaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactgtaggtttttgctgggctagagtattgagaatactgctgtgttgggagacctacttgtagatctcactgactcaatttctgtctctcagtggctcactttctgtttctgatctacctgacaggttgttggacttcttttccttgcaacagtcacatctatttatgtctttggccttctgaagtttcctattttactgcattatgttcttctcctaagttcatttatttctaactacatcctcatcttggccctgcctcacctcccttctgcatatctcctagcttgttagctcccagagggcaggatttactttagttcatatttactttctcagcctacaacacagtgtatagctgtggtaaatttctagtgtatgaatgaatggataaatgaatgaatgaatgaaaaaggaaggaaggaaagaaggaagaaaggatggaggaagggacagagggaaagaagaacaaaggaagagagtagggaaggaaggaaggaaggaagacatggttttgaaaatgggaaaaaaatgctgccagtatgattttcttgatgtagtttgtaatgtggtaggagggagagatttgattgagcactcttctatttctgaataaagaaggttatggtaacaataatgtaaatggatgggtgggagatgaatagaggaagtggaatgataatcagatactataatgaggaagtcacattaaaaataatgtgtattgattgtttcctttattacagaaatgtttgttgtagaaaataaataaaaattctctatgatcccattactatcaaataaccactgttaaaatttggaatatattctactggactttaaattcatataaaaaatgtacatgtatatatttttatttttattttttttggcttccagcaggaaaagaatttttattttactttgttgttgttttggatttttttatgtatatatattttaatgcatctatatctatatacagacttttttgaacttggatttctttgctcttgtctatacatactttttttttcttttttttttttcgagatggagttttgtttttgttgcccaggctggagtacaatggtgcgatctcggctcactgcaacctccacctcccaggttcaggcgattctcctgcctcagcctcccaagtagctgggattacaggcatgcaccaccatgcctggctaattattgcatttttagaagggacggggtttcaccatgttggtcaggctggtcttgaactcctgacctcaggtgattcacccgccctggcctcccaaagtgctgggattacaggcatgagccaccacacccggcctatacatactttttaaaaatagaataatggtgaatagaggcatggtgtaagtgtcagggtgtggaaccctgtgtggctaatgacaagtggttctgacaggacagatgcacctgcttaagttccatggccaagtgcaaagccttaaccgattcgccttaaccgattctccttttcccacagaacattcctgcctcagaccactacgtggggccaaatggctttaaaagtctggctcaggaggccacaagattagcagaaaggtgagcagcattagagggcacctctgcttcaagccgtctctgcaaggccagacttgaataagagtgtagggtattagggacccaagcatcgtatttattctctccaggctcctttgcagccattccctaccttgaaaccagtttttaaccacttggcttttattgtatgtaagtggccactgggcagggtcatttggcaggagttgggggtgagggtgtttctttcccacatttccctatgactcacagtatggctgtgttgtatgtcagatgtgattcctcgggccacgtgaaatgaatcagcccttggaagagaaagctctgcagctttcagggactcccacaccaagcctgggaacaagtagcaacgagttgttttttagcctgtgggggccaagactgcagagggggaacttcctcctgaaaaccggctctgcagggccccaatgataacacgcagctcccttcatccttggctctgactagaaatcctacggtgtttaagaggtttgctggtagcggtctgctcagcagggtggcaggctctgttaatcccaagtggaattcagtcagcggaagagggctgatttgtatattttgtaacatgagctgcctcctgagctcgtttttaattttgtttctttgggttttttttaaagaagcactttttagaaccaggaggaaccaaaagtatccagggaatttttatagacatgctttgtccccctagtggtgggcccagtttagagctgaagcgaaagtgcgtaaaggttggatcctgggtgaaataagacctagaggtttcttcctgcagcaaacagcttacagatgcagtgttttatcacctgagactgctcccacccatctccacactccaccccgctccgggactccagtgattatgccataaacggaaaagatcactacaaggtctatgacataaggcgaattctccaaaacactttctgcttcttgacagcacctctaattccatgtaatttgagtcagttctgtagggtttttctaaatcagaccagctcccgtactctttgcccttcgtgtaactgaacaacctaaaggaagccctttgcgtgaaaactcttattcttttgtttttaatcctttcagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaagtacgttcctacgggtcctcccgtggctcattataccttggatactcccagggcaaaatgctaaccgtacttgaggggcaccatgctagttgtaaaaaacatattattaatgataataagagggccgaaatcatgggagttttactttggggaaaagcagatatttttaagactggaagaaaaaaagattggttagtctaaataaaattaatgttttgattgagattacaatactgggaggtatggtcaccctctggtgtttgaagggtgtgaataaacccatctgatggcatggggagatataaaaatacagaaatatatttctgttatcaagaagtggggaatttgggattgaatttttctgacccaacctgtgtaaattaaaaggcttatgtttagtggagagggacaagtatctgataaataattttgtttggttcttctggttattctaactacatactttcaagacaacagggtgaaattttgcttttgttaaaaaaaaagggggggccaggtgtggtggctcactcttgtagtcccagctacttgggaggctgaattgggaggattgcttgagcgtgggaggatgaggctatagtgagctgtgatcacgccactgcactccagcctggacaacagagtgaaaccctgtctcaaaaaaaaaaaaaaaaaagaattctcaaagtcctctttttattaccgccccctccccacccccaacaccagattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtgagggcatctggcctgtgtgcttgatatacaggagggccataaatactttcttttctgggggtgccataatattgttcaaacattcagctttttctccatgttgaccatttctgttttagagtgggaagagtatttagccttctcattacccatttgcttgttcttaaaccacaatcctagtctctggaaaggatttgacccatgctaaacctattactggataaaagttttatgtatcttccttagttctggggattgttgaaacctgtggaaaatttttataaagtttttttgtttacgcttgagtccaacctatagtatatctctatgtatagccactctgagatgacttcttctcaaaagttttgcattgtttctgccatcagttcctttaacaattccaaacttattcgattaagaagattttgtttactacctatagaaaaaaaaattcacaatccccatggatatatgttcccatgaatatataaactaacatgtaaacatttaaaaaatgaaaaagaacagagacaaagcctgtttgacattgaggggacctgctgccttactttcattgggcatactgactcatttttgttaggttttgggcctggatggctagtgactattttcttggcttcttaaggctgttgctattttcaaacaatggtgccaggtcctaacaaggctggtgtggtaactggtaagcagaagtcagactccctggtttctttgggctcataggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagaggtattcttttgttaattcattcactcaataaagatgtattgaatgcccaccatatgaataaatatggcaagaagaataatcaaaagctctctgaccaggcacggtgacttatccctgtaatccccgcacttttggaggccaagccaggaggatcgcttgaactcaggagtttgagaccagcgtaggcaacgtagtgaggcccccatctctacaaaaaataaaaaataaaaaaatagctgtgcatgatgacacgtgcctatagtcctagctacttgagaggctgaggcgagaggatcacttgagctcatgagttcgaggctgcagtgagccatgattacaccactgtactccagcctgggtgacagagcaagaccctgtttctggaaaaatcaacaatgaaggcactgcttatggaagaagtaacagttgcagagatcttggtgtgattagctcagttccacccagtcggtcagccctcaaacctaggaataggacctaggcctcttgggtctaattttggtctagctcagtctactacttggcttcaggaaatatctagagtttaaaattatgatttataaaaccgttcctgtccctgatggtggactagagtttctctatatggaatgtgttgtggacttataaagtttgctctgtcccagattgtagaggggtttgctacagcacccctagactctgcagtgaatcacaatgatctgctgtcatgaagagaaatgtgtcagagtgattttgccagcaggaatgtacttcctctaatcttgttctatctgcctttttacagaaatcagatcagctgctttcccgtgccaatcttgctaaaagcagagcacaagaagcactgagtatgggcaatgccactttttatgaagttgagagcatccttaaaaacctcagaggttagtacttcatggttcaggtcacttgagtattttaagtgtatagtcatgaccaatttcctttgaattctcatatgtctctctaagtggcaggtatattgggatattaatagatccttagtaaatatctttctaaagaaaatcttaatgcattaatatttaatgtagtagtaataatagagctagatgtcagaagccttgagttctgatctctgctgggccacctaaccaggccagactagctgtgtgaccataggcaagtcatgtaacctttccagaacctagtatcttcctctttaaagagacgaggttaaactatgtgttctctaagttctctcacagatgcaacataccactactgtacagacatttttccttttcctgtgtagtctggttggttccagtatggaactgatatgtttctttgtggtgataacagagcaacctttgtcactgcatctagatcccaggagatttagatttgtgcctcgcagagatttcattaaaatttcaggcttcttcactaaagcacaaaagagaaacattcccaaaattttggaattttcttcatggaaagtacttctctacccattcaaacctaaccccaattcttatcattggagcttagggcttaaaactctggcttgatgctttggacttcaaagattctacctgcttctgatgcactcttcagtttcaatactcttgcagtgctgtggaactcagggcaggctgattgtcggtttctctaagcaacggagtaattataacccctccaatgcatcttttaagaaagttaattccagccgtaacttcccacaccgtcatccccagtcagtaataacactctttcaggaatttttctttacaacatcagcccctttcactcatttgtaaatttgctttcatcttcacggcagttttttcttttcttcatttcagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggtaaagagaaatcgacatgtgtgttggtgccagtagcaccaaacacaagggtggtgtggagggaaaaagaacattgagcttattttaacctctgaggctcagagccctgttgtggcccatgggagccccagattaaaagactatggtagcaaagacgcatgacagagaatgatgtgtttttttgtcctccgggttttcccaaatggttcctaactctgttcaacatttggtgagcattgaactgagagagaagcactgtctggccgctgaccttcctagtcatacccccagattagcttgtttgaggcagagcttggcaaagtacccctgtccctaagtctgattctctcattattcatctaatttactccatcagggcccggctgccgctgtattttttctatggttgtctttgggatgtttttgtgcctcacccctatctctccttccgtccctggctccttttcttctctcaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgagttcctgttgctttccacgggagatccctttcaacttgccaaaatggaaaataccttttcaaggctggtttgtgcttatttgtcctcaggtgattacagaagcccagaaggttgataccagagccaagaacgctggggttacaatccaagacacactcaacacattagacggcctcctgcatctgatgggtatgtgaacccacaacccacaaccttccagctccatgctccagggctttgctccagaacactcactatacctagccccagcaaaggggagtctcagctttccttaaggatatcagtaaatgtgctttgtttccaggcccagataactttcggcaggttcccttacatttactggaccctgttttaccgttgctaagatgggtcactgaacacctattgcacttgggggtaaaggtctgtgggccaaagaacaggtgtatataagcaacttcacagaacacgagacagcttgggaatcctgctaaagagtctggcctggaccctgagaagccagtggacagttttaagcagaggaataacatcaccactgtatatttcagaaagatcactagggcagccgagtggaggaaagcttgaagagggggttagagagaaggcaggttgagactacttaagatattgttgaaataattgaagagagaaatgacaggagcctgctctaaggcagtagaatggtggctgggaagatgtgaaggaagattttcccagtctgtgaagtcaagaatcacttgccggccgggtgtggtggctcacgcctgtaattctagcactttgggagactgaagcgggtggatcacccgaggtcaggagttgaagaccagcctggccaacatggtgaaaccctgtctctactaaaagtacaaaaattagctggatgtggtggtgggcgcctgtaattccagctactcaggagtctgaggcaggagaatcgcttgaacccaggaggcggaggttacagtgagccaagattgcaccactgctctccagcctggggaacagagcaagactgtctcaaaaaaaaaaaaaaaaggaaaaataa

SEQ ID NO: 1010 - DNA, 141271 bp, Homo sapiens
acagagcaggacccacggctgctgctgggtcgggttttatttcaaatgcagccacagaggcggtttctgcacaggtacgtgatccgactccacaagctcccaccaggggctccccatgacccgcaatgacgctgtgtggggtcaaaggaaaacaggccacagccaggcccctcgatggacgcaggcaggggaccaggaatgcggcccacgcagggggatcgggaatcaggcggaaggtgcaggtttgcagctggcgggaggagccagcatgccccaatctctaaaatattcccggtagaaaaatagacatttccctccaaagcagattcctggggctggagggtccctccaaggccaggggtccgggtgattccagagcatccacgctctgcgctgaaggcactgaacctgccatcactgtcacagccgtcaccggccaaggagggtctggaggagggaaggggcccttgcgaggctctggtgctggtgatcccggcccccaccaccggaggagctgaaagcccttgctcagccgctgccctgctggtgaacccggcccccaccgccggaggagctgcaccctgtgtggtctgaggcagccctgcactgggcagcggccccgccccgcgctgaacccactaggagagcagctgcagcacctgtcggatgcgctgggccctccccggcagggggggatcagagccctcctcatccagctcccgcatcagggcttccgccttctgcaccgtcagctctcgggcccggccctgcagcccctccaggtaggccagcagggtggagaagtgctcatcgggaacctggacgggaaagagatcgagttggtcaggggcggggcagggaggggccgctgaacagcaggagacaagacgctgcagccaaggacacccgggcctcaggcttccgtcctcccactgcggcccgagggtgtgggcggcctggccacagaccctgccccagacactggaagaagaaatgcctgtttagaggcagacaaaacactcaattaacctgggtaaaacagaagccatgtggggagaacatttcacaaacatcgtaaaaatcctcagaaaaacgagaaaatacgacacaaattaaacaggggtaggcggtgatgaaaggtgcattcagaacaaaaagccaagtacgcgccggcacttggcacgctcgcctttctgctcagggcggcagtggccaggtggcatctcttggtggcctgacccttgtctgctggtggtgggggcacctctgcacaggctcaccagtcacctgacaatctgctctgcaggcacgtttcctcaggtccctgtggcagcggctttcaacactgggctctttttattattgagttagcagagttctaattccatgtgggacttgcaaacgtctcccattctgtagcaaccatttcactttccagctagttctgtatgcagtgcaaagtcttagattctttttttttttttttttttttttgagccggtcttgctctgttgtccaggctgcagtgcagtggcacgatctccacctcccaggttcaagtaattctcctgcctcagcctcccaagtagctgggattataggcaagcattaccacacctagctaatttttgtatttttagtagagacggggtttttgccatgttggccaggctggtctcgaactcttgacctcaagtgatccacccgcctcagactcccaaagtgctgggattacaggcgtgagccaccacgcccggctacacagtcttagatcctgatgaaggcactttctcgactttttcctttgtcgcttgtgcttctagagtcacatttaagaaactgttgcctcacccaagggcacgaaatggactcttaggctttcatctaagagttttggttttagcttttaaatttaagtctctgatccattttgagttaatttttgcatatggtttgaagctgggggctgcgtgcattaagtatcggcatgttcgtaaatatgtacggttacatatgaaataaaaatgtataagtaaaatgcacatttgtgtgtttgtaaatatgtttaattacaatagtgtaagataactttgcgtgtgtgtgtgtgtgtatacacacatataaatggctaaccaaggatttgcctaaccaaggattatttttctgtataaaaagttttgtataaagtttacttttggtaatagtaacatataaataaaaccacgtaaactttggttaaaacaaaacaaaacgtggaaacccagttgtccctggctctgttaagaagaggtttcctccacatggaacaggcttggcccgcatgctggaatcagctgcgccgggcgtgagggtttccaggcttcccaggctgttccagtcaattctacttccacccttgtgcctgccccagtgtcgcgattaccggagcttgcaatagggcttacaatcggcttgcaatagggcttgcaatgtgtatgtcctctaactctgaggagggagagtggcttgagcccaggaggtcgaggctgcagtgaactgtggtcgtgtcactgcactccagcctgggcggggccctgtctcaaaaaacgcccacaaaaaaacaaaaacaacaaaataatgaaagcaagtggctgcaggctatgcctggaatgtcccagggctgtgagtggggctggtgggcctgccccgctctgagagtctgcaaacacaggcacggcaggagaaaaccgccccctgcccccagcgcgcacgcaaagcctggcctctagtaacgtgggcgcaggagagccagcgaggcaggaggcactgcccaccggatgcagctcagcagaaccgtgggctcctccagcctcacaggacatgggcagctccagcccgccgcccagcagccgggtttagttcagaattctgtctcgtttcatcctgtgaaactctatctcacatcctgcccctgaaaagggcagctgcccacacgtacatgtgtagacacacatcacgcgcacacacgtgtagacacacgtcatgcacacacgcacgtgtagacacacgtcacacgcacacgtgcaggtggcctccctaaggttaccccgtgttggtttctgccctgaaggccggcggcagggctcctggaggaggcaacgctgctcatctcttagaacaaaggcaccgggagacctgccctgcagtggggccctgagggcggccccttcagactgtggcttctgctgtcagggccccagtgtgcacaggagacgtgcctgccccgccgtgcacagacctcagcccccaggagacgtgcctgccccgccgtgcacagacctcagcccccgggagacgtgcctgccccgccgtgcacacacctcagcccccgggagacgtgcctgccccgccgtgcacacacctcagcccccggggggacgtgcctgccccgccgtgcacagacctcagcccccaggagacgtgcctgccccgccgtgcacacaccttgtcactgtcatacatgtgcagcaggagccacgtctgcctcgtcttctgaaacctccagttcttgtgcttttgggcccatctagggaaagaaagacaaacatctcagggtgctgggcaaaagactcccgggcagctgtctgccctgagagatcggggacgcctcatcttaggagagggagccccaccaggtactacacaccaaggcctcatgtgaagagggtttttggagcccctcccctgcccgaggcgaggagccgcaaccccacgccctgctgccgcctgaccaggaagcatgtggacgccactcttaccttggccaccccggggctcaccactgaccccaagtccccgtgggctcccccaccccatgggtcacacggattttacagggggggaaggatgaagtgagtttctctgggaggaaagggagcgatgtaattgatgatgtattttctacatgaaaatgggaagactgtaaggaacaataccctgagtcccaggccctcacaacaaggggccagtgggcctggggacgagcagctcccggctgctagaggggccgctccccagggccacaaccaccccgcccccgtcccgctcctgcactagggcctgtggacatcaggcagctgcggatggagcgaagctggcgctgtgggtagggcagggccaggcagggtttactccagagacctcctcccagatacgtgtttccagggccaggcagggcagccgagcccagaagcctccatcagtgtgcaagcccaggtctgaagactgtaggctcagcacgggggagggccctgtgcctgttgtgagcgctgcccagcttgcctgaccccactgccatgtgggtgagtggagtcctgtgggtgtggagccctgtgggtggggagtcctgtgggtgagtggagtcctgtgggtggggagtcctgtgggtgagtggagtcctgtgggtggggattcctgtgggtgagtggagtcctgtgggtggggagtcctgtgggtgagtggagtcctgcgggtgagtggagtcctgtgggtgagtggaatcctgtgggtggggagtcctgtgggtgagtggagccctgtgggtggggagtcctgtgggtgagtggagtcctgcgggtggggggtcctgccggtggggagtcctgcgggtggggagtcctgtgggtgagtggagtcctgtgggtgagtggagtcctgcgggtggggagtcctgcgggtggggagtcctgtgggttagtggagtcctgtgggtggggagtcctgtgggtgagtggagtcctgcgggtgagtggagtcctgtgggtggggagtcctgtgggtagggagtcctgtgggtgtggagccctgtgggtggggagtcctgtgggtgagtggagtcctgtgggtggggagtcctgtgggtgagtggagtcctgtgggtggggagtcctgcgggtggggagtcctgcgggtggggagtcctgtgggtgagtggagtcctgtgggtgagtggagtcctgtgggtggggagtcctgtgggtgagtggagtcctgtgggtggggagtcctgtgggttagtggagtcctgcgggtggggagtcctgtgggtggggagtcctctgggtgagtggagtcctgtgggtgggaagtcctgtgggtgagtggagccctgtgggtgagtggagtcctgtgggtgagtggagtcctgcaggtggggagtcctgtgggtggggagtcctgtgggtgagtggagtcctgcgggtgagtggagtcctgcgggtgagtggagtcctgtgggtgagtggagccctgtgggtgagtggaatcctgtgggtggggagtcctgtgggtagggaatcctgtgggtgtggagccctgtgggtggggagtcctgtgggtgaatggagtcctgtgggtggggagtcctgtgggtgagtggagtcctgccggtggggagtcctgtgggtggggagtcctgtgggtgagtggagtcctgtgggtgagtggagtcctgtgggtggggagtcctgtgggtgagtggagtcctgtgggtggggagtcctgtgggtgagtggagccctgtgggtgagtggagtcctgcgggtgagtggagccctgcgggtgagtggagccctgtgggtgagtggagtcctgcgggtggggagtcctgtgggtggggagtcctgcgggtgagtggagtcctgcgggtgagtggagtcctgcgggtgagtggagccctgtgggtgagtggagccctgtgggtgagtggaatcctgtgggtggggagtcctgtgggtggggagtccttgggtgagtggagtcctgtgggtgagtggagtcctgtgggtggggagtcctgtgggtgagtggagtcctgcgggtggggagtcctgtgggtgagtggagtcctgtgggtggggagtccttgggtgagtggagtcctgtgggtttggagtcctgtgggtagggagtcctgtgggtgagtggagtcctgtgggtgagtggagtcctgtgggtgagtggagtcctgtgggtggggagtcctgtgggtgagtggagtcctgcgggtggggagtcctgtgggtgagtggagtcctgcgggtggggagtcctgtgggtgagtggagtcctgtgggtgagtggagtcctgtgggtggggagtcctgtgggtgagtggagtcctgtgggtggggagtcctgtgggtgagtggagtcctgcgggtggggagtcctgtgggtgagtggagtcctgtgggtgagtggagtcctgtgggtggggagtcctgtgggtgagtggagtcctgcgggtgagtggagtcctgcgggtgagtggagtcctgtgggtgagtggagtcctgtgggtgagtggagtcctgtgggtggggagtcctgtgggtggggagtcctgtgggtgagtggagtcctgtgggtgagtggagtcctgtgggtggggagtcctgtgggtgagtggagtcctgcgggtggggagtcctgcgggtgagtggagtcctgtgggtgagtggagtcctgtgggtggggagtcctgtgggtggggagtccttgggtgagtggagtcctgtgggtgagtggagtcctgtgggtggggagtcctgtgggtggggagtcctgtgggtgagtggagtcctgcgggtggggagtcctgtgggtgagtggagtcctgcgggtggggagtcctgtgggtgagtagagtcctgtgggtggggagtcctgtgggtgagtggagtcctgcgggtggggagtcctgtgggtgagtggagtcctgtgggtgagtggagtcctgtgggtggggagtccttgggtgagtggagtcctgtgggtttggagtcctgtgggtggggagtcctgtgggtgagtggagtcctgtgggtgagtggagtcctgtgggtttggagtcctgtgggtggggagtcctgtgggtgagtggagtcctgtgggtgagtggagtcctgtgggtggggagtcctgtgggtgagtggagtcctgtgggtgagtggagtcctgtgggtggggagtcctgtgggtgagtggagtcctgcgggtggggagtcctgcgggtgtggagcccagctgtgcagctgctaggtgacacgccagccccatgtgcagtgacgcagggctcctgcgtgatgagaggggcctccagggaggtttaattttagttcctttctttttagacagcccctcgtcgtctgctccccggatggccgacccggccagcgtgggcccctgtgaggtgcacccgggccagccaggccatggcatctgcctgctgggggctgttttactgctgcagggcagaagttggcatctcagctctgccactttctaactctcccaccttgagctgctgctttccaccagcctgtttcctccttgggaacgtggagtggtgaccccacttcacgggtgttcccagagcccacgcacggtgagtcagtcacagctgctctgcacactgccctcccatggggcccgaggccacagcactgctggcccacggcactgctgcctacggccctgaaccaagggcgcctctctctcaccgagcccccaccaggcagacttcaagccaagcccatctccctcaccaccgaagatgagccgtcccgctcttggcctcgtcactgggggagcagacacagcgaggggcgggtggggtgctcagtgtcgcctgtggctcccacggcactgggcgaggcctcctgagtgatggccgcctctgccacccaccctggggactggtccctgcgcaactgcagacagttcacaggatgcctgacacaatcctctttctctctgcctaggtggggcagcagacaggagatcccatcttggaaaaggaaagagagcagtcagagggaagtcccttgtccccagcatagcgggggccacggccactgcagggtcatctgtccagagctgcctagagcgtcccagagagaagaacctcctcccctgtggtactcaccagctgggtggagaaccagagtccctgctagcctactgggctttaaaaaaaagcaggggcggctgggaacagtggctcatgcctgtaagctgagcactttgggaggccgagggcggatcacaaggtcaggagactaagaccatcttggttaatacggtgaaaccctgtctctactaaaaatacaaaaaattagccgggcgtggtgtcggatgcctgtaatctcagctactcaggaggctgaggcaggagaatcgcttgaacctgggaagcagaggttgcagtgagccgagattgcaccactgcactccagcctggcgacagagtgagactccatctcaaaacaaacaaatcaacccacaaaaagcggggacttcttgctgaacccccttccaaaagaaaactgagcgagggtctctattgagacagcatctgaagccggcccgcagccacagcgtccacgtgctcgtaactgcaccaggaactgccagccgcggtgagctgacgacccaatgcccatgaaggcccgagcggggctggcgcggacaggggccgggtctcatgggttggccgctcctcccatacttggagctgggctgtccctcggcagcggggcagtgggcctgggtagggaaggacacccaagaagtgtcccctaagctccgctgatgggacagtttggcctctgctctggcctgtcattccagggttccaggcccggaggccacggggtgcaaggaagctaagacaccatgctgtgctgggcaacatggggacctgaggagggtgggcttgggctgccccacggcaggagtgacttgctctcgtcctcccgcaggtgagtgggggaccccgtcccggctggatccgtgtggcccgggtcccagttcctctctctcctgtgggggcaccacctcccgcctcgagcagacccaggcagggggccggcccccgaaaatggtgagctaaagcctgcagggaccagggaggcagcggtcacctcgccacctgcccccaacgtgaacacccagcaggcgtgttcttttcttttttcagttatatggaaagtaaatcttcaatttcctgcgttaagcatataaataaactcttttttctctttaatgaggaacaggcttgcccgctgacagccgtgtgcctcgctcgtgtaactaccacagtggacccagcaacccagagacccacagaaagtggagggactgcttccagcactcccaaacttccgcctatgcaaggccagagcaacacggctctgagctggaaaaacagagctgggtgaccaagcctggggcccctgctgggaaaacgaggggacagtcacagcacagggaaagagcacacgacggccacagtgcagggaaagagcacacgacggtcacagcacagggaaagagcgcacgacagccacagcgcagggaaagagcgcacgacggccatactgcagggaaagagcgcacgacggccacagcgcagggaaagagcacacgacggccacagcgcagggaaagagcacacgacggccacagcgcagggaaagagcgcacgacggccatactgcagggaaagagcacacgacggccacagcgcagggaaagagcgcacgacggccacagcgcagggaaagagcgcacgacggccacagcgcggggaaagagcgcacgacggccacagcgcggggaaagagcgcacgacggccacagcgcggggaaagagcgcacgacggtcatactgcagggaaagagcgcatgacggtcacagcgcagacaaagagcgcacgatggccacattgcagggaaagagcacacgacggccacagcgcagggaaagagcgcatgacggccacaatcccccatcccaccctctggaccctcctctccccagccctgctgcacagctcccaccagccccagcttcacacaaagccaggagcaccccaggaaggctgcagagaagatgaacccttgagatgcaagaacagcccagggtatggtcacaggtcacaggccaaggtcaccgtgtggggatgctgcccagcctgcgacccgggttctagggacggggcatgaagaccccacgggcgctgggtcgacgtgtcttgggggcagagccttcgggggatctggaggggagacccccagggcatcctggaatgggtggggtgcctcccagagagatgagaggaaactctccaccatgagggctcaccagaacaatccggggtctcctccacacacagcccacctggctgcagatggctttgcctccaggaggaacccctcgtggaaagcccataagatggccatgggccacggcggccagcatgtccttcctgagtcccagtccagggcctctgcagggggaggacaactcgggcacctaccttcaccgctgcccctgggctgggggctctgtggtgggccagccgtggcgtggccagtggtccccagcagcccccaggctgaggacactcccctgtgggaatccccgggctccctctctttggaaaaccctgagttgccagggataccgtgggctccacacatccacgtgggctctgatctggcagccagatgcggctgggcttgcgggcacccttggagacccccaggaaagaggagaagctcctgccggggtgcccgtgtctgtggctggcctcctggtgtgtggatcccaggccttggaagaagctcctgtgggaaggggctgctttgtttctgagaagtaagagtcccccctcctcccacacgcaggacacagtgcctccgcacaggacttgccgctggggggttgcgagtagcatgagggggccacgggaaggtcccagagggggagaggagggtgaggctgaggacaggagcagggcatgctcccaggcactcaggaccttcccgtggggtgctcggagggtgtgtgatcatgggaggggagtcagggcgcctccagggtgaagaccagggagtggcagccacgtggtggagcggatggtcccccctctcctgcccacgtccccaacgtcccccttgtctaacagtccacactgagagcagcggaaggtgctggcaggcctggggaggaaggcggacaaaccccgcccaccccaggcatcagggcaggtccagaacagccacgccccgaggcacctgccagtggagacaggcaaggtgcaggtggcacagctgcaggccccagtcgccctctgcctcccacagggagcctacagtccattcctgcggctggcaccttccaggcctgtgtccacctgctctgcccagcccacaccttgcccacacctgggctcgagacgctgcactaacggcctctgaagccctctctgtctacagcgactgaccctgcggtggcttgtggccctgcctgcagagaagcaggagcaagcgcaggaggcagcagcctcacaccacagccagcaccttgggtcccctgggccaagcgcgttcttggagcaagaaagagctcttggggtagccctgggcacctggcctcagccccacgttcctcagggagagggaagctaagcctcccagagaactgaccagtgcagagacccatgatgactcaactggttccagccggatccacccaacgctatggctgagctcattctatgacccccaaggcagcctcagctccgagaaacaggaggcttgcccccatccccatttcctgagcccggcgctgagcctggtgcagggcagccaagagcccctctcctgtaggtggaggaccgtcctggggatgcacacacaacacacatgtccacacataaacacacacgtgcataaacacacacgcacacacgcacatgtacacacgtgtatacatgtacacacgcacatatacacaacgtgtatacacacgcacacacgtaaacacacgcacacacgtgtacgcaacactcgtatacacatgcacacacgtacacaacacacgtatacacatgcgcatacatgcacacgcacaccccctcatgcgaacacacatgcgtgcacacacacccatgcgaacacacatacacgcacacacacacacatacacatgcacacacgtacacacatgcacacacgtacacgtgcacgtgcacgcagcgtgcacatccacgcaggccccgctgctcattccgctagctgcacagccacactgggggtcatctctccgaggaggtcatctctccgagggcctcccacagaggtgcggctggagcctgtcctcccaggcagggccagtgcccccacaggacaccctgcccctcagggtgacttcatcacagggacccagttcttgtctctgaggaagccagccacgtggacgccgtgacaccccttattctaggtgcagtcagcactcagggagacggacaggaacgggcagcagcctgtgctggtaagcgccggggaggtggccacagcccgcaaggctgtggagcccacgccaaagcctctgacccctgcaatcctgcaccgtccacccagccacgccgcaggcaccatccacccagccacgccgcaggcagccagggagatggcaccctgtgcccagcaccccacaatccccgtcttcccgctcttgggtggcagtggcgcctcctgtcactgtgagtgagggctgaaggccaccacgagttccctcctcctcacccccacgtccaagcagcacccaggcccgtggattcttcctgtggtgacgtacacctggggcaaggttcaccatcagacccatttctaaaagcacagttccaggcaacccctgcacgggcagcggctctgctgccgcccctgaaagttcctgaaggctctgggccattcagacagaaagggcagcggcggcagcacaggcctggcatgaacgctcatacctcactgctctagaaccttccacacagtgtgtgcgagtgaaggcttcgaccccctcaggcaggggttgagacgcacgtccgggacagaaccgcgtggggcagggccgctcacctgcagaggtagtccagggccagttcggcccccgagcgcctggcaggcgggtgctgggccacaaggcctgcctcccgcagacgctgcctctcctctttcttccgttcctttttcagcttcctttccaggaccctctgctcctctggggacagctctggctctgcgtccagcccgggcctgagcacagcttcgccctgaaagtcaaggaacacattaggcttcggggatggagggtatccagagacgggtgcgctgcctggggcttcccgagcccaccctcacctcagtagtggccaaaagctctgtccccaagcactgggtctggccccagccgacaccatcctgctaagcctgtgctacgacgaagagacagacaggtcacatgaggatggccagtcctgcgggcaggcgccaggtgccaggattaactgcccagaggccccttccccacccccgtggtccacctcccacagactcccggctcccgaggctctgtgaggtcctgccccaccccacacagtgtgggaagatccgggccggcccccagggagggctgaaggtgtgctggtgtctgttatcacacaggccaggtgctggccccagacccgacccaaatcccgaggacggtgcctggggcctgctgctttctggcaggtcactggctgcctggctccccctgggctgcaggctggggacagggagggggccaagacccccaagggagggagagggcccgctgtgacaatgtgtccccagccacatcttgccaggaaagcacaggccctccgtcttgcccaccctcccctcattaacaaaagaagaggacggtgcaaagcgtcaaagccggggcagccgggccacggggtgaccatgaggtgaccccagccgctgtccacatgcttcgtcttttttggaaaagtcagaacatcagtgtagactccgagcaaggccaggagcccagggaaacagctaggggcgtgggaatcaaccaggcagcgcccaccgggagcttccaggaagggaggccgggcacagcccacgcctacgcatcccaccccagggagagcaaagaagagtgaggcaagcccccctacatacagatatatatgcaacccacccccccgacacagacacacacattcacagacttcacccctacagccaaacacagcccccaaccctcacccatgtacccacaccgacccacacccacccacacccaccatacacccacactcacccacccacacccacagacacggacacatacccacacccacagacacccacatacccacccacccatacccaacacacccacacccagatacccacacatagaccaacacccacacgcccagacacccccacatgccacacacccacatacaaccacacacaccgacacccacacacatccaacaaatccacagacacccagacacccacagatacccaaacacccacagacacccagaaacacccacacacccaaacacgcccacagacacccagacacacccacacccagacacaccttcacacgcccagacaccctgacacacccacacccagacacctgcagacacccacaaacacccagatacccaaacacacccaaacacatccacacaccatcccaacatacccacagccacacacgcccacacccagatacacacccagacacccacaaacacccagatacccaaacacacccagagacacccacagatgcccacacacccagacacccacagatacccacacacgcccacagacacccacaaacaccatacacacacgccaacacacccacagccacacccctagagcctgccaggggtccgcagcaagagacagggcctgggggacgaggagcaccgtccctggcagatgcctggcacagagaggctgaagagtcccggtgggaaggcctgggccgcccacacacacaggcaggaagctctgagacccaccaggccaggcacgcagggctctggggagcaagattttcatggtggggatgtggacacccccaggggagcctggtgactgaccggctccaaccagctccatgctcacctcctaggcccacagccgcccacagccgccaacggggcaggcacaacaactggccctgaaaggtaaaaaccctcctggcacaggcccagcctcggcccccactccatgggccacgcagtccacggctgatcacacgggccaaagtccataacactgttagggctgcacaggggccgccgcggtggccgagggtctgtcagcccacatgcgtggggcacccggacaggccctgagcaggtgggcagggccctgtggtagggtcccaggttggtggccagagtggtgaggacggggccaaggctgtgggcaacagcaacgtgggcgctggcctggggtggatggcgaggggaacccaggccgtcccatatcggggccaagccggggacccgcaggcccagctgtttcccgcaggcttcctgagcgcccggtgcagggctgcttcttgtgtcaggcaccagcctggatgctgcggaaacagcttccttcacacccactcttgcttctggccaccagcgctcccgacctggcaggagtcacagcccaattcccgtgtccccgagggagccactgtggccacgaggtgggaagctcaggagtgccacccactgccctgggctgtgcctgacactggccggtgcacctttaacttttccaaactcctgctttctgtgctgggcctcaacagaagacgcaggggcagctggagtgagggtgctgcgcccggagagccaggggccttgggggtgcccggctccactctgcgccatcggctgccccgtgctcgcgctcgctgccttgggggtgccggctccactccgtgccatcggccgccctatgctcgcgctcactgtcctggaccaggcaattccccaaggctgtgaccacgacgtgagcgacctcagctatcttgggatgacacaggcgggccccgggagggtgtgcagctggagggggcgggaggcagcaggtccaggcaggctggagggcacaggccgcggcaggtcgtggggaatgggagcagcgcgggagggtggtggggccgccaggatcgggcgtggtaatgccgggacctgctgcttgctctgcttggcctgcacagtgtctggcccggagagcacaggtgagcaaggtaggacggctgtcacccacagacgagcagcggagaactttctctaactgccacccacgtgccgaccctccaaagaacgcgggtttcactagcaaataagaacgtgggtttaattagcaaatacttttaacaaacttgacactatcacatagagctcccaaagttgccccaagggcttgtaaattacctaagtacacaccaaaaaatttttaaaagaatcccagtgtcaaataaaagcctgtgagggccccttctagggacttgagtttcaggcctaggatgcaaagcctggcgcagcagccaggggtgactccaggctcctgccggctccaggattctgggaaggggcagactttgggccccctggagcccctctaggcccagtgtccaccccacagaccctgcagtctggggccactcttctgggagaggtgttgtgggcggctttgagccgacgctgtcagggcaagagtctctctcctaacatgaaggctttccaacacagatgggacgggcctcatggaaggaagcaccggcctgtcacagacgtgtgatgtctaaagccggcgtctctggaccatcccagggcaagcagaaagtcgtacaaaagtacagtcaccctatctcaatgctaggacagtcttcagcatttcagacttgatgaaatacagacactcatatgaagtacagaaaaataaaaattccagccacacattctgtctcctgcggttagatgtcttgaggattacatttgaaaatgcataaaacaattcaatgtgcatgaaaagctttacgcaggacctgcacccacacagataaactgcgaccccgaggactgggatggggaggcggccagcgggcctgtcactgcacctacgctgtgtatttcacaacatggacacttccacaggctacctcaagcaacgcggcactcgtgcagtcaaacatgaaatccttaccatcaggcaatgaaaatgttcactgtactcaacaaatacactgaaaacaaaccacaaagccaaaccctacaggctgggaggagcaaagtggatcagctgccacagcaccttccagagaagagagccgtgagattcttacagagaagctgacactgtttgagaaaatacaactgcatgaaaactatgtttttcctttatgcctttaactcctggcaagagacacagagaagaaatgacactaatttgattttaaaaggttcccgtagactcgactgaggcagcagagacccaacagctcctttccgcccaccccacccgtccatctgtgtgacacgggccctgtgtgagccgtgctccccagcgtgaggcttcgccacaacacactggctcttcctggagatgtccaaggtgggtaacgtgctagtcataccccaacaaaaagaactggcaaaaataaaaaccatcatcatttcccaggtttgtgaatttaagccaacaggaaacgtgggacaaacacgcggggctccataaagccagcctggcactggctctggcaccaggtccctggactggacaccaatctccacggttccgaattttcctaagtgatgactgtgaacaccacatgcacagaaacgagccctgagaagggggccacattggccgccggccacggcagcgatccggccacggcagcgttccggttggtgtcaccctgtcccggcctgagcccagctctcagatccgagcaccaattctgtctacagccccttcctgcctgcgggccctccctgccctgcagggacggtgcagtgagcacaggtgtgcaggctgtgcggtgagagccccagggctgggaggagcaggcagccttggtccagcaggtcctgtgtgggggccgcgttgccgggcagggcctgacacggctgctgtgggctctgagaacagcccaaaaggacagtgacccctgcccagtctctccagcctgggaatgaccttccccagccgtggcctcacaccagggaggtgtgatgggaagtgacctgggtggctcctgggtccctgctaaattgtttgggggggctgaggggtgaggaaagagaggtggggtcgggaagaggcgtggcctccctgtccctgaggcatgagagcaggtgtgggctccccgtcccccgggcatgagagcaggtgtgggctccccatcccccaggcaccagcaggtctttgtcaacctgaggctcagggaggaatgtgcaagtccctgtctcatgaacagggtttgggccatcggagcccctgcagaggctgggttcatgcaagctgtcagctgccagtgcccacaggcatccacgccgctctggactcagggtttagaaaaagtcatctgttccagccagaccttcctgtttccccccaagtctaagggagcagagccttcacctaagaaaggagggcagagtggggagacccagggctgacccagagggcagggaggacccaggactgacccaggagagcagggaggacccaggactaacccagagggttggtgggcggggccaggactaacccagagggccagagggactgaagctgcggcctgtgggcccctaatgcccagccctcgtggaggcaccaaggcaggagcgcatcccaacacccagcccgggcttcctcggtgggcagctcctcacccacggtgaagcgaggccaaaggtcatcgagtgctgaccgccactctccttcctccaggggcccctctgtgagcaatgcccatgtgacactgatgtcacctgaccagacggaaatactcctgacgcccctcagtgaccctggaccggcgtctgtctgggcaggaccatctagtgtctgaggtgtcacatgaggatcccagacaaaacacgctccccctccggtgtcacgccagcacacagcagcacacgccagcgcacagcagcacacagcagcgcacagcagcacacagcagcgcacagcagcacacagcagcacacgccagcacacagcagcacacgccagcacacagcagcacacagcagcacacgccagcacacagcagcgcacgccagcacacagcagcacacgccagcacacagcagcacacagcagcgcacgccagcacacagcagcgcacgccagcacacagcagtgcacgccagcacatagcagcacagcagcacacagcagcacagcagcacacagcagcgcacgccagcgcacagcagcacacgccagcacacagcagcacacgccagcacacagcagcacacagcagcgcacgccagcacacagcagcgcacgccagcacacagcagcgcacgccagcacatagcagcacagcagcacacagcagcgcacagcagcacagcagcgcacagcagcacacaccagcacaaagcagcgcacgccagcgcacagcagcgcacaccagtacacagcagcacacagcaccacacagcagcgtacagcagcgcacgccagagcacagtagcgcacgccagcgcacagcagcacacagcagcgcacagcagcacacgccagggcacagcagcgcatgccagcacacgccagcgcacagcagcacacagcagcacacgccagcgcacagcagcacacgccagcgcacagcgcacagcagcgcacagcacacagcagcacacagcagcacacaccagcgcacagcagcgcacagcagcgcacgccagcacacagcagcacacagcacacagcagcgcacagcagcacacaccagcgcacagcagcacacgccagcgcacagcagcacacagcagcacacgccagcacacgccagcgcacagcagcacacgccagcacacaccagcgcacagcagcgcacaggagcacacagcagcacacagcagcgcccacccacgcaccctggtcctctgctgtgcatgtcattgagggtgtggggtctgcggagagcccggaccactcggaagccttggtctgagggccacgcgggcccagagcacctcaggctgtgggcattgggcctctgcctctggccccaggctcaggctccctggggaagtggtggccgtgctgcatcaaagaatggcagagaaaggacccactgtctctcagagggaagataaggagctccctgctcaaattggagctgcggggagggacgccaccagcccagcctgccgtgccctgctgtgcgggtgaaggggctgcagggaaggacaccaccagcctggcctgccgtgccctgctgtgtgggtgaaggggtcacctggcctggaccccgtccagtagccatgcaggggatggtgtgcatgaggcaggcgctgctgtcctacgatgtcagccgggtgacggggccagggctccagtgtcgctgccatcgggcccttggggagcatccctggatggcaggggaggtggggagggctccacacagcggggtggaggacagcgagacagctacacaccctcctgcaccttcttctggggaaacaagacacggactcaatgcttacgaactttcctggaggggagacttctccagtgggatcaccccaacacgtgaactgactgccgcgggcagccgcggacggcgggataaggggcagccgcggacggcggggaaggggcagctgcggacggcagggtaaggggcttctctgcccccgccccccactgcacacaaggccaggcgctctggggcccagcatccagggctcaaaaccacacccgccttggtgggatggcgcctcgcctttcccatgctgcggtaggaacaccccatgtttgttcggtgcattttattttctaaaatgtggcagaaagaaaataactccagcaggtgacagaagacctagtagaacttagcccaaatttaaataatgacccaaagtccccacggggctcagacgttcccacaccctaggcagaaatccccactcacacgagcacgcatacacacgcgtgcacacatacccctgccatcatctctgctctctccattgagccctggctaagcaccagctcccaccaggcaggaagcacaggcccaggacacgcacactagggcttggcgggtggggtccaagtcaggaagtgagagccgaggccctacaggaacagggggttgccccttcaacaggtaacccatataaaaagtgactaacgaaagcacgtctttcttctcactccacagctttgaaaccagtgtgcattgtacacgtggagccatctcagacccagactcaaagtccgcctggctccggccatcagcctgtggcgtctcagagcctggccccgagcagagaggagatgtgatgaggagacatgacgagggagtcgtgatgggcacacccatggccagcaggcccagcctgtgcctctcggaggtccgcacttcctgcccagtgggagcaggcacctggcgtgggctccagctgaggtgtgcacgcgggcgggtggggtccagcccagagtgtggtctttatgtaaatcagggtggagctcaggtgcactggctcacacatgttaatctgagtgctttgggaggccaaggtgggaggctggcttgagcccaggaattcgagactgcagtgagctgtgatcacaccactgtaccccagcctggatgagagtgagaccctcaaaaaaaaaaatcaatagatcagggctgcgccccaggtcttctacctcgggggtgggtgataggctcgtccagctggtggtcccaggacaagctctctgtccctcccaggtgttccatagtctaggacagtgcaggaactgcagacttgtcaagaactggggagtggtccgggcgtggtggccgaggtgggtggatcatctgagtcaggagtccgagaccagcctggccaacatggtgaaaccccgtctctactaaaaatacaaaaattagccgggcatggtggtgcacgtctgtaatcccagctacccgagaggctgcggcagaactgcttgaacccgcggggggcagaggttgcagtaagccaagatcgcgccattgcactccagcctgggcaatagagtgagactctgtctcaaaaaaaaaaaaaaaaaacgggggggggggagtgaaagggagggaggaagagggtgagggtttggaggggcccaaccaggcccacctgtggttgcatggatctctagccacctgcaaagccagaaggtaccttgagctgacaggtccgtgttgttcaatggttctatagggaaaatcctgcccccatgccaggttgttgatcacccacggtcaatgctggaaggggcagctgctgctctgggccagaaggagaggcttcctggcaccgtgaggaggctggcctggctgctcacagctcccggcagaaatgcggagcggggtcctcactgcagcacccgggcttttcaaaacagtgaagccctgagtccaagaaggcaaaccacagagcggaggtggccgtggggctgccctgtgggcagaggggaggctgcgcaggcctagtggctgcaggaagctccagtggccgccaagaacctccaggcccatcaccacgaggagggcccccactgcagccagggcttccagatgggcagaggcggtgggaagcaagcaggaagcggagactggttggctgtggccctgacccctcttctcctgatggagtgtggggggctggggctgcctggggtcacccactcaggtctctcactcctgccctcccaggaagtggacagttcccacagcctggacccagaggcccgcaggcactgaccgcggcccggaggccaagctacagtgcgtttcccgagggaggccacggggcacctggacgagggcagcttaggacgctcggctctcgtctcaggaatcccagggcagaagtccagcgaggcggcaggtggccggcccgtccccagcctctcttcccactgaggagagatccaagggccggcggagtggtggtgtctgctgctctgcgggaacacgggcaccaggcccagcagtgcatggatgcggcaggccccgcgtgcgatgccctggtccccacgactgtttcttcccacgccgcggagtgcattccctcatgctcccgtcctgtgaacacgcgctgcagcctctgccctcctggggctccctgagagagggggcaccccttgctcccatcacagtcctcctgcagcctggggccccgcccagcacgcccaccaaaggggaggcccgctctcctgtcagagccaggacagcctctccaagaactcttcctgggccccagagaggagccccctaggttcgcttctcgccagccgctgccccatcttgcgtctccacccaagggcccctcggcgcccccacctggagcccccactatcgagatatgtctggcggataccacacacaagggggctgtagcgggttggggaacaggccaacccctcccagactgcagggacagctagtctcacacagctaagaccaagatgatgtaaggaaatgaatgacagtaaacccagcccttaccgaacccacctcccgagcagggaggacctgcaggaaacagaggctcccattcctgttcacctctgatctcaggggcagacaccagcccatcactgccgtctgctgaccacccctgcagacggcctgggccttggatgtcctgctcctctgggctccccaggctgtgtgaaacggaggagtgcaggggtcaggacccctcgactttcttgggggcaatcaggccgtttgtaacgtcctgatacagcagagctggggactggggttacgaaagacaccaccaggtggagccttcagatgggacctcccagcagggcctccaggctggggaccttcaggcaggtacctccaggctggggaccttcgggcaggtacctccaggttggggacctcccagcagggcctccaggctggggaccttcaggcaggcacctccaggctggggacctcgcagcagggaactccaggttgggaacctccaggctggagacattccagtagggaccttctggttggggatcaccaggttaagaacctccaggttggggacctccagactggggacctcccagcacggacccccaggttgggaacctccaggctgaggatctcccagcagggacctctagtgtggacctccaggctggcacccatggggcaggtttctttcttcttccccagaagccttttcatcgtggcagtaggacctgaccttgacagagatgatattgcggatttcagtgactgaaccagagtcggaagctgaagggctctgcccagccttcctgtcttcatccattaagtctgatcggcagtggtggccacctgggctgctgctttgacaagatgccagtagttggagctgggaccccagggagcactgtccatccaccgcacaggagtagggcttcagcagctgtcagtcatcaatcatttccccatgctgttggatgggagagggacaatctgccagccccagtgtgactggctttgctgccaccgcagtgccctctgggaaccccggcaggtcggctggaggcaggacaccacccccctaacccctccctacttgtcaccagacagaaaccacagctcaccaacaaccatacacaaacagcgcactaaaagaaagcatgcggcaaaaatacccgcccagcgagaactgtgcctggcacagggaaacacactgggatgcgcgcccttccgcggggcgaggctgggttttggggtataaactgagtcctggggagcaggagcctgaggggcacccagggcagctccctcggcctgggtcacaaggttcgatcctccgcgggggtggcaggaaagcccaagtccctcggcacacccaggtgacagcgatgacggcccacaggcgtggcgcctgggccacatcggacaggccatgtcctggagcactcgaggccccctggacagggcaaccaaccctgagtccaccggagtctgctcgcagaccaccaggagccccgctgcactgttcgtgagccacggtggtgacggcagctcaggagggaaggaccagaagcctggccccgtcccacgaggacagacgcaggcctgcggggaggcatgtccccacccacgggcgcctcctggaccacgagctcctctttctcctgcatcgcctcagaccccacccaggggttccaaggtcaggagcctggtcccacgtcccacagccctctcatggggcacccgtacggattctgttccaatttaaagaaaaccttaatcagatttgtcacctcaattattagaatcccacggcgttaactcacagtagtaaactgctttttctgagaaacaagagttttttaaattaagccttttattttaacgcaatcgcaggtgacggccgtcgtgagggaacacgggacgcccacgtgccctccaccacctcctcccacggcaaccctcgcagagtagccaggaccacattcggatccggactctgaaatgacagtcccacaaccaacagcatcgatgtggtcttcttaatgatcagaaacacacaggggattaatttactcttattctgcaaaataaacaagctctcaaattctttaaaggtgaatcccccccaaccgtcctccctccccagttacttcctccctaggacaccagtggaacatcccatgctctcccccttccatgttgataccgaataaaacacactgcatcagaagacccacgcatacgagtccaggggctgctacaaagcgcggcgacgtctccgcggcgagctggccactccatggtcccggcgcagacactggggcaggcgccggctctgtcgtcgaggcgctcacaggcaggcacacgtgagctcctggaggacagggagagcggccgccccgcccctgcggagcacaggacgcttcctgccacccctgcagagcatgggacgcttcctgccatggtgccgtggcaatgggtggcacctgcctgtggccccttctcagaaggacgttttaaacgcgtgaggtctgatgcacagccacagggagacacagacgagcagatgtgggcatccgagtatttacaaggtctggtggctcctgcagccgcgacacgggctgagcgcaagtgatgtgtgaggtgtccccaacagatggcacggggagcgcccacacccgccaccgcggggtctgcggaagctcgtgtcagctggaggttagggaagacgcacaggggctcattctccacccaggttcaaactccctgaactcacgagacccaggctgaagacatggacagactcccagccccagcgcccctctgacagcacacccgaggcctcctgggaacctgggaccccttgcagggtcccccgcaggctccttcctaggaaggaggttcctgccctactccacatttctctccatccaacttccaactccttcccactgggccctggagaacatgacgaagactgtgggggcctcctcccaggaaacacacacacacacacacacacacacacacacacacacacacacacacacacaccagcaacgcgcccagaccccaatccctggcagcccaactcctcgttctacagagaaggggtgaggatctccaggggtgactgctcacatctcggcacatgtagaaggcagggctggagcagcggcccctgcagcccaggccaggggactggaggcccttccacagcagccctttccttttgatacacggtcttgctctgtggcccaggctggactgcagcggcaccatcacagtttactgcagcctcgacctcctgggctcaagcaatcctcccacctcagcctcccaagcaaccaggactataggcatgtgccaccatgcctggccagtttttaaattttttatagagataggaccaaggctgctctcacactcctgagctaaagtgatcctccttgccggcctcccaaagtgctgggattataggcatgagttttcaaactcctgggccacagcgatccttccggccagcctcaaagtgctgggattataggtgtgagcccacggtgcacagcccccactttcttcctaaaaaccctgcagcttggctgacagtgggacctgcctccctactcccgcctgcaggagctcagaagcctcagctcaagaggagcccttgccagagacgtgggaccaggaatgggccccacagagccctgcccgtgggcttcctaaacagcctgagttcagctgcacacaccaacgatgtaggcgggttgcaataaacagcaagaaacggacccatgggacaggagagacgcaggagccccaggggacaagagagacgcagaagccccaggtgcctttggtggccagtgctgaatttcgcaagcaacattagaaactttttatttctgcttttctcttaacccaagggtgaaaatggaaacctgtggtgtggggcagtctgctgaacgctaggatgagggcggggaacaagagccaccctccccgctgccacctggcccacaagagccttcccaggggctctccagtttcagcccctccttgccgagccagacagcgctgctggcctggacgggagggacacccaggctgactgagtgggggagcactttttataaagatcagatcaggtttctgaaaacaaaaagcccccagatcctgcgagcggctatttagacttgatgcacactccaccatttcacaggtatccattccccagcgtcacacatgcccatccccagctggagcacactcttcagtgtggaggacagaaggagcaggcagaagacgaccccggggcgctgggggagcaggtgcgggctcccacatacctgctctattctggttggaggtgtcacaagggaaggcgtggagatgctgccaatggggacatgcggcaaatgcgcccccttcgccccacacctgtcagcagctagcaacaactcagtcctgactgctggagacccagccccaggggcaggcaggttgggatccgctgctcaggaggcagctctgggccagggtggaggccggagaagccaggcacctccccgcagagctctgcagaggccagtctgctaacggcttcatcactggagtggcggctgctaagagcaaagcctgtgcttggtacctcagggacctaaataagaaccactccctgttccaaggatcccaagtggggggaggacgagaagcagctgagcctatagggcacaggaaactcactggggtgtgggtgctggggacttgggttgggtgctgtactgagcaagcctgttgtggggggacactgctggcggtgggtgacgaggtgcacaagtcaggtcagggagggggactctgccctggcaccactggggcacaggacactggctcaggtgtcagctgaggaccccccagtgtaggcgaggggctcacagccgctgaggcctgtggacacagctccgtgtattctgaggtcgcagagcacaagaggttgggggtgtgatacggaccgacctcgcccatccaggaggaatggggctggtaacagagctttgtaacccctcagcaccggtagaggttgcgtggctccccagtggagctgagggctggcgtttcttgctctgtatttccctgcgctctggaaactcctgcatcaccagccttgggcccttcactgcctcccctgggcctccagaggcaggctggggtcctctcctttctcagcctctgtggccagtgtctggcacaggacagacacccaccaggacgctgcctgggacggagggctcccttctgcctccggccaggtgggccccgcagcagctcaagcttcagctgcagtggagggaagagtgaactgctgggcagaagcagaagcaggcctcctggaactcgtgaccccagatcccagaggccctgcccccttgccacctcccagaatgttggcagggcctctgggtgattttcatccacatgcaggggtgtcacataggcccctcggctccagctccccactgaacggcagctttgtatccacaggtagggctgggcggctccaatttgaacttaggcatatggacgctgtctaacgattcacgacactcctcgtttctttcgctactattggaccagttgagggtggagcccagctgcacctggcattgctgaagagccctcgcagagccagcgctccagctgctgggcgcgcaacagctgtcccgggaggcaagggttcgcacggcagtgcttctgtgtcgacagaggctgtgctgcagctccctgccaggcccgtgtccttcctagctgtgagaacactaacctgcctgggcttcacctgtggaagccaccgctaactagcagtcggaggcggcgttgtttctaagacaggcaggcagctccggcaggagcagccgctaagcacaaggacggccaaccacacaaagcctgcttctcaaccactcgcaggaaatcggctcacagttgctccccattcttcaatgctgatcctgccactttactgaaaatcacattattaacgtttaaaaaacgtatgggaaccatgcaaagacatccacgcccctcagttgctgccgctccagcacctggctccgaagtctgtgcagaaggcgaggctcccgtagtgctcgagagggccttgcacgctccccgtggagggaacaaagctacgtggattttccagcgcgccgcccacttcaccaggcagcctctgggcttcatcctgctcgcgtgacaggtgtgctctgtgctgtcaggaaactgcagggctttgagtataaactgaaaacagcaaaactatgttctcatctcagaggccccttccttctcaccccgaggtcacctgggcccggagacacagcacccgccgtgcaggagcctggaagatgtttgagcaacgagaaaaaaaccagaacatgttaccgcctctaaaatgaggaaatggcaggatcaaaattaaatgtccgtgaagtgtatcatcatgtcaattttgttagttgttacacatagtttaaaacactcacatctgggaactaagtacgggttaggttttctcactttgccacaactcctcagtgaacacaacgaattcataaaaatcactgtcaattcggtgagttactcataagcaaaggactctgaagcaacggtcaccattcccgccgtctctgcagccgtgaggcccagcagcaggctaggcagcccggttcgcgtgtccgtgcggacgcctggtccacggcccccggctgtgcgcgcagcagctgaggacgctccgaggacacagcgcaggaccagcacggggccgccacctgcccgggccaccgcctcctcagaagataaaagacctactccaagcacctctgcgctctccaacccaaacccggctgagccccgacgcagcagcggcagagcctcttgaaggagctgccggcctgctccgccgtcctcaggaaggctcccgagtgaagctatcccaattgttttcatcatgagtctttgctttagttgacacagcttcgcactagcacccaccgcgccagtgggggccgccttgcctcaggcaagaaagcccctggcttccgagcgcccgacggggtcctctaccccggcacagggaggggcgaggcggcgctgcgggcgacacaggccctctcaagggtcacgcggcggccgacgactccagcccacccagggtcctcagagctcgtgtctcccccgggggctgctgcatcgcggctgggggcccggtccgcccccacagcgcaggggagcctggccggttgcggggccgctcgagggctcgcagtgcctgcagggcctggacccccaccctgccacccgcggcccggccctgcgcccccaggagagtaagtgggaggagggcgcgggaccgtccagggcctgctcggggaccggcgcgcagcggagccccgagaagcgcggctcggccggcccggggtctgcagggcggagcggggcccgcagcagcgtctggacgccacggcctcccacgggagcgcccacctgtcgccgcggggcggggctggggcagggcccctcccatcccctccctgcagcccgaatgcgggccctggccccgcgcactgacctctgacccggctgtcaggtcccgcgggcacggacggcgccggggcagggatgcgcccgcagtgcgcaccgcccggcccgcgcctccagcagcctcagcgcctccacactgcgcatgcccggccggcccggcgcggctggaaccagatccagccggctggaccgtgacgccagcgcgcctgcggggactggacctcggcgcgggggtgggagagccggggcggggcctcggcgctgagaaggcgggggtggaccctgctgcagcccccactgctcctccgacgaggctctctggccgcccgggtctccggtccacctgcgcgaactgcggggagggcgcacccccgcccgcgcagggcccctgccagctgcacgtacttgcctctgaccgcccccacccagcccctatcgtccccctacttccctcatctcccccatctgcctccattatcctctcatctcccccaatctgcccccatagacccatctcccccagtctgtccccatctcccctagtctgccgccatctgtccctatcgctcccccaatctgactccatggcccccatctcctccagtctacccccatcttcccagtctgccatctccccaatctgccccatctctccccagtctgactccatgtccccccatctcccccagtctgcccccatctcccctgcccaggccctgcaggcagaggcctagccctcccatggcatccacgtgtccagcaaaggggaggtgctcaataccggctggctgaatacgtggatgagtcacgcagccttttcctcaccacacagagggcgtctagatctcttctggcttgtgagttccctgccctgggactaagactgcagatcagtttttttgcttgtttgtttttggagatagggtcttgctctgtcgcccaggccagagtgcagtggcaccattgtagctcactgcagccttaacttcctgggctcaagtgattttcccaccttggccttccgagtagctgggaccacaggagtgcaccactgtgtccagctaatttttaaattttttgtagagacagggtctcactacgttgcccaggctgttcacgaactcctgggcccaagtgatcttcctgcctcggcctcccaaagtacggggattacaggtgcgccaccatgcccagcctaatttttaatttttggagagatggggtctcactatgttgcctggcataggaggctggaactcctggactcatgtgattctcctgccttggcctcctaaagcactgactgggattacaagcatgcaccacggtgcctgccttgcagatcaattttatggtgcgagggagccgcactggccacccagagcacagtgagcccggaggctgggccggttccagggcgaggagaggcttagactccctctcaaggcgtcagggtccaggacacactgagctctggtcgcggggccctgctctggaggccacccctgcctggggagatggtgtgggcaccccagtcccccgctgaataaggatctgcaaggccggagtcaggcctggggctggctgttttcctcctagctgtttcaccatctccaggcctgttcccatgcagaggcctgctctgtggtggcagcggggcaggcaagggtggactggaggcctcctggagctggtggacacgaggaggccaggaagggatgtcctgcccactgcctgcagcggctatgcagcagtgcttccgatttagtgtctctgccactggtgtccgcaccccgctttcagagaaggaagtgtgtgctcagtcaccggtttcatgggagggactcaattctgggccttctgagccccagtggccttgtgtgctgactccccagtgtgtccccagcatgaatgcgccagcccacacagtcacctgcctccatgaacgcgccaactccgcgcatccacctgtcttcccgaacgcaacgacccacgcatccacccacctccataaacgcgccaatcctgctcatatgccgtcttcaccaacgcaccaactcgcacagccacccgcctccacacctgagcccggggaccaggtttcttctccccgtagttctgtgctggtggctctgggctgctttgggagacaaggacaagagcaggagcgggagaagctggcctggcagtggggtgcagtcccccgggctgggccactagccccacagggatggggacgtggtgccggctgaggacccaggggcttcactccactccatctcacgcttccagctaccctgctctttgcacttcacagagggggaaccaagcccagcaaaggtggacacataccagctgctatgccttcctaggtcctgcccagtgacccacctgtagggctgtgctgtccccagacccatgaaggcacacataggcttgtggctttgggcaggtgggactctctccccaggcaggcggggactctctctctcccggggcagggggggactctctctctctcccggggcacgcggggactctctctctctccccgggcaggtgggactctctgggcaggtggggctctctctgggcaggtgccaccatgcctgctttcccacagcccacaccccgggccccaacacagagcagcaggtgcaaggctgcttactgcaccggcacatccaaccacctccacaaacgcaccagtccatgcatccacccaggctgagctaagggccccttgtacctagtacagtctcaagggtggagtggccaggagggagccctcccactgccttggcttgaagcatcagtggccagtggtccacactgagaccctagagccccctcccccagcaggtcggcaggtcctggtcaggaggaggggccaagaggaaaggaagggcccccagatagctggtgaactgcttccgtacacgggatgccgttccacacgctacatatctggacagaacaagacaaagatgcgtgcccattgagaggctatgctgaggctgtaataatactgaggagaaaagttaagggtaggctgtttttctgagatttaaaatggttgggggaggaaggaaatcagcgaaacagcaccacaggcggctcctgggcagagaccagagacctgcagggagggcagagtggtccgggggggcagagacctgcagggagggcagagtggtccgggggggcagagacctgcagggagggcagagtggtccgggggaccagagacctgcagggagggcagagtggtccgggggggcagagacctgcagggagggcagagtggtccggggcggcagagacctgcagggagggcagagtggtccggggcggcagagacctgcagggagggcagagtggtccggggcggcagagacctgcagggagggcagagtggtccggggcggcagagacctgcagggagggcagagtggtccgggggggcagagacctgcagggagggcagagtggtccggggcggcagagacctgcagggagggcagagtggtccggggcggcagagacctgcagggagggcagagtggtccggggcggcagagacctgcagggagggcagagtggtccggggcggcagagacctgcagggagggcagagtggtccaggtgcggggggcggccagcaaacaccacccggggaacgggccgagagtgcggggtggctgcgaggacgtgccgagggggtgagagcaacctggtcaccaaaccttccccaggtaatgagaattcgccttcgaaacctgggcccaggcaccccaagaccatgtggaacattctgagtcattcaaaaaagacataactatgtctgacgcattcttttaattaactgccctgctcaggtggtcagtgggccccacttcccagacacaccacgccccagagaatgcagggtagatgggccccagatccagagaactgctcccggcccacggggctgccccaacacgtccctcgcactcggcccgcctgaaaataaagtctctgaaatggaacctggggctgaggatgaagccccccgcaggtggatctgctgttggccagagcagagaaggtgccgtggaggcctcggcgaggctcctgtctgccaaatcactttcgtggcatcacgagaatccactgtggaggtgtgagggccaggaggccctgagaagtggaggccctggccctaagaggccacagccacccacccacaccgccaggcacccccaggtgacagtggccctcagaggccgcagccacccgcccacaccgccaggcacccccaggtgacagtggccctcagaggccgcagccacccgcccacaccgccaggcacccccaggtgacagtggccctcagaggccgcagccacccgcccacacctccaggcacccccaggtgacagtggccctcagaggctgcagccacccgcccacaccgccaggcaccctcaggtgacagtggtgcccttgggctgctccagtctgtccatgacaggcaggggcaggaaaaccacccaatcagcaggtccccaagagaaaacactggtcggagtcgccagaaagcacgatgctagggtactgcacgtatgtgggcagcgcctctgccccaagcatccttcctccagcccagtcacactgtctgcctgaccaatcctgcacgctcctcactaccctgcccggataccccctctctgggaaacctgtgagccccaggttgctggagggcctctcctctgtgcactcgcggtgcggacccaggccacggacagtctcggcaagtccgttacacactgaaagaagacctaccactacctcgatacgagggaacacagcccagctcggtctgtgaagctagtagaaccctgatacccaaaccagatgaaaacaaaactacggactaatatccctcataaatacagacgcaaacatcctactcagcaacatggaaaaagagtcacacaccatgcatgacaagtggagttcactccagaggtggaaggctcgctcactatttaaaaatccattgggccgggcgcagtggctcacgcctgtgatcccagcactttcggaggctgaggcgggcggatcacctgaggtcgggagttcaagaccagcctgaccaacacggagaaaccccgtctcaactaaaaacacaaaaattagccgggtgtggtgggttatgcctgtaatcccagctgctcaggaagctgaggtaggagaatcatttgaacttgggaagtggaggttgcagtgagccgagatcacgccatttgcactccagcctgggcaataagtgcgaaactccgtctcaaaaaaaaaaaaaataccatcgatataatgcaccctatcaacaggctacagaagaaatacgacgtggtcaaaccaactgatgcagggggcatgtgacgaagttcaagacccacgcgtggtaaacacccaggaaatcggtaacggaggtgcctcctgagtgaggtgaggagacacccaggaaatcggtaacgggggtgcctcctgagtgaggtgaggagacacccaggaaatcggtaatgggggtgcctcctgagtgaggggaggagacacccaggaaatcagtaatggaggtgcctcctgagtgaggtgaggcacatctgcaggtgctcctccaaggccaggagcagggcaagggtgtccaccctcccactgtccccactgctatccagcatcaggctggccgggggccacaggcaggaaaaggaccagaaaggaagaaatataactctctgtatttgcaagcggcatgaccgttgatgcaggaaatctcagagaatctacgaaataaatcctgggactgtgagtgggttcagaaggcatgggaccgcagacagtcagggagctggcaatgggctcgcggaaactggcattcccgtgctaccaccacctacgactgctcagcaacaaggaaatgcttagctgtaaatttaacaaaacctgtatgggacttaaatgctaaaaaccacaaaacactgaagaaacaaactttgaagaatccaaataaatggagagacacattgtgttaatggacagaacagacagcagagtcaagacataaattctcccaaaattgaggtacatgtttcatgcaactcctaccgtaaatttcagggtttttttttttgtaggtaaagacaagattattctaaaacgtatatggaaaagcaaagtaacaaggatagctaaaacagcgctgaaatacgatgactagaaggaactgcatgcctgatttcgggacatcggacagctgtggtgcagcacgggcagtgggagacacacagaggaacagagaacagtgaacccaggaggtgccccatgttagcaatgtgattttttcaaaattttattttaggtttaggggtgcctgtgcaggtttgttatacaggtaaacttgtgtcatgggggtttgttgtatagattatttaatcacccaggtactgagcctagtacccagtagttatttttcaccttctctccctcctcccaccctccaccctccttttcctcctccctcctcccacctccaccctcaaattcactcctgtgtctgttgttcccttctttgtgctcatgagttctcatcattcagctcccacttatagtgagaacatgtggtatttggttttctgttcctgccttactttgctaaggataatggcctccagctccatccatgttcccagaagacatgatctcactctttttaatggctgcatagtattccatggtgtatatgtaccacattttcttcatccaatctgccattggtggcatttcagctggtgtcatgtctttgcgactgtgaacagtgctgggctggtgtcatgtctttgctattgtgaacagtgatgggctggtgtcatgtctttgtgactgtgaacagtgctaggctggtgtcatgtctttgctattgtgaacagtgctgggctggtgtcacgtctttgtgactgtgaacagtgctgggctggtgtcatgtctttgctattgtgaacagtgctgggctggtgtcatgtctttgtgactgtgaacagggctgcagtgcacatttgcatgcatgcatctttatggtggaaagatttatattcctctgagcgtaaacccagtaatggagcaatctgatttctgacaaagtttgtaaaggcaattccatggggacagaaatcttttcaacaaatgctgctggaacaacgggatgtccacaggaaaacaataaacctcgaaccaaagaagatttacagatggcaaataagcatggggccagacgcgcgacatcctttgacgtgagggagcgcccatgaaaatagcagtgaggcaccgcacacctgtcacgatagcccaaatccagagaccgacatcaccaaatgcgggtgaggatgtggagcaacaggaatgcactcatcgctgtgggaagtgactgcaaaatggcacagtcacttggaagtcagctggtggtttcttaccaaagttggcaaaatcctgccacaggattcagcaaatgtgccccttggtattcacccacatgaactcaaaatttaggttcacatgaaacctgcacacagatatttcgagcagttttattcataactgccacagattggaagcaaccaagatgcccttcagtaggggactggataactgtagtccatccagacagcacaagaaaggctctgtcatgccgtgaaaagacgtgagcaagtttaacagcattctgcgaagtgacaggtgccggctgaaaaggctgcacgctgtggggtcccaccgcatgacattctggaacaggtagcaccatggagccaggaaagggttccgtggtggtcagtggtggtggggagggagggatgaatgggtggtgcacagggcccttttggggcagtgaagctgctgcgtgtggtgctgtaacagtggatgcacagtggatattcatttatcaaaacccacagagcatgccataccaagaggggccccccataagctgcggacttcgggcggttgtgctgtggccatgtagggttcgggtgctcgtgctgtggccgtgcagggttcgggtgctcgtgctgtggccgtgcagggctcgggtgctcgtggtgtggccgtgcagggctcgggtgctcgtgctgtggccgtgcagggctcgggtgctcgtggtgtggccgtgtagggttcgggtgctcgtggtgtggccgtgtagggttcgggtgctcgtggtgtggccgtgtggggttcgggtgctcgtggtgtggccgtgtagggtcatcactgttgtaaatgcactattcagggtgcagggtgttgataatgggggaggccgtgcatgtgtgtcaggagggtgtacatgcaaactccatcatctgctcaattttgctgtgaacctaatattactcttaaaaaaaagtctattaaaaaaaatccgataggggaagatggcggctgctcctttggaggagcgggattgagaggatcggggtggggagaccaaacaagagagacatttctggctctgaaggcgaacgcttcgctggccatttaggagctctgctcaaagccagacggccaagcgtggtggctcatgcctgtagtcccatcactttgggaggctgaggcaggagtatctcttgagcctaggagatggagaccggccggggcagcatgtcgaaaccctgtctctactaaaaataaaaaaaattagccaggcgtggtggcatgcgcctgtagtccaagctattctggaggctgaggtgaaaggattgcttgagcctgggaggcggaggctgcagtgagccgagatcacaccactgcactccagcctgggtgacagagtgagaccctgtctcaaaaaaaaattttttttagcaaaccagtaatagaaaggatttacttcagtctgataaagggcatctacaaaaaatctgtagttatgtcatacttaatagtaaaggagaaatgcctcctccctaaagtttggaacagtacaataaggcaagaaaaagaaatgaaaaggcttttagaacagaaaggaagatgcggagccgaagctggactgtactgctgccatctcggctcactgcaacctccctgcctgattctcctgcctcagcctgccgagtgcctgccattgcaggtgcgcgccgccacgcctgactggttttggtggagacggggtttcgctgtgttggccgggccggtctccagcccctaaccgcgagtgatcccgccaacctcagcctcccgaggtgccgggattgcagacggagtctcgttcactcagtgctcaatggtgcccaggctggagtgcagtggcgtgaatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccctgtctgagaagtgaggagcctctccgcccggcagccaccccatctgggaagtgaggagcatctccgcccggcagccaccccgtccgggagggaggtgggggggggtcaaccccccgcccggccagccgccccatctgggagggaggtggggggtcagcccccccgaccggccagccgtgccatccgggagggaggtgggggggtcagccccccacctggccagccatgccgtccgggagggaggtgggggggtcagccccccgcccggccagccaccccgtccgggaggtgaggggtgcctctgcccggccgcccctactgggaagtgaggggcccctcagcccggccagccaccccgtccgggagggagatgggggggtcagccccccaacccggccagccgccccgtccgggagggaggtgggggggtaagccccccgcctggccagccgccccgtccgggagggaggtgggggggtcagccctccgcccggccagccgccccgtccgggaggtgaggggcgcctctgcccggccgcccctactgggaagtgaggagcccctctgcccggccagccgccccgtccgggagggaggtgggggggtcagccccccgcctggccagccgccctgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcctggccagccgccctgtccgggagggaggtcggggggtcagccctccgcccggccagccgccccgtctgggaggtgaggggcgcctctgcccggccgcccctactgcgaagtgaggagcccctctgcccggccagccgccccgtccgggagggaggtgggggtgtcggccccccgcccggccagccgccccgtccgggagggaggtggggggggtcagcccccctgcccggccagctgccccgtccgggaggtgaggggcgcctctgcccggccgcccctactgggaagtgaggagcccctctgcccggccagccgccccgtccgggagggaggtgggggtgtcagccccccgcccggccagctgccccgtccgggagggaggtggggggggtcagcccccccgcccggccagccgccccgtccaggaggtgaggggcgcctctgcccggccgcccctactgggaagtgaggagcccctctgcccggccagccgccccgtccgggagggaggtgggggtgtcagccccccgcccggccagccgccccgtccgggagggaggtgggggggggggtcagcccccccgcccggccagccgccccgtccgggaggtgaggggcgcctctgcccggccgcccctactgggaagtgaggagcccctctgcccggccagccgccccgtccgggagggaggtgggggggtgtcagcccccccgcccggccagccgccccgtccgggaggtgaggggcgcctctgcccggccgcccctactgggaagtgaggagcccctctgcccggccactaccccgtctgggaggtgtgcccaacagctcattgagaacgggccaggatgacaatggcggctttgtggaatagaaaggcaggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggctgcagggtcctctgcctaggaaaaccagagacctttgttcacttgtttatctgctgaccttccctccactattgtcccatgacccagccaaatccccctctgtgagaaacacccaagaattatcaataaaaaaataaatttaaaaaaaaaaaaaaaaaaaaatccaggctgggcatgctggcacatacctgtattcccagctgcttgggaggctgaggtgggaggattgcttgaggccaggagtttgagaccagcctgggcaacacagtgagaccccccatctctgcaaaaaaactttaaaaattagacaagcatggtggcacgcacctgtactcccaggtactcaggaggctgaggagtgaggattgcttgagcctgggagttcaaggctacagtgagctatgattgcaccactgcattccagcctgcatgacagagtgagaccctgtctcaaaaacaaaaaacaaaaccaaaacaacaacctaaacctcacaaaaaatgaactcaaatagatcatctatttaaatgtcaaatgtaaaactataaaactttgataagaaaatgtaggagaaaatgtttgggacctgggagtcattgaggaattcttaaccatgacaccaaaagcagatccttaaaattaaaaagaacaaaaaaaaaaaaaaggataaattagacttcaccaaaattaaaaagaaaacagccttttctctgcaaaaccctcattaagaggatgtaagagataagctatggactgggacaaaatatgtacaaaccacacatacacaaaagcctagcgtctagaacacataaacaacgagaaggcgcagctcggagcagggctgggaggatgagcaaaggcagacgtgccggctgcagccgcgctccgtgagtgagtggctgctgcatgccgggcctccagctgacagtgcctcccggggtcaacccgaagccagaggctcggcagtatgctggagacccatcctgggcacctcccacgttccctgtgggaacagctgcttctgcagaacatggaaaaggtccaggctggaagctgtgcagacggaatttaggaagagggaatggagagactgcaggagggagggaggcccctgcacggcaaggtggtggccacatgctccagaataggacttgggctccgcactgcagggaacgggacctgggctccgcgctgcggggaaggggacctgggctccgcgctgcggggaaggggacctgggctccgcgctgcggggaaggggacctggggtccgcgctgcggggaagggggcctggggtccgcgctgcggggaagggggcctggggtccgcgctgcaggggaacgggacctggggtccgcgctgcggggaacgggacctggggtccgcgctgcggggaaggggacctgggctctgcccagggactccacaattccttactaatgttactgccgtttatgggggctctgaacaacaccacgttttactaacacatgcacagagtgtcagatgatgacatgctgtctcacttatgctaaggctcactctcattttatcatctgtaacgtcagggtgcgccttataatcaacaggccacaaagaaagtcacaagccatactcacaagaactaggaagttcgttgcaaaatattccttgtccgtgatcagcacggcacacactatcagactcactctgccaacacaatcactagagaaggttcatctccgaggggaacgccagccagcttttcccaccactccccgcccccccgagaaagcccacgtgcagacagacccaggccagctgggcccctctccagctcctgaccagcagccccggatccctgggtggcgtgcagctgaccttccggaccgccactcagaataagcaagaaagcctgccgacccgcctgaatgcggcaggggaaggggaagggcggccccaacatctccgtgagacacgcggctgcatcacagcagcctcggcagtgcgcggggctgcagaatcaggtgcacaactagggcatcccccacccgcaacacacacggcacacaggagcctcggcagtgtgcggggctgcagaatcaggtgcacaactagggcaccccccacccgcaacacacacggcacacaaccacagaggcacggccccaggccaggagcgcacaactgccctcaaatgccctcagcagccacggcacacagccacaaacacatgaccccaggccaggagcacacaactgccctcaaacaccctcagcagccacacaggggaggccacgtccacgtgacttcaaccatcaacactagactagggtgcaaccgcgaagctgagtcagggccacacgcccccctacgccccaatctgtgcccacccttccccccaccaactgagtcttgtacaggggctggccaggacccttggatacgcagctgcagcctctggagagtgtttacacctccagctacgagtacttattgtggttcaggtggagggtggttccctctgacgatctccccaggacacacacgagctttctgccattctccctggcaggactggcctgcttggcacaggaagtctctgcagataaggcggtctgcagtgacctgaaagctcagtggctcagaggaagctaacctctagcattccccagccacagagcacccctgtgggtaggacccacagagcctggcattacagggaccagacagcacggtgcatactctgaccagggattctgaggtcttgggccatttataccatggagataacgaagcttactcttaggcgggctgctaggagggcccaaagtcccaaaccctgatctaaaaagccagaatacccctgggttcaaatcctggctccacggcctgcagtgtgacctgggctaagttgcttaagttttcacaattaaatttaaaatgcatggccgggcacagtggctcacacctgtaatcccagcactttgggaagcccaggcaggcggatcacttgaggtcaggagttcgagaccagccggaccaacatggtgaaaccccatctctactacaaaaaaaaaaaaaaaaattagctgggcatggtggcacgcacctgtaatcccagctactcaggaggctgaggctgcagtaagccaagatcgtgtcattgcactccagcctgggcaacatgacagaaactctgtctttaaaaaaaaaaaatattaaaatgcacatggtgacctatctcattgacgctaaggcgtactctcactttatcatctctaatgtgaggctgcgccttaaaatcagcagtatgtcggaatgcagtgggcagagggccttctttttagtaatccataaagtaatggcatagctaacactaatcaatcgtgtcttaggtttgatgaaatacggacgtatctacctcaaaacaatggttgaggctcagaacagaacctgacacagaatacgccctcaggtatcggtgttggctgcttgtgactgactttggcaagtaagatcagtacccggcacctctgggcacacagggcccgggctgcatccactgtgccagggacctggtgccgggctgggcagcaagtcagtatcacatcagcaggcgtgggccgtggtgagcctctccctgccctcccgctggaatagaaagctgatcccgacgtcccactccgacccacggtcaggaagccgtcctgtccaggaaggtggctgaggtacatccctgaacacagtaggccacagcatcatgcagcggagggccagtggccgctattcttcctgctggtgttccactcggcccgcagctcacagcaagtctatgcggaactgtgcaacccacatgctttgattttcagaaatgttcttagatcctgaaccagaatgtgctgcaggggggactgtttcacctcaaaaattacagcaaagtaaatgtccttgtttcaacttttccaatgtttaacttgtaacaatagctacaaaagtaatcaggcagcaatgtgtttctttaaacggctttcctgtgagtgttccgtttacaaagaaaatcctaaaaccaggaagtaattggtgactttggaaacagcaagcaaacttcggtgaagaaagaggggcaggtgtacctggaaggactaacttgcagccactcatttcctttggagggcggtggggcctgcaccctgcagattagggtatattctgactcagcaaaataggcaccagcgcctgtaaaaagaaaccgcgctgggcactaagagaattctcaaaaactcccagagccctgggtgtgtgtcctcccacagggaatctcgcacgagttcgtcaaatggctggtctcaggttacacaaccagcactgcctccaccgccaccgccccccaacctcactggtccgagcggttccccgcggtctagccgcgagggcggggccggggggcggaggccagggcgggaccaaggctgggggcggggccaggcatggctgccgctcgccggccgggggcggggccgacggtcacgtgtgtacacagggcccgggcggcgtgcgcgccgtgagccccgccgcctccgccagcccgagctgcccgcccggcggcgactgcgccggccgccgcccagcaagccggtgagtggggcccgggagcctgggtcgggtcggtggggcacaccccagtctccgcctggggagggagccagccccaagctgctgtggctcccacggcgggcgctgcgcttactgggacccgggtcctctggccgctgcccactgcggggctccgtgcccttgccaggaggggaccgctgtcctccggccgcgctccgagctgagccccgggggcgggctttcggtcattaacctggtgatggcagctgaatctgctgctggcgtaggcggcacagcgccgccaccggctctcccatgtccgacagggcaccactgatcctgctctcctgggccactatggtgactgctttcggccccttctgtgattagtattttaaagtgagttttggatctgtgtctacatggaggtgtcggatctgctgtcagttgtcttggacagttggcagggcatgggacggctctttcaaagcttcactggaaggcagtgctctccagccgccaaaccaccactaccagcagcagaaaacccactattaagttagtattacaaacctggcaagtcagttctctaaattaggcataagtctatgaatcttgatgtgactggtcacagtggcttatctctgcatgcatgctacgtggtggaccagaggataattctgtattcgtcgtccacagcctttgatctcttccctgcccatgaagatgtacttgagtcctccattccactttaaatagccagctcctgtccacacggaacagcacgacatcttttatcttttgctacctgcagcacctagcagaggccagcattcaataacagagggccaagaggcttgctttaaaggcctctgcaaacttgtatgagtaaaatggttctgaccatgttcccaggctcctcacgcatagtggtgatgagatagtctaccgtcctaactggggcaccgttgagagtgaacggaggcactgttaataattagacgaagtgcacactcacagtacccatgacctgctgtgcagctccttcaagaactactgtaaggcctggctccccaaccagaacccctgttgtcttcctcaatgaagaaggcctctgaagacaagtgacttaagaacatagtttatatgtattgaatactgttgtgccttttcacagagaagaggtcggggccagagcagctcactgcccgacgccacacacatccgtgctggcgtccacgtgtcatcctgcctctctagccagcatggacatatcctgaggatggaggacagaggaacacagatttagggcagaatgtaaatgtgaaagttgacttggagtccctgcaactcataagccccagtaggctgatgaagagagaagggcaaagggcgcgcacctcatgtgggtcttaggttaggatgtaaaggctgattatgtctatcatacaatgaatcaatggcatactgcacagatcgctgcatggggaaatatgctcgtgtaatttacagtcggaagagggacatgctgctcactggggcagggagaagaaggggctcctcagggagctgcagctctcacagcccctaggatgtcacctggaatcctgaaaaaataactgccgcctggcctttaatgacccaaccacagcgaggtcttgcctttgcagaaggaaattatcacccagagaacccggccgaccgtgtcatgcacacgacgatcccacggtgctgttttctgtcaacagtgtttcccagccattccctcctgcctgccagctcctctgctctccagggctttcactaacccacctgcccaactgaccagcattaggctgtccagttagcccacatctgtccaggggtctcaaaggctcaggaccccaagacaccatccaggtagccaagaggacagggaacccagtctggagagtagaataacgtttcgctccaatttgagatcccaaaatgagatgctgcccgggaccagaagtcagtttcttaggagcgtgctgtctacccaggagcctccgtgtgcaaacaaaatacccccttgagcagcagagggacaaggtggaggtggggcaggtgtctgttcatccccacagagccacacccaggtcccttcctgcaaaggccaaggactttccccattttaattggaaccaaagcaagccttgcagaccactgtcgctaccacagctagtgtgatgaggagaaataacctgctggctcctccctgggaaacaaccaaggtggtgataagatctgcggctcagagcacttccctgcaggttaaggccacgcctagtaaaccggggctcgactgaggagccccggcaggtgccaagcctgcccagagtctgcagtagagactctctgttcttggccatgtctttgaatttctgaggaagtcttttttgtttgtttttgtttttccctggtctgatgtacctggagagggaattagcctcacacccagttagggaacaaaaagccaagtaaacaaaagaatgctgttccaccttcctccagggaactggcgcccatagctgcaggcacaggtgcccagcccgctcactggcccagcaaggtgcttggtctcaggcccccagagcccgtcctggagccgcaaacatgctcgctattatccatggaaaaagagaggcattctctttgtttatagtctaagccaagtcacctgattcactctcactactctgcagtttggaattgtaaaaagcaaaaggctacaaaaatcaaaaccatccacctatgtaatgaaccatttcttatcacagcccaggaaggcacagataggaatcagtgtgcgtaagctctccacgtggaaaccctgtgaaaacagcagcctttcctaagcatctggctcctaggagctggatgttaattgttgctaaagcctgggttcattactacaaaagaaaataaacattccagagtcattttgaaagcattttgattgttctagaatattcacccaaggttgagcgtctcatggtgcatggcaggttcggccaggagctggccgtggcctttccactcctttcctgccatcctgaggatgcagtgcctggggcctcgcagttctctttccactcaaatctaaggctctaaagcttcaacaactgtccggggacaataagaagcgctgagtccccatcctgcctgctctcctttctactcagtggggaaattggatcactcgccttggtggatcactcgccttggggaaaagccttttacgtcactgaatacatccccttctacggttttcatccaacagtcagccaggctgctgcagcacacataaaaacttcccctgcctgcaaagagctccaagtaggtgggaaagagatggatgtgcggacaggcttaacccagcaaagactggcggaggggtgtggagacagtggtcaggggtgggttcccgggggtactgatgcccaaaataaaatgtcaaggacgagccagtgtttgctgagagaacgaggggaagcgagaaagggtgttctaggcaagggatcaacatccgcaaaagacagtgtgaaagagagcacccggaaacttcgtggggatcaccgggcgtgggacttgccggccccagctctgacagggccctaagcaacagaggaaagaacttcccgactaacagggacagcaacatcaaaagcgatggcttttgtgaaactaattcagccaccttggagcagaggattcctctgctggtttctgtttctgccagctctgtgcagtgcaggcgctatgatgctctctctctctcacacacacatacagggacccgggtgcctctcaggttgagaggggtggtcaccatccccacactcaggccccctctgtctccaggcctgctgcttctgaacaggcctggggcagtccatttctattgggaaaccctatcaaagttagccccgggtttcagccaagttcacctcactgctcacagacattcattattaacagactgtttgatagcactttgggctctttttaaataagacataggaagaaagatgccaacgtctcacttgaaatgctcctgacagctagcctgacggggtcctgtcgcccctgtccacaccctgctatggccatggtctccacagccgcacatgggctccagacattttcacgagttatgaaccaaagagaaccaagacccctggagcaggttctccttctcagtcccatgttcctttgaaagcaatgaatagaggccagggaagcaagtgtttatactccagtttagtactagtgaaacatcgggaaattcattgtgttggtatcaaagccccaactcagaacataaaaaccataaaactgcaaagcctctgcagtctgagcgtgcgctccccaggcctccgctgtctgagcgtgcgctccccaggcctccgcggtctgaccctgtgctacccatgcaagcgccacccacaggtgcgtcctgggggctgcctcctcctccacgttggccagcagtgtggggtgtgacggggcccatgttgttgtcacccccaccctgccccacgtttcccctgcacacgtgtccgttcacaaagattctgagcaaaaggtcacagaacagcttcctctgccctttatatgtggggaggaggccaaagatctgcaggcgtcatcattccaggccagggctggtaacagggagcaagtgccggcaccctcttgtgcttcacatgggttggtttacttaaccctcctgtctcatgaagatttttactaagcctggggaaaccgaggcacacagcaaggatgtcacctgcctgcaaaggcacctgtgtgcaagccaggactggaaaagctcagcctgcagtgcacatgcttgctgcccgctccagagcccaggcccttaaccacttccttcctaggaagacggagggcgagggagtttcttacagcgctttatgtcaactcctgctgctgcccaccactaatccaggcccctgcagacagcagggcacggtccttcctattagcaggcttactacgaagccctgtctaacattccctcatgtcaggtagaaggaattagaccagaggtcaaggcagcggctggaatcagtggtgctttctcaaagtaggaaaacagttttaggactgttttcggtcaaattttgggcaccactgtactgggttctatgacagagaagccaccaaggtcccgtgcgaggagccctgggcagggacagctgaagctgtgcacctgggccctcctgattgcctcccaccagccaggcctggcagcagccagcagccaccccaccccaccccaacaaggagagctgccccacactgtcggcccccaaagctcaggacacacgggccctcccaggtctctctggcgggctaggccttggcagggccccctcagcgggccccactctgaaccgcaagcacagggtcttctgcagtgtgagacctgctgtcagcacaggcctacgggctcagggctgtgcagggacacaggggccagcaccactgggcaccctgtcctttcccagcctgcctgtgcaccctgtgggcagtgactcctcaggcacagtggcccaaagtcacaggtggtctgtcaggggctctccagggagctgcacacactcaggtttagatcaggaacagaacagatccccagggcatttgctcaggctcagagcagagcagggagccgtccacctgcggcgggcacatccatggacttccaagccaacagggacagctgcccagacgggctgcccaagccaaccaaggatcctgtcccatcggtccctgtggcttgggagtctggcactttttggctttcgtttctcaagctgccccagcttctccaagtcctgagcctggggctcccagctccgagcggatgctctgcaagtggcgtccctgcaccctggtgcaggcggacggacgcgggagagcctgcaaggaagtaaggcccagcagccttcccgggcttggaacgccgcagcctaggaagcatcttcccaggaaatcgcagtcggagcccagcacggggtcttggaagaaaagaccccaccttctatcctcacgagtacgcattaggagtgagcaccgctcagtagatgacacagaggcacagctgaggacccagagacgggcacaccggaaacagcgacatccacaggcgctcggcagggaccaggaacccagaaggcttgacgcgcagggggtctcggagaaactctacccctgtccttcccagcctcctgcttagctgggcctcaccctagcctgctggagatggcggccatgccgtcagagagggggatggacagattggctgaggtcaccccacaggccagcagaggcctgggtgggagtgcgcagccccgcagatggctgcttatggggcccagaggccacccctgcgtcgcagagggcaccagcacacccggacttctcggaggcttcatacagctcccaggccctacaagcagcgtgtgggcagaggcccaggccccttcctgtcactcagagaagctgctgctcccagaaaacggggcgccagcctcccatgaacactgtgtcccaaccccggtcctctcaggattcctgtgtggaaatgtcacttctgtctcagctctctagggtgcacctggtgtccagctctgccccctttctgcttaagcagctgctgggagaccctgagccaggccgccgaggttctgagctcgtaaggggtgcagcagtttcccgcacagcgtggggagcacatttgctcacgtctcccaggctggctgtacactctgaggccagccctgggctctgacactctcccgattccgctgggctttctaagccctcctctcctgtccactgctggcccatggcccaggcccagccttgaagctgtaaagacctctcaccccatccaaatgagactggtcagatatctcccgcatgtcagccgccactggattgggaaggacgggcagtaggtgcaaggctggccctttttatgagagttatttaaaaaacaaaaacaggtcaggcacagtggctcacacctgtaatcccagcactttgggagactgaggcaggagggtcacttgaacccaggagtttgagactagcctgggcaacatagtgagaccctgtctcaaaaaacgttaaatgaaaacattagccagctgtagtggcacatgcctgtagtcccagcttcttgggaggctgagatgggaggatcgcttgagcccaggaggcagagggtgcagttagctatgatggtaccactgccctccagcctgggtgactgagagagatcctggctccaaacagaaaaataaaaacagaaggaggaacagatgaatcccatttgtgacattaatgaattctcttatagggaaaataaaacgattgaaactgggccatcttggacagctgaggcccaggcagggccagctccttccaccttcccagccaagatgctgcctgcagcccctcccctcctggcccgagatgctgtcattgtccctaagagaccctgaggcctgctccaggctgagtgggtgaggagcctctgagcaggcgcctgcgtcgaggcgtgccctcctgagaggcaaggctgacctgcagcgtccagctcggctggggacactcgcctgagaagagcccagtcctgggtgcctccctaggggagggccttggggctgcttgtgctggcaccgacgtgggcctggggagggacctgtgtgtgggtggcaggtcttgaggagtcgtgggggagggtttcggggggagatgctggtggtaacagtgggaggtaggcagtgaaaccagcagtgtgactttggaggtgctggaggagcagggcctggcggaagaagtgggggagccaggaaggagcagctgccagggacggcctggcctgggagggtggccaggaactgggggagaagctggtggtcaagctggtggtctctcagtgcaagggtggggctggcctggaggagaggcccacagggtccctgctggctgagggtgcagtggcgggccccggaagctgaatatcacccccgccaccgggcaggcagtgctcagagtgaaacgggtgactggagggcatgtgccagctctgttcctcaagcctggcccaagagggacctgcagcatggggttggggggcaggcggcccttctctgtggtctctcctgccttctgagggagcctccagaatctttcatcgccgccacaacaaactcaggctttcgtgtaggaaaagagcccacttctgaagaggctcatctgggctttctctcccagcctctaagtctcccatcacctggctccccgttcctctttcccttgaaggaagtcagcagagtgcatggctgacgggaaagaaggcacagcgggcctgcccagtggggggagaagccaggccattgttctccagttccaggatgccctgcttccccagacagcccggcagccaggaaaaggaagtctctgggcacagaggcaagcgggagaccacggacaggcaaggagtcgaaggctccacccgcctgggccaggccaggctcccacagaacccctctgcgtccaggcaggcacatggggcccaggccatccccctcactcggacgcaggtgtggcgacggcgggggaggggcgtccacagtagagcccagaaccttgcgcaggacaggaccccggctaatgtgcccggaacagctcagtgacagggagctgggttggctgtgagggtcgggcacgcgtcacgagtctcctgtgaccaggagaggtgggaacactggctcacatgactcgccaggccctggcacgctgtggttctgtgggtgccccctgcagctcccagccttcaaaatgtacacctcgctgggcatggtggctcacgtctgtaatcccagcactttgggaggccgaggtgggcggatcacctgaggtcgggagttcgagatcagcctggccaacatggagaaaccttgtctctactgaaaatacaaaattagctgggtgtggtggcagtcgcctgtaatcccagctattcgggaggctgaggcaggagaatcgcttgaacccgggaggcggaggttgcagtgagctgagatcgtgccactgcactccagcctgggcaacagagcgagactccatctcaaaaaaacaaaaacaaaaccaaaaaaccatacacttcatgctcacttctctgggagccatggctaacagcctgcaggcaggagactctcaaaccagctcctggagggcactcccagggaccctgttcctaccacgagccagagaggaggcgggtcaaggagacttgtccacccaggcgtggccgaggaaggggtttcctcacgctctgctgacctgccttccttccatgcctctcagcccagctcctgacaaaggcgggaacctgagctcctcggctttaggaacgtcccccagagcccacggagcagcccgccccagctgccttccctcccaagatctccaggtaatgcctggtaaaaggagggctccagggagaatgttggggccaacacgcaaagcgcgtcaccttccaaccggcggagagtgaaggaaaacaggtacggctcggcttgtaaccttcactggaaacagaaaccatcctcatcattgatacctggtgaactgcacagagagcaacctgcagctttggaagtttataaatccttcagtatttgtcagctgccagtaaacaaaaatgcacacaggagaactttccacctgaaccccacctggaggccggcgttcccaggtcccggctggggtgacagcacgcactcgagagccggttcagggcgagtgggacgcacgtgagcgcagggaggaaatgccagcagatcccactccacgtgaccgcctcccaagaatcgagccattcttagccctgcagacgctggctgcctccctctgacttggcctcacggcggggcaggcattagcagtccaggcagcttctctctgactccctgcaaggaggggtgcggcgggcaagaggctggccccacgcggttccacctgcaggagagccctcgcaggaggctccgtgtgtggggccggctcagcttttctctggccatgcccatgtcccttctgtgcacggagacaccagatgcacgtgctcccctctctgcttccgacctgaacctgccctcggcctccgctgtgcctctgaggactcctgtgtcctgtgggctgagtgagcatggccaggccttcgctcgacagtagacccttctgttgatttcctcacggaaaaaagggttcgtaaccaacatctcaagcacactgaacaccaggggcggctgcatggacctggacacgtgtctgcctgacctgcccccaggctctcggtgggatgccccgcagcgatgcagacaggggcctgcgggcagaggccacggcctccatgagccaggctatcagaaaggtgggacaagaggccagctgtgctcagtttgcagtgcggtcccgtccaagcacggcccctcgtttctggaacccggctgtaaacagcaggagggaggggcggtggcgcctgccaagggaggcagaggccctgcggggaacttaccagaggaaaacaagtgcttgcatcctggggccctcacacgcacgcgcaggcggccaggcgcgctgctgataagagcctgcgggtttgcagagaagcgcagcagcgcgcaggtcctcaccagagctctggtggccacctctgtcccgccatgctgctcaccgacagtggccagggcccacagcaccaagaggcttgggccacaaagtaaaggtgagagcctgtggtgcccgcaggtgggagaggggacgtggggggctctgtgcagtacaggcaggagaggggacgtgggggactctgtgcagcacaggtgggagagaggacgcagggggttctgtacagtgccaccggtggacatctctaagtagggaatgaaggggtgccgagacagagcacactgaggggtcccggcccttggcaagctctgtggggtgaaggtggccggccgggtgtgccctcctgtcagtgactggaggcagcacacaaggcacacagtgagacagccctcccgctccgatcttctaatcacagaccctggacagatccgggggccctgggcgccccgtgaggccaggccaggctgctgactgacacccagtcacagtggcctgtgtttcctggggactcaagtggagtctggggggtgacgtccccaaactgggctgccactctgtgacagccaaagccacgcagcctcgcaggcagaagctggggtgtggaggaccacgatcctgaagaaccccgtcctctggaccctggcgcagcaggaggggagaagcccgcagaggcccggacgcccccctcaccggcccccgccactgtgcttggagcaggtgcatcctgtctggagcttgtgctggcccggcgagtggagcccagagcccatcccccactaccaacatcccccagattgctgcctgcctggccgaggaggtgctggtcaagatgtgttagtgaggagctagacaagatgagcacgtgagaagcaggggccagggagcctggacccaggacctgggggtgctgtggcagcgctgtggcggcactgtggctgggcacacccagcagcggcctagctctgcatgcctgtcaccacctgaccctcactgcggctgctgggcggcattcaccaggattgcacaatgacccacacctcccgtcctgcccaccagcctctggatgggaattcccacatctacccacccgcccatctgccagctgcctgcatgcctagccacagggccgtgtctcctgctgtggggcgcacactgctattggcactggggacctcgggccctggcccctccgtgctctccacctcccgagcctcctcttcccgccctgctgtggccctgtgtgtggtgtgggtcttgcagtggcaggactccagtggcgggtgaggacccactcccgcagccggcctcctcactgctcttgcctccgggcatgggaacgatgccgtctgctcgtctgcctgagacgctttctactccactccgagagtaggaggtcagccggggccaaatgacatggtggacatcaggcttcccgagatagctgtaggtccctgaggaatgcctgtgctttggcggggtgggggggtgggggtggcgaaattcttactctaggatggctccagccgccaggttctcattcagtgacgtcaagactggctatgtccccatgtccccagagcctcctgtgggctgcgacccacaggtcaccctccctggagcccaggctctgcaaggactccaaggcaccgggtcctgagctgccgggagggagggagggaggctcagggctgaccgtccacattgcctgtccctcccggcgctggcaagatgcgaacaccacagacatctagtaaacttcgggaatcactgtgcggggcccgtccaaccaactcaggacgaccacccaggcctcgcagcagcccgtgaagagtgggctctgagaatgtggggcacaccaggctccctctctggtccccaaccccagccgctgaaataagtgcagccacagcagcccccggtcacgacccgagacggccatttttcaacgctcaacttcactttcacagaaatgcaccaaaggcagcctcgctctgtggtctgcagcgattactgcaccaggagaaggcacccctgtacctgcagcacttctgggccagggctttgggacgggacgcgagctgaccacctgttccttctttccgcagggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatccgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtgtgttaggatttctgactgaataccagagctgaagggcccccaggggacagagggctggaggctgtgtcacacggggtctggtgggagggccagggtggaaccttaggccagctccgaaggcacctgggaccagcatccgtatctccgcggccctcgcagcctcagatggggcccggaccggcctgttccacttgagcgaacaggtctgcagtgaggagggtccatagtggggcgggtccgtagtggggcgggtctgtagtgaggcgggtcttagtgaggtgggtcttagtggggcgggtcggtagtgaggcggttcctagtgaggcgggtcccgagtggggcgggtcagtaggtggttcttagtggggcgggtcttagtgaggcaggtcttaggggggcgggtccatagtgaggcgggtccgtagtggggcgggtctgtagtgaggtgggtcttagcggggcgggtcttaggggggcgggtccgtagtgaggcaggtcttagtggggcgggtccgtaatgaggcgggtcttaggcaggcccgtagtggggcgggtctgtagtggggcgggtctgtagtgaggcgggtccgtagtggggcgggtctgtagtggggcgggtccgtagtgaggcgggtcttagtgaggcgggtcttagtgaggcaggtcttagtggggcgggtccgtaatgaggcgggtcttaggcgggcccgtagtggggcgggtcttagtggggcgggtctgtagtggggcgggtccgtagtgaagcgggtccgtagtgaggcgggtcttagtgaggcgggtctatagtcaggggcaattgttcctcgtcagcctggctggagaccttccacccattgggattttgtaaaacatctactttaaaatgtggccgtgagaaaagcccccattcctccccaccatctgttcgcctctccccgattttctaggattaaagtataggcctgcaatcccctacctccaattctaaagcccacaaagctctgaaaacaggaagatgttccccccaagtttgcggcaaattcactgggcagcgatccctgacctgaaggggtgtgagagcttcatgtccatgaggaccccaccccttctgaagacgggcgatgtggctgtgggagctgccctgagcgccccggggttctgtggcacacttcctccccacagcctgaacgcgctggaattctgagtatgcccggccccagggacagtgggggtagggtggggggagtggcaccttgcagccatcgacgtggggacgtcacgctctggtcccagtctcctgggaattcagccacgaggtcactggcattattcatcacgtgctgcaagcaggtcagagtcggcctcgtgaggacgcggctctgggtggctcctgcggggagctcagacccgcgggacaggctcctaagccgtgggattagagaacagttttctgagctgtttctgtcagtgtttggttttcaggtgtgaacctttaaagccgcaggcctgacctccctcccagtccctctggagccggagctggtgtaagggccgcgtctctgatggtcctgggcttcccatctccatgcctgcgcggaaaccctggcatccgatgaggaagtgatcacacaagcccacagaaccctgcccagcggctggcgccgtcagcccaaccctcctacccctgcagcccagctctgcagggtggggtgtccgtgcttgaaccaggagaccctcttcctggccgatactttccagccccccttggctccacgctgagctcccaggaaaggggcggaccccacacacaggtgagggtggcactgggctgcctctgcccgggaattacaccatccaactatcctccccaaaggcaggaggggcctaaaatcactatttcaatttctcagtggctttgggtgcaaactggctcatttctgtgggtctgttgcagggactggcctgcattcaatacccctcatcccaccctgctgggtggccctgtggagggccccagggacaccctgctgcctggtcagctgtttgttcctggtgggccccacacagggcaggcacatgcctccagcgcagaccctcgcctgctacctgagacacttcactgtgcaccatggcctgccccaaccccctacccagcgagtcccctcctcatccccaggttcccgccagcctctgctgcctgagaccctccactgagcgccaaggcctccgtcctcatccccaggctcccgccagtctctgtggctgcttcccaggagctgcgtcgctgactgttcctgagacacctgctcatctatattctatgttgccttcacctgggaagattcggcacctcctgagcctcctgccgcccctgagagattcccaaagccttcacctcatcacacacagaacacaagaacttgagccactcggggcagaaaaaggagctacttgtaaaaagtcaaggtagtcatctgcccaactccccagttcttccaggcagccgtctccccaactccccaattcttccaggcagccatctccccgactccccaattcttccaggcagccatctccccaactccccaattcttccaagcagccatctccccgactccccaattcttccaggcagccatctccccaactccccaattcttccaagcagccgtctccccgactccctagttcttccaggcagccatctctccaactgcttaattcttccaggcagccgtctgcccaactccccaattcttccccagtttgtgagacaccaggatgcgagtttttcagcgcgtgacgtcccagggtcaatgatattgctaccaacacttcttgactactatagttcaaaaatcattcatcttatttttgtttatccacaaaaaaaccttgccctgcttccttaagtaagattccagaaagggagtttagttgtagattcacttcattaaagttctaagagttattgtaggaagctggatctagtgtgaattgtggcgaagagatcaggaaatctacacacgtcttctttcatacacagcacacgacagagggaaagcaggaatagtaaccgtaacagaaagtatcataaaattggttatttcccctcgaattgtacgtcttaatactttcggttacccctctgtagttcctctttgcagaaattctgtccacccaatcacccaggagtggttccacttcacacacgcccggcacgcaaaccatgtctccacacgtctcaaacggtagcagagggagtaccttggctgctggcgaaggagtaagccacgcgggctgaaggagcaggcctgccccacacaggcgttactcctcccagaaaaataagaataaagtcaccattgactacacccctgagggcttctgtggccctgaggatggaactgaggtgttggggtatcctgcagccctcccaaggattccggcagaagtgagagcacacgttcctgcctccgccctgctgcacagggcagcctggcaagagctgtatggcggtgcgcacggtccgcactccgtcaggttgggaagtgaaggaagagcagagaatctaggcaggaagcataacgtgaacatgcccatttcacatgtacccctactcctacccctaacccctaactctaaccaacttaaacctcacctaaacaccctattcctaaccccctaaccaccctaaccctaaccctcaacaccctcatctgaaccctaacccttacagaatcgctctgggcctgcctggctttgccaagcctgagcgtgtgagtgcatctgacctgccccctccgttctctctgggctcctccatcctgtgtcttctggcatcgctcacagacccacgccccatcctgctcagccaccttgactcgctgggggaccacaagatgaacacagctctgacactgccagctgaccccggccacatctggggcttccacgcgacgctgtccccaaacagcaaatctttgggtacagatgggaggtgtcctgaggctgggacaaggactgggcaggggctggcagccggtctggcaacataagcaagcccctggctttccctctgctcactgccttggctctcttcctcactctgtgactgatcgggtgctcctgagaaacgggctccctgtgctgctcctggggtgtgcgtcattttcccgtgtcccgtgtcctacgggttccaggcactacaattcactggtccactctgctgctgacaaacatggggactgtttccaacttcaggcgttcgtgcacgaagcggcgctgttctgccgtgtctcccagcgcccaccatgggcccctgcgtggggcactcctcgggcagacacagcctcagccgcgcacgctcaccaagtgtggtctcacgtcctcacctgcccttggtgccatgtgtctctggtattttgtgccaagccaggggaggattaaggcatttcccatcttaatgacgtcttggcctctccaaagaagcgcctctttagggattctgcccacgtttctaagtgatgtaaggtccttcctggtttgatctgaatgtgggcccttgccacggctccttaatctaactgtacccctgtacctgtgctgttctctttccacagaagggcgagctctaccacaccacagagaagtcagagctccgcaagtccccacctggaagatggaagacccctcagaaacagcctgttcttccctctgcagaggtggggggcagggggactagccacactcaaaactggcagcctctgaggggagggagtcacttcaacatctcgaactttagacagatgtgtgtgcctcaggcagcatacacacacacatacatgcgtgcaagcatgcacacatatgcaagcacgcatgcacacacacaaacacacacgtctgtctcctccccgggaacaccgtgaccggaagaggcttcacacgcgtcggctgcagggtaggagacccgacacagcgccgggtcctgatgggctgtgacgtgaagatggggagaccaggcccttagcagccacagaacaggccccggaaagacgcacgatggctccactcttggaagcagatggtggctctgtagggagacaaggcttaccttgctccagggactctgaggagacgctgtgcagggaggctgcccccagcaggagacatggaaggtgagggcagaaggaacagcggtggggagcaggggcactgacaggttccagaccctgaccctgagcttcccacagcgcctaaacgcaacaccctgactcctgagaggaagggagggaatcccgagctgacctcacacaggagaaccgaagctcaaagctcaagtgtcaccctgaaaggcaccggcagacaaaggctgagtctccagagccagccctgcatccacccaaactagcgtggtgcagggactcctccctcggccgagtcacctggccccagactgtcggatgtggggccagcagggaccctgggggacgccccatggacacgagggagactgaagcccagagggtcccacagcagtgagcagcccctgctgccaggctccagggctccagaagccccagcccaccccacactcagggcgcacagaaggccccaggagggagggtgggaaacgccgggtcaagcgagcagcatccgattcttttctgcaggacatctgagctgtgccacacacactaaggcttctaaagagaaaagacagcgttccccgctgtccaaccctaatcatcacaggacgctttctgcagagccccttggggcacgaagattcttcccagcaccagtctgagaaacgatgaggccctgggcaggaggaaacatggccccatcctgttctaggggccacggcaccccttggggcccctctccagacccaaggctggacaggctggcttcctgcccagctccagccaactggcatacactaagtgtgcagctgaggtggtgggaggaaggtaaaacgtaccccacttggcagccacttccaaaattaaacatggttaacatctgtccccgctgtcccaattccagacatttacccaagaaaaatgggaacggaagtccacacaagcacctgtatacaaatgttcacggcagctttgctcataagagcccaacactggaaacaacccaactgcacatcaacaggtggacagataaacagatgtggcctgcgcatcgaaggaatgctactcgtcagcgaaatggacccaccggggacaggcgcggcaacagggtgaacctcacaaaacatgcagctgcggggacacagctagatgtgagcacgtgcaaagtactggagcctcttcagcagctccagagcagggaacccacctcaccagcgacacagcggcgacgagggccgggtctgggagggcgtgggccagggaggggcgacggaggcggtctcccttgccggggtgctggtgacacagcggctgcacctgtcagaacacgccagggtggagacaggagatctgtgtgcttcccgagtacagatcacggctcagcatctcatgggaaagggacagggctctcttcaggacacgcagtaagatttcaagtgcgggcacttttaatactccgcgatccaaaggcagctccagggccagccgcggtttccggcctcaagggcaggctcggttctggagctccctccagtggccgtcggggtgccgtcactttcagggccccaccaggagagcaggggccccgccgaggaccagagcgcctggaccagagggagccctgcgcggccggcacggatgcctctcaataggcggcatggggccgacacgactcggtgagttcccgccacggctttcgccggcagccggcggctggaggacaaggagaatgcgccggttctgttcctggacaagctccatggcgctgcggggtcccggcccagaaagcccaccctcccccagaatttccccaggcccacagaaggggaccggaatgggaaaaataccgacaaacgcagcaacggtgcggccgtaggtgtctgcgcatccggcggggctcctacgggacccccacgccgcctggacgccgcctagcagatttggggccaggctaattggggcccatcgtggcccacagatgccagctccgggccatgctgagggacaggggagcggaggatactgcctgtttcccggcggggggccctgctcaacagcctttcccttccctacaaactgtcccaggatcccgggccattccttccagtaagttgggaagtccaggaccagacctcaacgtggaaaaagctggaggagagaaggggggacgaggggttctacctgccctctacctacctgccctcctacctgtctgtccacgggatgcccagaggctcccagaccaccagccccagacccttggtactgcgtccccagctgtctgccaggggcctgctggggaggccgatgcccatccctaagcctgagcctccagcccggcacgagggaaggccccacatgccccaaaggagagggttcggggcacaatcttcacaaaggctggagtgcaccccagaggtgagggtttggggcacagtctgttggcggaggcaggagtacaccccagaggtgagggtttggggcacagtctgttggcggaggctggagtgcacccagaggtgagggtttggggcacagtctgttggcggaggctggagtgcacccagaggtgagggtttggggcacagtctgttggcggaggctggagtacaccccagaggtgaggatttggggcagtctattggcagaagctggagtacatcccagaggtgagggtttggggcacagtctgttggcggaggcaggagtacaccccagaggtgtgggtttggggcacagtctgttggtggaggctggagtgcacccagaggtgagggtttggggcacaatcttcacacaggctggagtgcaccccagaagtgagggtttggggcacagtctgttggtggaggctggagtacacccagaggtgcgggtttggggcacagtctgttggaggctggaatacacccagaggtgagggtttggggcacagttttcacacaggctgcagtgcaccccagaggtgagggtttggggcacagtcttcacacaggctggagtgcaccccagaggtgagggtttggggcacagtctgttggtggaggctggagtacatccagaggtgcgggtttggggcacagtctgttggaggctggaatacacccagaggtgagggtttggggcacagtcttcacacaggctgcagtgcaccccagaggtgagggtttggggcacagtcttcacacaggctggagtgcaccccagaggtgagggtttggggcacagtctgttggtggaggctggagtacatccagaggtgcgggtttggggcacagtctgttggaggctggaatacacccagaggtgagggtttggggcacagtcttcacacaggctggagtgcatcccagaggtgagggtttggggcacagtcttcacacaggctggagtgcaccccagaggtgagggtttggggcacagtcttcacacaggctggagtgcaccccagaggtgagggtttggggcacagtcttcacacaggctggagtgcaccccagaggtgagggtttggggcacagttttcacacaggctggagtgcacaccagggaggcttcccgcctctggcagaatcaccgccatgctcagtcacaaacccagagctgcgtttggacgctgcagcacacgctgcggccccagcaacggtcctgcgcaccaggctcctctcccagtaaggtccgcttctctgtggagctcaggggtccctgcagtgcccaccttagcagagggcaaagccttgagacacggatgctttgtcctcaggtctccactggctcctcagaacagggcccctcagcgctgcagtgtgtcacatgtccccagtttcccctcgtggtgctcacgccacacccctggcacggaggctggaacccaggtgtcagtcctggctctgaccatgaccttggacaaaccacccctcagacctagagccctcatgcacatccccatggtcactgccacccggcagggagcaggacagccccgggggtctgtgactgtccccgggacatcagtctgagaaacagcgctgagttggacgctgcctggtgtggacactcgccctccacagtcacacaaactcggctttgcaaaatcagttctcagtgaaggaaataatgtacacagtggtccacttccaagacacagtgtcttgcttgcttaggtcagcaagctacagaagaccaggcccctgcctgggttgccgatgcctgcttgtcggcctccccatccccagtcttccccccaacgcttagttgccttcacctgacccaaaaacttttagtctatgacgaaagttttactcgtctgcaacatagcttgttttgtctgttcttatcagtctgcccagctacttaggtcataagtcaaatacctgaaaagcccctgagctgactaggattgcaacgcattgtgggctgcaacaaaatgcagcaggacaaccctaaaaaaacacctacagcccctgcccgacaaccaataggtgatgtccgggaagactgtgaccccagagtactcagcctgtgaggaaccgggggaggggcctgcgtactgggggataaatggcttgttgtgaccgtgctgggtgtgcctgcccaccagacacccgatcttgcaagaccgtcattaaaagtctcacgtttaggccgggcgcggtggctcatgcctgtaatcccagcactttgggaggccgaggcgggcggatcacctgaggtctggagttcgagaccagctttaccacatggagaaaccccgtctgtactaaaaatacaaaattagctgggcgtggtggcacatgcctgtaatcccagctacgaagaaggctgaggcaggagaatcgcttgaacctgggaggcagaggttgcggtgagccaagattgcgccactgcactccagcctgggcgacagagcgaaactccgtctcaaaaaacaataaatagctctccctctcccctctcccctctcccctctcccctctccccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaaccttggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagcgcctctgcccggcgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggggtcagccccccgcccggccagccgccccatccgggagggaggtggggggtcagccccccgcctggccagccgtgccgtccgggagggaggtgggggggtcagccccccgcccggccagccgccccgtccgggaggtgaggggcgcctctgcccggccgcccctactgggaagtgaggagcccctctgcccggccagcacacatgcacgcacatacgcacacgggcacacgaatgcacgcgcacacatgcacacatgcatacacatacaccacgtgcacagggacacacgcacacacgtgcacacacgcaaacacgcacacacggacacgcacacacatgcacacatgcatgcacacacgcacacaacacgcacacggacacacatgcacacacatgcacgcacatacgcacacgtgcacgatacacatgcacacgcgagcacatgaacacgcacacgcgcacacatgcacgcacatatgcacacaacgcacgcagacatacacatgcacacgcacgcacacggacacgcacgtgcacacatgcacacacatccacacgtgcacacatatacacacaacgcgtgcacacggacatgcacacgggtgcgcacacgtgcacatgcacacacgtgcacacacatgcacgcacacacacagcacgcacagacacgcacacatgcacacacacacagcacagacacgcacacgggcacatgcacacgggcacacacacacgtgcacacgcacatgcacacacatgcacacacatgtacatgcagccccgaggcagtgccaccggagccagcctcatggagtagcctcctccagggtaacaggagccatgggggggccatgagactggattccactcatagaggccccgcacgcggctgttcaagcaaagccacactgacatttctggtatcaaatttaagtcaatcttttaatgaccctcccgcacgtcagcagcagatcaggtgcaatggcaagaaaagcaagcgagaaacagctgtacaacaacataggcttaaaaattctttttgaaagaaactttaataaacgatgcattggtgagtggtgaaaccggaaggtgctgtggccccgggctctgtggcactagcactggtagtctcaggtgcgctgagaggaccagagctccttggagaaaagctgatgtgaggtgggcctgggcactggtgggggcagctggggggctcccactggccacacaatacattaaaaaccacaaaaactgatgagtccacagcgacactccaaaaagcaggcaggagagggaggaaaggggagagggaggagaagtaccactgtgagtcttcatagaagccactgtttccacagaccctgggcaggaacaggttcaggagacgcaaaggcaccgggtgggaggggtcaggagggcaccgtcgccacaggacgcattgccagggaagtcctatgatgcacgcccacctcagtcaagtgaccacattcggtgtcaccagcatgggacaaggtggaatggcatgcctgcgggcgacaccacatacaacaggcagccttgcccctgtgggactcacccacctgagcggagccagcctaggacaccttagaaggagggcttcggcacccaagactgcacccccaggcccaggccgcacggccgcagcacaggctctgcacctggtcggcacacgtggggaggctgcaggacagagccaagcagctccgggcaagtggcacccaacagtcacccagccacacaggggaagagcggggaggggcccagcgctcaggatggaagagccctgggcaaggcatccatagacaccttagactctggcctaagcggggatccaagatggccttccgatacccagaccctcccatgcacacagagtgcccccacctccccatggtcctggagccgtaagcatcctggctgcccacggtcagcacacactgacccgcccacggtgcctctgctgcccttcttctctcgccactccccatctgcagcccgtgtgctgaggagggcacggaaaacgtccaaagcacgcacgactgcagcgaagctcatgaatgcccctgcacacacgcagtggggcagacaccggttggccctgccaggccctgcacactcacgggaccacgactgctcctcggatttccagggtcaaatggggtccagtcaaggaagggctgtgcgttctgcttctgcgcttaggcatatgattaaacacatttcataattagatatgatcattgcatctgagacacagagctttccaaaacggtctgtgggctgaagttactgcttccctaaacgtctgaggggcaacaccagtgccgccagctaggcctgcagccctccttgtagaaaggctttaattatggagtcaatttcttttctttcctttttttttttttttttttttttgagatggagtctcgctccatcgtgcccaggctagagtgcagtggcgcaatctcagctcactgcaacctccgccccctgggtgcaggtgattctcctgcctcagcctcccaagtagctaggattacaggcgtgcgccaccacgcctggctaatttttgtatttttagtagagatgggatttcaccatgttggccaggctggtcttgaactcctggcctcaagtgagccaccgcgcctggcctggagtcaatttctttaatcgttacaggactgacagagccttcaaaagttcttcttgggtcagtatggtaatctgtatcttaaaacaatgtgcccagtattggcataaagttgttacaacgttcccttactgtcattctgttgtctctagaaggatctgaaaatgtcctaggcccaccgaccaaaaccaggtcctgaaaaccaggactggcagcaggagaggaaggcgctcctctggcctctttctcacccactctgcagcttcacacacaggaacaccttacaccctccttcggtgtgaatttcaaaatacatacaatgaccagagggcagcggaagggaagggcagagagctttcaagcaacactgccctccctcctcacctcctcaccgcattccactcccgtttcggagacaagtggccggcagctactccccgcgcaggcagctcctccggcgccccagctgagctcccgccgcccctcaggctctgcttcccaccccctaatcccgctggaatctgccacagcatcgacctgctgctcctcaacatcgtagagctttcttactttctcacaactccttgagacactttttttactgtggtttccttccccagcccatatttggttctcatgaaaacagaagctccgtggagaaagcgaagaaagtccttgaaagtcgcctgttcaaagccgccactgccgtgatgccccctgactccgcaccccgccgccgtgacgccccccacgaccccgcaccctgctgcagtgacgcccccgacccctcaccccgctgccgtcacacaccccgaccccgctgccgtcactccccacgaccccccaccccgctgccgtcacgctccgtgacccccgaccccgacaccctgctgccgtgatgttcccccaaccctgcaccccgctgccgtgacgcccgccccgaccccgcaccccgctgctgtcacgcccccgaccccgcaccccgccgccgtcacgcccgacccctcaccccgctactgtgacgccccccgacccctcaccccgctgccgtcacacaccccgaccccgctgccgtcactcccaaccccccaccccgctgccgtcacgctccgtgacccccgaccccgacaccctgctgccgtgatgttcccccaaccctgcaccccgctgccgtgacgcccgccccgaccccgcaccccgctgccgtcacgcccccgaccccgcaccccgccgccgtcacgcccgacctctcaccccgctactgtgacgccccccgaccccgcaccccgccgccgtcactcccccgaccccgcaccccgctgccgtgacaccccccggcccccatcccgctgccatcacgcctcccggcccccgcacccttgtctgtgtcccacagcacaggacctgtcagcgagcgtctggcgccttcctccctcccctgcagagacccgccaggcccctccaacaggtgctttctaaactgcaatttcctcatctacaaaaggacaatcacaacaacggaacccaggggacaggactgcatcaactacaaccagacggcgtagacggcagcacacggccctcggcaaatcagaggtgctcagtgaccacagccaccatgacagcagggcggggcggggggcaaggaagcagcgctgggagacttggagacaccccaaaaaacgccttcctcagaaacactgctgtgcaagaacctgcaaatccctaaggcgtctgtgtccgatggccccggccccatgctctgaggtcgcgcaggtgtccaaggccaggaggggcaccgaggagacgaagaagaaacagcacagcagctggggaggtgaggcccgcgcctgggatgtcatgcagcctgccgagcagccgctcgagggacccgcccatgtgtcatcagctctggccttcctcctctcacagatcagagagcagagggcaaggtgggcagagcccagggtgggtgcagggctgagcgcaggacagacgtccctccagcctggtggctgccccgtgtggtgagcgggaggacgtgtgagctggggggctcctccttgtgactgcagatgtgtgggccatgggagggcgcagaatggaccaagaaccgaaaggtctgtgcaggggccctgcagcatcccaggagcagccttgccgccacctccatccaacacaacccgtcctctggcctcactgaattctcctgaggaccaaacacgggaggggtgtggttcctaggccatctgagcaatgacaagctagacgggtggttagaaacagccattttaggccaggggcggtggctcacgcctgtaatctcagcacttaggaaggccaaggtgggcggatcacaaggtaggagattgagaccagcctcttcaacatggtaaaatcctgtctctactaaacatacaaaaattagccggggaaaaatacaaaaattacaggcaggcgcctgtaatcccagctactggggaggctgaggcaggagaatcgcttgaactggggaggcagaggttgcagtgagccgagatcgcaccactgcactccaacctgggtgacacagctagattctgtctcaaaaaaaaaattaaaaaaaaaggaaaagaaacaaccgttttagggctcttgaagctgaccaaggccgcacaacaaatcgggtcacttttttttttttttttgagacagagtaggagtcttgctctgtcacccaggctggagtgcagtggcgcaatctcagctcactgcaagctccgcctcctgggttcacgccattgtccggcctcagcctcccgagtagctgggactacaggtgcccgccaccactcccagctaattttttgtatttttagtagagatggggtttcaccgtggtctcgatctcctgacctcgtgatccgcccacctcagcctcccaaagttctgggattacaggcatgagccagcgcgcccagcccgggtcacatttattaaaaaaaaaaaccctcctgacctcaggtaggaacagcagagtctgagtcaccaaagcccggggctgccactctccagggcgccccactcccagctccagcggctgagtccaccaagccaggacaggcccaaggaccagagggcgaggtgattcacagtggagctcggaaagacccatccatgcccagcgccttgtcaaaaaccacaggggtcttggtgacaagcaattgagggaggccaacatggcagagccagggctgcaaaatcggctggaataagcatcagacctgctagaagggtaagaagagcagtgcagtgtggtacatgccagggaggagcatcgccagggaggagcaccatgagggaggagcaccaccagggagaggcaggccagggaggagcaccgccaaggaggagcaggccagggaggagcaccaccagataggctgcaaggagcaccctttcctgagcctgcatgctgctccgcaggaggctggggagcacctccctcccaggcatgggctctggggaggagttcccctgtggcaccggtggtttcccatggatgtgccacgctggttttcggagcctgcaggcggactgggcaccgtgtaaagaggcccgagagggttcccctaacacaggcaagcgtcatgcacagggcacaagcaccggggagggatgtaagaaaggtctatgctttcagtttccaacagggctggccctgggaaaagccgcagagggaagctggctctgaattaatgtccaagatcttttcctccacttggcagggctctctcccttcagggaccggtggccttggccaggactcttcccagcccagcgccacagccttctcgggaaagccgggggaggagagcatggggacttgcacgccttgcctggctggggagaggacctgccttctagccacacttcctgcacagcccacgcccaacccctgggtgacgctcctggcacaggcttacggggtggtcagcgaggggctggcccctgctctgcagccaagactcaggttacccagtgtccagtccggagctcctgctgttctgggtaccctgctgttgcgggcagagggccgagacccccggcctgggccagatgccaatgctggctcttagctcgagactgtacgacagggtccgaggaaggcgctcttgggcttacaaaggcctgagcacttttccctggtattcttgggggctttcaggtcctatttttatttatttttatttttttgagatggagtctctctctgtcgcccaggctggagtgcagtggtgccatctaggctcaccgcaagctccgcctcccgggttcacaccattctcctgcctcagcctcccaagtagctgggactacaggcttccaccaccaagcctggctaattttttgtatttttagcagagatggggtttcaccgtgttagccaggatggtctctatctcctgaccttgtgatccgcccgcctcggcctcccagagtgctgggattacaggcgtgagccactgcacctggcctcaggtcctatttgaagttgctctggtcctcccagagtgctgggattacaggcgtgagccaccgcgcccggccccaggtcctatttgaagttgctctggcagggctgctttctgaacgtgcaagccctcaggtgccccgtgcacaggcacacaccaccttttccctctgcagtactaagctggctgcctcctaccagggctagtttgaattttcctaggtcacacgggcaagccagacgctgcttacgtgcattgagtgtggtgtgagcggcttcagaccagattcctgtcttctttacacaactctaggttttctgtgcctgttttcggtgagcacagaacaactgaaggaagcgcgggacagacacaagggcgggcctcggtgccacggctggccttgggcagagggaaatgctttgtgtactttctctgggaagcagcagccccagcgcggcctcggcgtcctctgccgccaactgctccgtgaccgctgggcgtgtgtgcggggacatgggagcaacttcacagtggtgggaagtttctctcctaaaacgaaagcttctctatactacagattggccccattaaataaaagaaaatacggtgtatttttacagcgtttgggattggaaatgactgagattcacggtggctctagtcctgtctcctgaagacggagctggacgaggtctgcggacagtcagaaaacacgtcagggttttggctcagctgccagatatgcagctatggtgggatttctgcggcagggcaaggaagtggagacagttcgcgtggcagagcacagcgggtgccctatagtgggcacgcctggagagcgtatattttcacagggcccgaaacctgaatggaggattctttccaccagctgcggggtgggggggggctcaggcacatcagttttcccacccagaagacgaaggcctgcgaagggggccccatgaggcctgggaagggggccccgtgagacctggggttaaatcttccacagcaagcagggaccccagccaggctctgcacaaggcaggcgctgcgctcaggtgggagtcctgtgagatgctcctgcaccccacactcccgtgaccacaggcgaggcctaacgccccccacgccggttcatctcgtctcctcaaactcccaccaagatgctcacgacagggcccaaatgcactcccggggggttggctagtctgcaggatcacaggctggcccagtgaaaacctgggcttcgctgccttacaaccatgcagaactcatagccaggccatgtgcccacctgcccactgggaccccgggacagtgcctgctccagacagaggctgggagctctgtgaggggcacatggagtgaagcagagcctgcggctcacctgtttggctctggctggccaggtgccccctcaagccccagctcagccttcccccaaacactcagctccatcccccaccccagcgggtcagggctccatcaagactgctggtgaatggccggctgaggaggcagcgaggcagcgggtcagggctctgtcaagactgctggtgaatggccggctgaggaggcagcgaggcagcgggtcagggctctgtcaagactgctggtgaatggccggctgaggaggcagcgaggcctttggagagggagggccagggtcacaagaccagcagggcacaaaggtggctacgggaggagcaggaagtcaacagccgcaaacaaacctcccaagccactcgaagctgacatccgcaggccacagggacacacctgaggctgcggaggggcggccacagaccttcacagccatcctgggtccccaggcaggcaacgcccggctgctcgtctgctgtccacctccctatggggacacctcaaatcacacgagaattgtgacctcaaaagcttatgctgcttttgcacagaaacagtgacgtgtgaaccatcctgggatggtatgaaagacaagcgcaggtctggaaaagcagttcagaagccactcaactgtctacgctggggagacggtttcgtgagctaccaccacagcctataactacttatccattaaaaatgataataaaacccaggaagaggccgggaaaacattcaataaaccagcgtgctgagggaatctgcacaacccccctccctgcccaatgtagacgtgtgacgggaagtggcaggggcagcagctcctctgaggggccccgtggcaggcaggccctggcgggggctgggagggctcaggggcaggggtgactcccagatgccctccagagggtccagggccctgcaggagccaccagccctcaccactggagtccccggcctcccagctctggggaagcagccctggagaagtggcgcccatgctttctagaacctctctgaagggttgtttaagcagcgagggcccatgctgccgtcaagaacacacaattctcaaggtcccggctttggggagttcccccaggccccgaacctgaccttggcagcccctctgcgtggctcaggaacgagtcccacaagcccctggctcttggccggaaaccggccaccaaaacagactgtgaagggccaacccctcctcccagggaattccagggctcagtaggaccctttgctttccctggggttagaaggacaggtgctggcagaaacgcaaaacagagtggccactttggcagctttgtatgaagctaaatgtgcacacactgtaagaaccagcgatgcccaatcctagcgatccacccaaaataaaattacgctcacatgaaaccctgtatgtgaacatttaaagcagctttataatagacacaatctggaaagaactcaaatgtcgctcccacgatggcgggacacagaccgcggcacagccccccgtgctcagtggcgagcagccacggccacctggtgtgcacgacgtgacacaccatctcaagcgcaggaggcacggggacagccaggctcggaggctgcacacgcacaggtgccacccgcgtgacggtccggggagtctgatcacgggagcagagtgcagccgcacggccgccaggttgggtggagggaggggctgaccacccagggacgggcagaggagtctggaacaggacggtttgtgcgctgcctgcgagcaccgtgcttccacgactagatgcctctgtggtgaaagccaaaaggagtattttactgcacacaaattctcagaaatgatcatctgaaaactacaggttctcggctaaggcacccaggctcagactgccgacacatcgttaagcagctgggtaccagcagcaatgacctcatccctctgactccgtgacctcggctgcagagggtcacggcgaattatatacacagtgccacgcacatgggaagctctcagtgagagagggtgggctgagagccgcttggcctgggccctgcacctcgtcccactctgcatgaactgcctttgcgggtaaggtcggggagaaggtgccaggctgtcaaggcccagggtgcagggggccaggtgggaagaacaggaaggccggccgagctggagcctgcacggccctgcatttgttactctgcctcttagactatgcagtggtagcagtggaggagggggagcacgccccccacccggcagcccagcaaggctgcaacctgcagctcccaaagggcttggtccctccccgcgtgccgtcatccagggccaccagggccggggacggtgccgggcagtgccgctgggagacgggcttggtgcctaggccgggtgggggtgagctaagcacacccagccccgctccaccagactgaccttgccaggctgggatttgagagggcttcggggataactgtgaggaccccctctcctaagacccccaagtcagggggccatgaaaggtgggggaaggggaacctgtctgggaccactcagaattcttccctttccttgtagagcccgagcccgggcagaagaaccagaacaaaacctaagtacaaacacggcgggctcgagcggggcttggcacggcgcaggggtggcggcaagggggcagcctggactggagccagaaagcctgtgctggcatccgccacgcggacggggaagctgagacccagggctcaggtcacgcttacgtcgtttggtagccaggtaccaggacctcatgccatacacagcacacaggctgtggagctggagccagtcgaggaacctggaagccccgacccagacaaggcgcagcctgggggagggacagggaggcctctcgaacccatggctttcttctgcccactgcagcctgggggagggacagggaggcctctcgaacccatggctttcttctgcctgcacaggggcccctcctgtccacgataaaagcccagtaataaggagaaagcagtcagcagccttcacctcagctccagactccgttctcggggccaagttcaggtgtgtgcctgtccccccacccaccaggtggccaggcctggctatgaccgcacgggagagcagggcggaccccgcgaacggggacagcacctgacggcgacatccacaaacgccgccccgcaggagcacgcactcccacacaaagcgcctgcagctgacagccgccgggaggggacatctggacagcctcacgcagctttcagacctgcagtccatgttaaaaggatcttgtttccaatttgccttaattaaacaaacattccaaaccacttcctctcagtctgaccattgttcttcattccatggtactcggagtcctgggaaccactcatcactgtcgggtgcaggtggacgtcccctcacggtaaggtcagagtgctcccgcccagcgcgtggctccgcggcgccctgtgtgcctggggggtgagagagggtggcgggggcgaggtgcttgtgaggcacatcacaatggggcccgagggcgctgcgtgcacaggactctacagcacagtcttcatgggccgttggtctgagttactcagagcaggggatgatccatccccacttaaagacaaagtgaatggggttaaacaggtgctgtgagtggctgggacgggctcacaggaggaggggccagcatgggccacgcaccacactctcacccaagacccaaagccggccaggccaccgatgggcagagatgactgcagcttccagaatagtgggcttcatggggtgggcatcccaaagcatatcacagcccctggggggcagggcaggtgctgcatgatcctggtcctgtgtccagctcctgccactgccccatctcgtaaccctctggacacagagaacgcagagaacaggcagtgttccatgttcccaccaaggggaagatccagcgcccgcagagaactaaggaagcaccggggagtgtggtgctactgaagagaggatgcgtcatttgcatttatccaaagaaagggttcacgatgtcttacgttcaaacagataaaatcagactgaggtggggtgggaggagcctccccgaggctccttgaggaactgcctggcagtgaccgaggtggggctgggacaatgcccaggtgctggcctctcctcggatattccgccatgtgctcctgggggcggagggtcccccaagggcagagctcagccagcaccaccctgcccactcttctgtaaagtgcccctggcacgacgctcccagagaacccaaggatgcgcccagaatgctcccagcaaccactgagggggccctgctgggagacccgcaaaactgccaatgccttgtaggccagcagccgcacgcgccttcagtgctggagtcacgcccaggggctgacgggccagatggtctctgagtgcagcaaattccgtcttgtgagggaaagtgatagaagatgagagtgtgggccgggcgcggtggctcaagcctgtaatcccagcactttgggagggtgaggcgggtggatcacgaggtcaggagatcgagaccatcctggctaacacagtaaaaccccatctctactaaaaaaaaatacaaaaaattagccgggcctggtggcagacgcctgtagtcccagctactcgggaggctgaggcaggagaacggtgtgaacccgggaggtggagcttgcagtgagtggagttcgcaccactgcactccagcctgggcgacagagcaagactccatctcaaaaaaaaaacaaaaaaaacaaaaaaaaacacgagagtgtggaggcgcagacgacgggagcacctgagcttccgtgctcagcatgctgtggtcaactgtggtctgcacacacccaccgttaactgggccctccagctgcagacaccaaacagggacaggacggcggcaccgacgcgcccacgtccaccagtgccaggcgacacagcagaaaaccaggatgccctgcccctcaccgcactgtttccgggctcggcaggcacacaccctgaatgaaaggctccaacctggcgcggagccacggcctgcgtgcttctgaaggaacaagagagacgaagtcactgtgggccgcaccacgtcctgacagcagctaacctccccaggccggaatggaacagatggaagacatggcaagtctgtctgaggggaggtcacaggatgtccctaaagtcaggatatggcacggaatgcagaaattggagcagagttccaaccccgcctgccactggtgcggcaaaacccgcacaccccacacacagcttccttgggacctgggctctttctataaaggggctgctggtgcatgtctccttaatgctccaggcctgtgaggatcggatgcccgagggtgctcctgcatgtcacgcggaggcgggggacgccagcgatgccctcccgggggcgtgggaaggggctctcggcctcccttgactctccatcatcagagaatgtgtccgcctggcatgtgagacacggcgcacttctccgaacctcgggctgtcttccagcatgtgttagctctagaattccttctgcacacagcttgatgtctcccctgtaaggtggatccggcgcgtggtactgtgagcacctccaaccaactgctccctcccttgtgcctatgggggagaagcgaatgagccaggactgggctaatctcaggcagtgccgccccacccttgcccctggtggaccgctccccttgaaaaggagcagcagttggtgggaagggaagcctcactccgcccagcagagacaaggggtgtgtgggatctcacagaaccgtgtagacccacgcacccccactgtacagatgggcactgaggctcaggaaggttagagacgttgcccggtatcacacagcacgtggggtgaggaagtggaacccgggctggagccggcaacgctgaaaaccagggttgtttggacggcgacatgcaactccctgagggctctgctcctgcagaatcagggggacccatgctgctgcctaccatggagggcatgggagaggactggggatgggacagggagcaggaaggggttgctcagtcagtcagtgctggcagagggaggggcgctgggaaggcactgcaggccctgtgtctggggcctctcagcacaaggactgggctttgcacgcgaggactgaagggtcaaaggcgagggccaaggtttcctacgtggcattcactcgggagggctcctgaagctggagacacactgccttactttgtgcgtgtttttctctatgcattatccagtatttggctatgtgtgcatttagctcaataagcaatgatcagatgaaattccccttgaagttctttccttttattctatcctggggatgaacagaaaaatattttcacttcttaaaaattcataacgacatcagatccaacaaggaaatcagtgcctgaaaagatgactattgacccaggacgcctctggtgtacaggccgagaccatgtgctcagagtcagccggcccctcccagatctgctcctggccagctgtgaggccgcggtgacaccacctccctgcagtcagtttctgcaaccatgagacggggagaaggacagccctgcctcacaggctctgaaggagggtgacctaagatcaagcacgcagagcaccgcacagcgcccagcatgcatgtgtacaatgtcacattctacactgaaggaggctgagacaggaggatctcttgagcccaggagttcaagaccagccttggcaatacagtgagaccttatctctacaaaaaaattaaaaaaaaaaaaaaaattagcggctcgcatctgtagtcccagctactcaggggccggggtgggaggatggcttgagcctgggaggtggaggctgcagtgagctgagatcaggccactgcacactggcctgggcaacagagcaaaatcctgtctcaaaaaaaaaaaaagatttaaaaatcggcaaaaggtctctatgccttacaaatagtccacgagattcctgccatgccgtcacacatcaagtattaagtaggtcttggagacggaagttcctgcagtccgggccctgtctcttacatcagtagctgtacagtacaagttacttacccgcccagtgcccacaggagaaggctgcgctccaagacccagatgccccgatccgctgactctatgctgcaagcaggaaatctaggagtatcggccactcgcccgcccagggcaggctccccaggaaacccagggcacgtgagtggagagcttgggagctgagctcttcctcagccgctgggatgggcagagagaccagaagccatgggtttgcactagcagggtgcagctatttttaagtgacatgtctcagctatttcaaggtttgaatttttattttacttatttttttctgtactttctcatgactcacatctttcaaaattgtgtctcaggcatttttaatgctgaaatcatctcaacttcacagctggtcaaaaaatgtctaagagcaaatcagctctttatcatccaaatacaaaaaggtacatattagagttgtcaactttctactgctggaagaaaactccacgttagtatttttccattaaaaaattaacacagcattctgtttaggaaatgtgtgtatatttcctaaaatacacatctgaaagactttaaattgctattgcacagatgccttgagccccagcaggtcccgaggggccgagtgcccctggaggcccagcaccccactcttgcacctgcaccagctctcctggcggggagcaggtcccgaggggccgagtgcacctggaggcccagcaccccagtcctctgcctgcaccagctctcctgggggggagggggaaggggggagcccacgcaggtctctgaaccacgcctcaggctgcagcagccgcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtaagttccgacgcttctgcagcgagcgcgggaggagggacctgaggcaccgctaacactcagagaaaactaccggctgagggtccctggtctgaatgcttgggaccggaagagtttcggagttcagatttttgcagattttggaatatctgcaggtacagaatgagaaagctaaatacgaaattcatttgtgtttcatacacaccttatacacactgcctgaaggcaactttataaaaacacttttaacaatttcatgcataaaacaaactttgaactgcctggactgcagcccgccacacgaggtcaggtgtggaattttccacttgtgtcacgacgctccaacagtgtcggactgtggggcactctggatttcagatttccagatgcttaaccagtactcagattcctaagttacttgtcagaaatgcctatttcttgggattacacttctctctgcaaatgtctgtgaaattcctgttaaattctttatggatcatgcacatgctactaagttaattatgaaatttagtgtttaacgcaggtcagttgcaaaaacaagaatattgcttgcttcaacccaggaggacaggttattgcctaaaagatacacaacacctagtatgatgccttcaaacttaaagaaaggtttgtatctgtgggtgaagaaaagcagttaaaccagaaacttccacaaaaacaagtctagtagaactgagctgattgccaaagtgtgggagaaaaagggccagcaaaaaaatggttaacactagccttctgaggaggccgcccagagcctggccagagaggagccagagaggagcggggcggagggggcctataaagccctgtgccaaggggcagactcactggctcagagggaggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtaggactcagcctcggcctggcggtgccataccactgactaggggagcgggtgggtggtgccacccaggccgctgtcctgttatgggaacagctgaacacagaccagacacctcaccccctggtgagagcagcacccagcttcccaaactcaaggcacagacccctctcccccggagctccggtggtctcagcgtgaccgcagcaggggctttgcctggacggcctttctaactcgtgctgaaagcaggacccagtattccgtcacgttctgtcccagcaagaacgtgtctcacttcaagaaaatgagggtgcccactctgccctgccctgcggtgccccagtcactctcaccaaccctgaagccctgggagggccacacgccttttgacagatgcagacttaatacagctgactaaagtgtggctttatttctctatgacaagcagaggaaatctgaaatgaggtattgcactgtttataactccatggccacctccagtgaggacgtggggccagtggtgaatggcacactaggttcctctcacccaggaccacatcagacactaggacacatcagacaccaggtcccgtatcttctcggtgtctggcaacgatcaaaagactcaatttacatgggaaagaaatgaatgactcgtttttaaactatttttcccttggagttcatttaacaaaattaggaaagaaaataaacgttaagttgagggttctgcccacctttaaacttcctgccacgccacggtctaatacgttccaaaatttctacatttaaagagcaaaacaagtcctctgtgccgtttttaagaaattaaatacagaggcgaaatgcggagtctttcaaccttcccgacagagcctgagagcagaggcatttatgctgttcaatggtattatctactaaagatgaatcaagagtgcaaaataaccaaaatcaaattcaccagccccagctaagtgaaggttattcagtacttttagaataactgacacagaggcagtgattcatcttgtcttccccacccgcctgtttttgagatggggcctcactgcagtagctcaggctcgagtgcagtggtgtgatctcggctgaggctcgagtgcagtggtgtgatctcggctgaggctcgagtgcagtggtgtgatcttggctcactgcaacctctacctgccaggctcaggcgatcctcctgcctcagcctcccgagtagctgggactacaggcgcacaccactatgcccagctactttttttgtctttttttagtagagacagggtttcgccatgttacccaggctggtctcgaactcctgaacttgagcaatcctcccacctcatcttcctgaagtgctgggattataggccagccttttttttttttttttttttaagtaagtattttcaagcaataggtcaacaaatctctagtctggttttgcagcacttcaaaacaataacccctggcccggcgcggtggatcacacctgtaatcccagcaccgtgggaggccaaggcgggcagatcactacaggtcagaagttcgatacaagcctgggcaacatggtaaaaccccatctctactaaaaatataaaacattagccaggcgtggtggtgcacacctataatcccagatactcaggaggctgaggcaggagaaccactctaacccgggaggcggcagttgcagtgagccgagattgtgccactgcactccaacctgggtgaccaaaaaaaaaaaacattcaaaacaataactcctaatgatttcaaaaggtaaaatgaaaattcccaaaggaaaaacaactcaaacccattttgaagtgttagtttactccagggcaccagcaccatctgggccaggtaattctctgctgggcttgggcacctgtcctaggcactgtagggagctgagcggcagccctggccccaccagcacccccctgtgactgcccccgcatccccagagactgccagtgtctgcaggctgagacccccgtggcccgctgcatagagaacttccaggagcacagtgacacggggcaggtgacgggaccctccccactggcggcagagccggggtgacacggggcaggtgacaggacctccccactcgcagcagggccagggtgacacggggtgggtgatgggaccctccccactggcggcagagccggggtgacacagggcaggtgatgggaccctacccactggcggcagagccggggtgacacggggcgggtgacgggacctctccactggcggcagagccagggtgacacggggtgggtgacgggaccctccccactggcggcagagcccgggcaccgccgtgggcggacagcccacttctccctctctgcagaggataagctcgggagggactctctccctggagtttcttcctaggttacaaacagcattgcaaaaacatattaggttttacaataatttgttaaaacatgaaataaaaacgtacatattatttcccaaaacaatgacccctttcactctatattacgaaaataagtttatttttggtacctagaacacagaactagcatgaggaaaccgctgaacttctgttttatcgtaagagaagattctgctctgatgtccagctttctggacccactctctctctctcagaaacactggctttcccttcctatcttacttctccatcagctgctgaaatgcattttcccctctcctcacaaatgccgttgtcctggggcggccgtgcccataccttcattgcttcctgggcctgctctgtggctataaagggaaaaacacccctgcctgtgggagtgactcacgtccagcctccagctgcagctgagcagccgtgggacctgcaggaaagaaggccatgtacttcccacaggcgactcttccacctcagctcaaccacagccacctcccgagctcataaagctgaggttctggccctccccagtgctcctgacacacccagactctacagacacccggccaggggagccaggccttgtcccaaagctggggccactcgatgagacttcatcctctcctgttgcttctccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttccggaggctctgtcttgggggtctgccaagtggggtgggacgtggggtgggcatggggcactcgggagaatccctcccccctcacagaaaacacagccctcccctgccaccctgaaaactctcacaaggccagcctctgagtccggccagccggacctaacctggcatttccaggctgtccaaaatgccgtgggggcacttctgtgtcatgcttgggtgccatgacaagcttcccatgaatgtaggaggcagggctcagccttgtccagcagcctgtgcgacctaagctgcctttctagaaggctctcggccgcgtgcgaggcccaagagctctgcggcacccaagcgctcctggagcagccggccgggaaggttcctgctccttctcccatcaccggggctggatcctggcgctgctcccctcctttcccgcctcacccacctggcagcagctgtccctgatgttaacaaggtgcacctgaaccagtgcctgcttctccgtcttcacagaaacctgcgcagggcgtcgggatgtgtgggtgaagggaactagccacctgtactaccccctcacttttcctgtgtttgcggttctggtctgtttaaaagctatgatactgttttttatttgtgataacataaagtttgatatgcaaacatattgaaaggaaaaggccaattaaagaaaacatctgcaaaagagcagggggtgaacgggtgcggcacaatgaagactgaacgcagccatgttgagtccaggaaactctctcctcctgtctgtgggacataacacaaccacagtgagtccaggaaactctctcctcccgtccatgggacataacataaccacacatgagcccaggaaactctctctcctcctgtctgtgggacataacacaaccacagtgagcccagtaaaacctctctcctcccgtctgtgggacatgaagctgtgtgtcggtgggtgtgggaagcctgggtctctcaggcaggtggggcctgtattctccatgaccccagcaccgtggtgctgggctcctcaggaacagagcgctgcccagaccgtggcctgcaggagcggcctctgtgcccacttctatcaggattgctttcctcataaatggctcaccgggaagcctgggaacagggcggctcccacacactaacaggtctcgtggaagtggagattgctgtggggtggccaagccagaagccaggctcacgtgtggcacagtcctgcagaacaccgtgcgtggcttgagccacgactcaggcccggcgcacccctccctctgcccttccagagcctgccctgcaagtcaccccagctaaaaggacatggccatcacactgacatccgtgctctggagctccttccaggccccagggacgagacttgccctcctccccagggatgtactcgctcaatgcccaggacagccaggcagcagccccccaaacccccaccccccacacctgggcgctgtctttacaacaatacccaggacagtcacgcagcagcccccaaacccccctccccgacacccgggcactctctttacaagatgcatgcttcaatgaagctccccttttgacctcagtgttgctgatggggaaaaaccatccaagtcccagaaagcaggcggggtgggtgctctaccaccaggcacccaactacctgtcaggcattccccacacacagtcccgttcacatagcttcaacaggggcaagggcagacgctttaaaatacgcagacgagagacccagcatttctgacttccagttctgacgagctgacgtggggagacccacacggaacgtggtctggtccccacccctcacagcagccccgtggggtaagcgctgtccccaccacaccaaggaggcactagaagggtcagtcactgctcgaagccttaaatggtgggtgacacagccaggaattcagccacgctctcctggctcaaagcccacaagctctgtagcactcggcaacccctggcgtctaactggcaaaagcacgccatgcagaaatcatacagggctgggggccatgggcatcgaggggtcacccaaggtcaccagcccaacctcctctaaagcctgctgtgcgggaagtgcagggacggcagcagcggcagcggggagggctcccttaaggtgatctgggtgggaactgcgtctgaacagagccccaggcatcaatcagggacgggactcaactcattcctccacgtcaacccaccacagggaacagtgctgactgtggcgtccttccctccctgccacagacgcggcttccatcctgcccgcaccagacaccgctgttgagtgcgtggaagcgtcacgccgccccactacgccgctcctctccgccaggtctcttctggggacttgcccaaggctctgggcagacagagctgacacgccgccatctagccgccggaagcagactcttgacctgtgaagctggcggcggcactgctctgaggccagtcacacgagcgacaggcacccagcagccaagccaccgggctgcggtaagggcaggtgcaacactgaggtccccacgcagtagagccagccttggaccctgggccctggagtccctgaccctgagatcccagagctgggagctgtaggacagagaccagcaggccgggcagggactccgtgggtgccgccggcgcagccacacacgcccttctcaagcgcttgcctgggagccagggcaaatgtaattgtttttggcaggcccacggtgagataaaatcaaggcgtcttaactgctctgctgtctcctggtaacccaactctcctacatgagtgctttttaaacccagaaagagctcaaaagtacatagctgcaagcatgggaaaaacccccgtgttagcactgaacgtgacctcctcgttctttgtgcttaacaattaactcttgacctcacgagagtgacacggcttacccgcccttcccaggccccgcacctcccactcagtgagaagcggcagcggtgggctcactaatgctcacgcgcccactcacctgcagtcttggggggcagggtgggggagagaactacaaagaaaccttcttaggagggtgtttctgtggcggggtgggaagccattccaaagccgtcctagacaccccgtgaactgggcacatgaggcaatgtgaggaggctcctgaagccggggctctcccagcagaggcgggagacagggcaggcgaggggagcccatgggaacgggtcagggctgaggacaaggcttaacccagacattgaaagtaagaagcagcacacagactacgcgagtacgtttgaacactcacagacacacgctcacatgttccaagctctatctctgcagcccacctgcacagggcctggccccgaacactgccaccctccagaagggcccaggactccgggagaaatggctgatttgggccggggcagggagagacaagatgagcctgggacaggtgattctggttgagacaagaaaggctccaagagcacgtcgggtgacacccaaaggacacggtgtcctcgccaaagctgggacaacgtgagcagtaagatgagtaagaagagacaatcgtgatagaccatgaaaagcaggagtctgcaagtctactccaacaacaaacagacctaatataatttaaataaaatgaaagaatgcatgaatgggaagagtctcgtttctaataaagtgctggctggtaaagtagttggaaaagcatcactctgcacctttcagagggagacgggggcaggtaagagtcacaaatggagggcgaatctcagggggcagtgaggtgcaggggactgcagagcctacctgtcccccacggatggctcattagtgctcggggaaaggtcaccacacagtggagacgggacagcccctcgctgggtgatcacatgggcagcaccaacaaggaggccggtccagatgctacaccctgagaagggtgcgtctcgtgctgtcatctaggaacgcacagcctgagtctcatcaggagggaatgtgagataaacaggaagggaggacggggaaccaggatgcatcaaaaatgtccatgtgacaaaagacaaaggcagagcaatcatcccaaactcagaaggaggaaagagatgtaacaattcgacacaacagggatcctagatgggtgctctaccagaaggaaaagagcgtcgtgaaggattttatggggtcagtcgacaagaatggaataccccgggagataaaagtgctgcctcaaagtccatttcccgagatgggcaacaatgcctcttaggaagcccacactggagtgtgcagagggaaaagacgggactgtgcgagtcacccccaagaggctccgtggcggcaggatgcacacagcaagtggggtgggtgcacagcaaatgcacaggacaaacgttatccactccacgcccatggatcaacctcaaagaaccggaaacatgcatccaagcaagcatttgttcgtgaatgtccacagcagcactgtccacaagaatcaacacgtggaaacaacccagatgtccataagccaatagacggagaaacgaaatcaatctatccaacagtggaatattactctgccatgaaaaggaacaaagcgtggaccacaccacagcatggtggacctggaaatgccacagtcaggaagataaagtcacagtcagggagataaagcagacacgagtggagacgccacgctcggtgagataaagcagacacgagtggagctgccacgctcagtgagataaagcagacacgagtggagctgccacgctcagtgagataaagcagacacgagtggagctgccacgctcggtgagataaagcagacacgagtggagctgccacgcttggtgagataaagcagacacgagcacaatgtccactgcgtgcgtccgccaatgtgaaacgtgcagggcagacaggtccacaggacagaaggctgggaagcggctgccggggctggggtgagcgggggacggggagccactgctgacaggcaatggagtttccctgggggtgaagaaaacgttctaaaattagattgtggcgatggctgcacaagtctgtgactaaaaatcaccgaggtacacacttcagaagagtggatttctgctatgtaaattacatctcagtaaagctgccattgagaccacagtacccattcaagcgccgggctgtgttcctgcagctggccttccttttcagagcctcactgtcacgttcttgcagcggcctccccttccggagcctcgctgtcgcgttcctgcagccggcctccccttccggagcctcgctgtcgcgttcctgcagccggcctccccttccggagcctcgctgtcgcgttcctgcagccggcctccccttccggagcctcgctgtcgcgttcctgcagcggcctccccttccggagcctcgctggtctctgcagaccaattctgtccctctgaagcacaggccaccatcggacagtgctggctaacagccgccctgtgctggtgggccacggggacgccagcccaacactccacacacacttcgttagcagccacaaaacatttcctaagagcggaagggtttccgccatctggaatcctagacgccatccagcatttattgtaaagcttctaattaaagctttctcttctcgctcaccgcctggtaagtcgagctttacttttcttctccacggtgggaaactcattacctggagtgtctttggatgtacttttaaattaaaaatggaggaaaagagcgttagtcaaaattagagctgaactgactgagtctctctggactccctcagaaagtggagatgccagctccgcctcctgcagagcttggttgccagggctgggtcaggctgcctgggcgttgccgtctgacctgtgcacagatgtggccaggtgaggacacaagctgttgtctcgtttgctgtgtgctgttcgcagacacgtctcactaggcggtttgctcagaactccagaggacaagggtacgtcattcaggccacggtgcagcagacgcacctgacggcggggactcaaccacggcaaaccctgagtaataccgtgcggcagatgcacctgagggtgggttcggagttccaatctgagctatggaacctgggtatggacaactggataatccacttctcatttaagaggaacatctgagcccccgtccccgttctgtgcaccgcaagccaaatgggagggagagcctgtgttctgggttacatgaaggttgccaggtggagggtgctgagtggaaatgctatacatgccacttgcctttttcaagcaggtgcgttctcctgtccagccggccaccactgcaccctgccccgtatgagccctcagtggagccccatgtctcgtttgctggcactaggcctcttctcaggcctcctgaagctgctgccagcccacaggagccgacagaggctgggtgccgtgttcaggccactctcgctcttcaggtccggctggtgagcaattctctgggagagagtggacaccagaggcaggcaaagccacacctgtgggtgcaggccacacgcaggctgcacagacccgggacaggtctgagctctgaggcgtgcggcccatctccgcggcaggagcttctgtctgagcctggggaggaaaagcctccacctcaccaagcggcgtcagctggggagcctgggccgtgcgccctcaagaagccatggctggaggcctttgctccagacatgaccagcccctgccttcctggctctctggcaggtggtgagtcagctgacccagctctagcggaaacaaagtgggggctgggggaggggccgtctgtgaaatgtccccagccggagcccctcactgtcccctctgcctccctgcctcccggcctccacaggggcttcttgtggttaaaaaaaaaaacaaaacaaaaccctttctgagcactttacccatctcgcccacaggcagagacgacaccccgaaaggacagctgcgtctacatccatcagcaagtctcccgggaacggctgaggggcagagatgggagaggccacagacgcaggcacagagccccgtgcacccctgctcctggcctaggcggggtctgcaaaggcccttccaccgcaggcacagcccgtcagggaggctcacgctccactcagaaggacacagcccgtttcagggaacacaggcccaggcggccctgccacaggctcccagtgtcatggtggcccctgaggtgacacgtgcgccacgagggcaggcgtgtacgtgcgcacactcccgcagactctgctctcgcacacacccaggctgcgttgctgggaaacgtcagctgctgcggttggtctgtctgatttctgccattgtctggtgggtggaggatggagcctgggaacaagggttaaaaagccaaaggcacgcagaacaaacgccctggacgctggtgtgctgctgagcccaggtactggggtggactccacctgaaacctactgccagaagtcagctgctgggagtccccagaggggcccagctactctcagagcaggcgcgtgcggcgtcggaccaggggctggctctgtagaatgtgagcatctgccaactgagcctctgaacatgacacagtgagcggctccttacacagagccccttccttcctgctcccgccccttccccggctattcctgaacaacttctagagctctgcaccttcagcctcctgtctgattctcgccgggatcagcctccgcgcagccgcccaggttccttgcagggtggaccgtcccgtgtcccagcaccgggccctgcccacggcgtgcctcctgagagggcccactcagcacggccacggcagcctgaactcccagccttggtatccacgcagcccgcagctctctgcaatgaggggccggccgcaggcccagggagatgtcagctgccccaggcaatcacaagcaaggaggtgcgcgtcgcggacacagcacgaagccctgctcggcctccagaaaacgaggctcgctcctgagtcttggctcgctgggccaccgtcaccctgctctctggttcaagaggcagcggccaggccagccgagccaggaacaagctgcagtgccttggcagcgtgtgaaatgcagaaggtcttgcccatagaagtcatcacagcagagcgctctccccacaggggctgggcagcatgtccgctgaccacagacctggctttggggcacgtgcaccacccacgttaaccatccagagctacaggcaacagcccagtgccaagtgcagccagccagaaaagaaaaacacacaaaaaaacggcaaaacacaaactccgtccaaagtccacccacgagcaaagccaaccgcattattcagagctgcgtgcccagcacacggctctagagagaagcgaggagctgggcccagcggcagtggcagttcccttctccaccgcgcagtcccactaaagctgcgggcagctcttgatttgtgtatcttacaagaagaagaggagggggagaagaagggaaaagtcggcgtctgcagccacactcaagttcttccgctcatccacgactgtgaagctcacagctccggccacgctggcgttcaacaccaggtcactgtcacttccacaggggacggtcttgcttctttggtaaaaccaaaggagtgtttcaaaccatgcccaccttccattcacctgtttttaaaatttttttttttttcagagcaggagcggacgtttattaaaaagctttaagagagaaaggaaggtgcactcggaagagaacccagcgggcgacctggagaacaggtgacccactgaactgtgatcctgcgcccctttccgtgagggtgggccgcccgcaggcacggtgcccgcctcacccttgggaagtgagcacgtgtgctgggattgggaagttgcacacgggcaagaaagcaagcacggcgtcagcaacatcagacacagaatcaggggcttcagtaagaaaaaggacagcagctcttccttgcaggaaaatagagtctggaggaaaaatgccccgtcccctgcagcagcttgaacagaaacactgtacagggaggtgggcacaccagggagcgggaagagagagacactctgttgccgtctagaccccgaccccttacccgtgacacggagcccaccacatgtctgagagcagacctctgcagcgtgcgggccggggtctggatggggtctcccgggccctcctccctggcagccccgtccgggaggcgcgggtgcagccagttcacacataaacggtgtggaacatcgcaggccacagggaaaggcgtttacgtggctatccaaactaaacctcctcccacgcccgaccctgtggtaaaagacaagtgtgcatgctgggcaaggacgaaagcttcatcccctgggctgagattgtcgggtgaaagcgtcaaagtggaagtggctactggagaaaaaccctcgcgcagggaggcacagtcattcggcttctttaaggaaaaccccagctatcaggcgctatgcacacaacagtcgttagaatgaccttacaccccacaaaacacacagtcctcttggaggtgtatctgcagctgaggaggctgtcaccacacgaattagcccttatttgtatttccatttcccaagttcaactgtatcaggagacattggctgatgaaactgttgacaaagccagacttcctgctacaaagcctgacttcagaaattcagaccacgctttcattatgatcaaatttaaacccaacttcagaaattcagaccacgctttcattatgatcgagtttaaacaaaaccaacagcgacgtccccaccctgcacaggagagggctgtgctccgtctcccgtgtactctcatggcatctccccagcccctgagacgggtctgcggttgtccccacttcacggtgagacacaagtgtgcagagggtgcccaacccggaactagcttgggggtgggctcccaaggaccaggcagcgtggagagcacccggtggggcaggggagagctggaaggatggaaggaaccctggcctgaacggcccacagcagcgctggcccctgcccagggagtaagttcccaccaaactccaagctctgtgctttgggatctcggtgccacctaagcaccagccccgtgctagcacccaccaggctctgccatggcacccacaggtttcgccccatctggttaccatctcacactgccaggcgggaccaaagtacctgggttgaggtggcagctatgctgagtcctgaaccgtgggcagggctctgtcaggccacaaaggctctggagaaggccaacctccactgtcagcaccgaggcaagggcctcaacactggatttatttaccagcctttaaaagcatcatccgccatgcatgcagtggcccgggaggctgaggcgggagggttgctgggcccaggacttcgaggctgcagtgagctatgatcatgcctgtgaatagtgactgcactccagcctgggaaacagcgagacccatctctaatgcattcacgtcatctatgagcagcaaatgaaagctcagacacctgagaggccggtggctccaaggtgctgcacaccctgacgcccgcatgtcagtactgcagctccgggcaaatcacagcagagctttcctccaggtcagcgcaactgtgttcccgaggggcccatgcagcttacgtggaaaggccaccccgtgccactcagaattaccaggagcgcagcaagtttaaactagacactgtttatgcgcctgacagcaggagacgtgagccgggtgcctgggaaaaccatcttcaaagcaacaactgttttcccagctgtgaatgctccatcctgggaaatctgctcataccactacaaaaataattttgaaaagaccgtacaaatatgcagcctcatctgtccattctggtactttagacccaaaactgaagaactttctggagcacactatccgcttagccagtgactaatattctttacaaacatgagtgaatgttataatgaaataagcttccttgaataaatgtgatgttagttcacttaactgagaacagtaagttcagaggcttcctttgaacagtcaggaagtggagataatcgcagtagaagagagggacagacaggaagactactcttctgcactctctattttcttactatgtatcgcaattttataaaagaaaaatagttgtcatgaaggaagaggtgttacaatcctgggtaaaagggccagggcaggagcatggacaagccacaggctctgggcacctctggaataaaatctcacttcagcttaaaataccaaacgtatactgtgaccagcaatttcaatatggtgaccaactgacatgcccttcgaacgccaagaagacaacagccccagaaacagcttcagtcaggagacccagggtgctggcccggttctgccgccggccggctgtggaacaggcttctggagcccgagggtgacgccccagcctctaagagcaggtgcttgagaacaacaggggctgcctcatggggtggcctgtggttcagtctcaaaagcagcaaaggaatcaatgaactgtgagacgctgatcgttactcactccacagattactgtggtgacactatgtgcaaaaccaggaggccagccatgcttttaaaaatacttagaaaaaaaaattacaagcatgtgaaaatgtaccaaatatttctctttattttattcatattttaagacgaagtctcactctgtcgcccaggctggaaggcagcggtgtgatctcggctcactgcaacctccgcctcacgggttcaggcaattctcctgcctcagcctcctgagtagctgagattacaggcacacgccacgcttggctaacatttctctttctaaatgttttcatgttttctgtatttttcataatgggtgtgttttacttttaaaaagaggaggaaaaggctttgtttttaaaattaaattaagaatgatattaaaagaccatgtataaatcaaatctatgctgagagttcggccgtgtcagaaagacgcgtccatatcacaggaacagagaggagcacacggaggggagaggagagaggtgaaggggcagagggagttgctttccttgctcaacttttccttgtatgatttcgatgctgtttatttaggaaacgaacgggaaatgcagagtgtttccaaggcatgcatcatgcagatgctgcagaagtagcttctacccgctgctcaccgctcccatcctcgagtcccgcacactgcccggccgagcactcagctgtcgggctctgccagccacgcggactctccacatgcggatgccaccaccaacttgcccaacagagacagccacctggtccctgcacagactcaagggtgtgtgtgtctgggcatcagagggccatccagacccagccagagcgaaaccccagagacacgtccttccagcgcttctgagggcccctgtgttctgggtgccgtgtgggggagaggacagagccaagagaggccaggacagcgtggcagggagaggatgcaggaggggatcaacgtggagaggggcaggcaggggccagactcaggctggaggggccgagagcttccacagagtctgctggcagcatagacggattgacacgtcaggaggagcccggcccacatgagcaaaaaggcaggcaggcgggagaacaggtgcagcctggtgagggtgacgggcctggggcaggcagaagggccccactcagggtgtatttcaaaggtagacaagacagggcttactggctgtggggtgcggccagaaaagaaaccagagaagatgccggtgctgccggagggaatccctggctgtgctcccagctcccaaaagaccaactgacctcaagtctgaatctgccgcccccttccctccgtgctgtttctgcagtggcgaagggcagctgggccaggtgaacacacaaagaggaagccaaaccgtggtgcagagccaggccggacagagggatgtggctccctgcccaccgtgaccacggccaggagcccccaacagcaggtcctgctgggactgcaccaggccacggggaagcgcagccctgccagcaccagcctccttgcctgcccgcccagcatcagctctgcctggaaggaacgcagactcgactccgggaaggaaggaagctcaaatgctctgtactgcaggaccatgaagagaagcggggaagggaaagagccacagaggaagccatgtgtccatgtgcactgtgagcaaggccaacacccacccggaaaaactgccgcttagccctgtctgcaacccactatccccaagctcagtgggcactccacagcccgcctaggaatgggagagagcccatgatgcgctcacagacacccagctatgcacgggtcaacaaatacggtcccatctgcaaaaaagagagaaaactgccatttaccaagaacccactacacagaagccagtgactgtggaaccaccaacagacatgactctgcctcctgcttcttaacccagggaagctggtagcttcttcccactctacagagaataagaccatgagatgaaggttctgtctcccaatcacagaattcgccgtggcttccaacaccatgctgcccacaagctgcaaagcacatgccaaaagctcagtcaacaagacagaactactggacagggctctgaactctttttgacaatcttatgaacactaggggttctctccccacaactgtaccaccgtgacgtacagtctgcaagttcttccctgaatcccaccagtggcctgcagggaagaccttcctgcactggagccccacgccccgggaggaagcagaggagggctgtgtcccacactggagtcctgcacccctggaggaagcagaggagggctgtgtcccacactggagacccgcaccccgggaggaagcagaggagggctgtgtcccacactggagacccgcaccccgggaggaagcagaggagggctgtgtcccacactggagacccgcaccccgggaggaagcagaggggggctgtgtcccgcactggagacccgcaccccgggaggaagcagaggggggctgtgtcccgcactggagtcccgcaccccggggggaagcagaggggggctgtgtcccgcactggagtcccgcaccccggggggaagcagaggggggctgtgtcccgcactggagtcccgcaccccggggggaagcagaggggggctgtgtcccgcactggagtcccgcaccccggggggaagcagaggggggctgtgtcccgcactggagtcccgcaccccgggggggaagcagaggagggctgtgtcccgcactggagtcccgcaccccggggggaagcaggggagggctgtgtcccacactggagtcccgcgccccgggaggaagcagaggggggctgtgtcccgcaccccggggggaagcagaggggggctgtgtcccgcgctctgcggggaagcagaggggggctgctctccttggcgggccctgtgggcagctttgcacctatctgctgcggactccacgaatctcacggcccaaacgcacgggtgtgctgacttgtcaactgggggttcccatgaggcgggggcagtgcaaatctgcctggggttctgattctgtgcggatggctttctatccaccccagcttccctgccatgtgtctccgccagctaaaaggattttgtacctcccattttaaggacaagtggctctcggctaggagggcagttgagttccactctctgccgcctgagtgtctgagatcacccgggttgccgtgtcactgctgacacacacgcccctaccgtgtgcacccgctttgatgccgatgggggccatccagtgtgcacccccctcactggagcggctgctgggtctcttctttaccacctgcttttgaattaactatgctagaaaattcggctgtgatatttctcccaggcatttttttttttttttttttgagacggagtctcgctctgtcgcccaggctggagtgcagtgctgcaaactcggctcactgcaactctgcttcccaggttcaagcgattctcctgcctcagcctcccaagtagctgggatcacaggcgccccaccatcacacccagctcatttttctattttttgtagagacagggtttcaacatgttggccagactggtctcaaattcctgacctcaggtgatccacccgccacagcctcccaaagtgctcggagccaccacgcccagcctcttccagtatttttatgtgtgtgaggcagaagggacgatttcccatgttgaccaatccaccatattgacagaagttccatatatctgcattacctaaactttcatgacaagcatgtatttgttttaaacaattttaaaataccttaatccaataaaagaattaagacccttcaagtggtcctaatcccaacaggctgaaaaccaccggcctgaagatcaccttgggaatccagccgacacgcgtggcccctgaggccccccattcctgcgtggttcctaaaagcatataaaaaactctttcactgctcattttcgtaaaggctacagtgtaacactccatttcacttgcagctcagcacgcagtcgctccacaccctggggtgcggtgagtttagtctgcaggtgcgaacacggaacaggtggacatgccctccccactcacctctgcgtgggcgacggagcctttcccgcccgccgggccctccccactcacccctccatggccagcagggcccttcccctcccccgccgggccctccccactcacccctccgtgggcggcggagcccttcccgcccgccgggccctggggcagcacagcttcccgattcccacgtgcctctgcgtctcggcgccacgggtgactttcggtccagatgccagcaaagacatctctctgtctaccaggcaaccacctccatcctcacctcctcacgggcagactctaactacctccgctctctccacaaatgccagtgcgagcgcagcctcgccgggccgtgggctgcgtccagggctacagtaatgagccggagggcagcgtggggaggacaccaatgccggcaccttctcccgggccctccacgcccagacacggaggctacgcaaatctgccccaagcgcagaggcgagcgggtgcccacaggagacagaggacctcgcgccggccgaggcagggctcagtccgtggaagagctctggcggcaccagcgcatgtggtagcaaaatccccacgcagccgctcctagcttcccgccagaatacctcgagatgccaggaaggaaagcgcacacaccaccacaaaagctaagctaaacaatccgctgtgaaaatcagggaggcacgtcctccgacgacaaggatgccgagcagggcttccatcttcatggtgcggctccgagaggaaaagccagccaccaaagacccctcacccctctccccgcgccggcacctcccgggccaaggtctccaaatctaacggaggctgggaagggcccctcagtgcgaaggcacggccgcctgggcagcctgagcgctcttcccgcgcctcccgccacgtcttcccatggctcccgtggggcagagcgggagcgggtgtcgggggtttggggagatccaccatggggccgcatcccgagggagcagaccgggacacgggcctcgcggggcctgtgcggccacagcgctgtggggcgtgggaggccgctgtctgtgtagggcaaaagccataaacacaaacagcccaactggaaaaatatttgaaacatgaaggatagataaaggctcttagtttaagaagtgtgtttgcaaatcagtacagaaaagataaattacaatagaagtggttaaaaaaaaaaaagcaaaaaccacacacaggcaattcacaaaaaaaaaccaaatgaccaatatgtacatggaaaatgaccatcaaccgtaatcttagaagctgaaattaaagcaatcacgccaggtgtggtggcacacgcctgtagtcccagctactccagaggccgaggcagagaactgcttgaacccaggaggtggcggttgcagtgagccgggatcgcaccagggcactccagcctgggcgacagagcgagactccgtctcaaaagaaaaaagcaaaaaaaacaacaaaaaacatttaatgtctggcttggtgctttgcagtctgcctgtctaatctgtggtaaacttttgaggaggcggcaccagatataacatgtctctgttatttttagaattaactgattaaaatgttttgctatttaaaataaataaataaaataaagcaatcaccagctatcactgcttcctgtcacactggatcacaacacccagggaggacacagggtagcaggtgttctgctgcggcccaggcctcatataaccatcttgatggcaaaggttttctcaaagtgcaactttaagggaaagacataaaatgaaaccaactactattctcatccatggcataacacaaaggtgttgaacaaaacagtctttattcaagggcctgctgtttgtcgttttgcttaaagtcacagtttctggccaggtgaggtggctcatccctgaaatcccagcactctgggaggccaaggcgagaggatcgcttgagcctgggatttcaagaccagcctaggcaacgtagggagactctgtccctacaaaaaatacaaaatttagctgggcatggtgatacataaacctgtggtcccagctacttgggaggctgaggtgggaggatcacttgagccagggaggttgaggctacagtgagccaggatcacgccattgcacttcagcctgggtgacagagggagaccctctcaaaaaaaaaaaagttgcagtttccaagggcctcggggcgggtgacactgagtgaggactcgctgtggatggaaaagcaaacatgcccactgcagaaatcctcagcacacgcggctgctacagacgttaaccacggcgtcatttcacggtggcagaatcagtctttctggtttcttccataaatttctctgtattttctaatttcttttacattaatcatgtataactcaggaaaaataatacacattacttttttaaaattacattttgctgagttcgtttctgttgaccacaaagaagcagcgctggcaaacatctgggctgatcacagcagcaatgacagcattagatggaaattccactgacatggaaacagtgggctttctggaatatggggaagtggatcctgttttctttggcccagaatgaggatggtcagatctccatggcagtgaggaaggccggcgagcctccagtttctcagcagttctttggatctgaccagcaggctgagaaagcccagcttagagatgagagaggccggccgggagcccagtgccagctaacagctcacctgccctgcggcccggcctccacctgctcactctgagagacgcctggcaaggtggctgggacggctacccccaaaaggctcctggagaaagagaccacaggagtgccccacacagacagggtgaacgagcctcctcggacaggaacaccgtggatggccccacatgaagccaggaaagtcccacggaacctggcagcttccagcaacgattgggccaatagcacatatcacgagccttggaaaagcaaacgagctttaattctgcttctcctaattcctaggacattaatcggctgtcctcttcgaaacgggagtgctgtgatccaaatggctaaaaaaaaaaaaaaaaaagaaaaagcgatcacaccatgtgccagtgagggtgcggggtccggcctcagctgtgcttgcagtgcgaacgcaaaacggcacggccactctggagaagcgcagcggcttcgtaaacatctaaacatgcatgcaccatgcaacccggcagccacgtcctgggcacttaccccagagcgatggaaacgtatgctcaggcatatttacagagctttactcacaaaagccaaagcccagagatccaaatgttctttgcaccgtggatgaataagggtctataaagcagcagcaccaggagccgtgcagtgcaggatcctcctgtatcttgaccgccacagtggtggttacaggaagctatgcacctggaaaaactgcagggcgcacacacacgcacacacccgcacgtacaaccgtggactctggacgagctctgtgcgaggcatccacgtcgatgtcctggggaagccaggccacacaggcccctcatgctttttttttttttaatttactaagaatctaccgttattttaaacataaacttgctttaagagaaagtgcgagtgagcgccctgatggcactggcttgctgagtactgtgttttcacactgtcccccagcaaccaatgccctgaaagccaggagtgcccgctcccagaaggcgccgcccgggcagcagcagctgctcctgttctctgcaggctggtgctgttcctgttcggagcaggtgtgcgacccacatggcaggggcacggacttgcttcgaccgtccacactgagaagattctgtaagcatcacgaggtgctgatgggtcaccacgccccacaggatgcagaacagctggaatcggatggcagcgctgggcagggactcggagctcatctacttcacatctcacgctccacaggactccttcccgggcggcccttacgacacccacctcgtcccagcccgagcatttcccaggacagactcattacctcctcttagacagcactgattttccgacagcgtgcctcatcccaagccaccacctgtgcctgtaattcctacccgcgggtgccagctctgactgccaggcaaggagcggtgcagaaactctgagccatggcaggcttcgaggggcaaaggggctccaggacccggcctggacggcaggaggccacgctctgctccggggctcttctcaaacttgtctccagggagcgaatggagaggcccgagctcagaaagaagtacaaacctctcagtggctcaacttcccgtcgacatagatactaattttatatttcaagttaaatgtcctcttgttgctcactgatgccctattcttctcctaattaacccgcagtgcagcggtgcccatggcaagctttcccactgtagcaaggacacggccctgatcatttcccacaataaacccagagtcctgccaacttcccaaggggtgcaggccagactgtgcggccactggcccatacaagggccgggctgttccttactcaaagtgcaaccactgggcctcttccacgtggtaggagacgcagaactggaggcagaaagacctgctgcctaagtgccacgatctgtcagggcagaggccgcccgcagctggggagtgacctcagacgcaggtcctaagctgcaggttaaagaggcaaatgcgcccctgtcaccagcgtgaattgtggtgagcctggagaagtgctgtttctgccttggttggactcgatgtttagactcggagaatgaaacttcagccccctggtcaagtccccggcagcctctgtgggtaaatcagctttggttggacacggctgcccccgctcggccgctcatggcctaacgctgttcctgctccacaggccgtgatgggcgcggggcccaagggctacccccttccccagctggcctttacggaaggactgaggccagctctcccatgggtgagggaaagagatggtgatcaggaacaccagcaaaccagggctgacaagagcaaggaatcgccaggcccaaaccgcggggtgagccagggctcagaaacgagggtggcccgggagccattctgcccgggcgatgggcaggtgtctgaggccccacggggcaggaggggaggtggaggggctcgcaggagagctgcccctgccccgcacaaagcagctgctctcacagggttgcagggttggacgtgggtgggagccatggtcactctgcagccttcccagcaaccccataagcaccaaactccctgtgttaaaccccttcctgtttgagatgcctgtgggggtcctgtttcgcctttgtggataccgtgggcatgtctgttaccagactgcagtccacaaaagtgaaagctcatgctttggcggagacaattcaaagtctctacttgcttaaaaattctcatcttttgagataaataagatccaaaaagatatgcctcattttataataaatctttgctgttttttaggagtgtttcttggggagagggaagaaactgtttgattttcatcatgtctgggtgttaaatttctccaaacacttcttgggcattcactgagatgagaaacggccccggccctgccactgcccacccttcgggaaacgccccaccacagacccagcccccaggctcgccctcaccgggcgccaggggatgtttgctatttaacacagagaacaggaaatcaggaggcgctccccatcacctcccaggtcagacgccatccaccctcctcatcaccaacgcccacgcaggatgacttcactacagctctacggaccggcttccatcaccaacgcccatgcaggatgacatcactacagctctacggacaggcttccatcaccaacgcccaggcaggatggcatcactacagctctagggatggcttccatcaccaacgcccacgcaggatgatgacatcactacagctctaggaccggcttccatcaccaacgcccacgcaggatgacttcactacagctctacggaccggcttccatcaccgacgcccacgcaggatgatgacatcactacagcactacggaccggcttccatcaccaacgcccacgcaggatgacatcactacagctctagggatggcttccatcaccgacgcccacgcaggatgatgacatcactacagctctaggaccggcttccatcaccaacgcccacgcaggatgacatcactaaagctctagggacggcttccatcaccaaagcccacgcaggatgatgacatcactgcagctctacggaccggcttccagcaccgacgcccacgcaggatgatgacatcactacagctctacggacccgcttccatcaccgacgcccacgcaggatgatgacatcactacagctctagggaccggcttccatcaccaatgcccatgcaggatgacataactacagctctacggaccggcttccatcaccaacgcccacgcaggatgacatcactacagctctagggactggcttccatcaccaacgcccacgcaggatgacttcactacagctctacggaccggcttccatcaccaaggcccacgcaggatgacatcactacagctctacggacaggcttccatcaccaacgcccatgcaggatgatgacatcactacagctctagggacagcttccatcaccgacgcccacgcaggatgatgacatgactgcagctctacggaccggcttccatcaccgacgtccacgcaggatgatgacatcactgcagttctaggaccagcttccatcaccgacgcccacgcaggatgatgacatcactgcagttctaggaccggcttccatcaccgacgcccacgcaggatgatgacatcactacagttctacggaccggcttccatcaccgacgcccacgcaggatgatgacatcactacagttctacggaccggcttccatcaccgacgtccacgcaggatgatgacatcactacagctctacggaccggcttccatcaccgacgtccacgcaggatgatgacatcactacagctctacggacaggcttccatcaccaacgcccatgcaggatgatgacatcactacagatctagggaccggcttccatcaccgacgcccacgcaggatgatgacatgactgcagctctacggaccggcttccatcaccgacgtccacgcaggatgatgacatcactgcagttctaggaccggcttccatcaccgacgcccacgcaggatgatgacatcactgcagttctaggaccggcttccatcaccgacgcccacgcaggatgatgacagcactacagttctacggaccggcttccatcaccgacgcccacgcaggatgatgacatcactacagctctacggaccggcttccatcaccgacgcccacgcaggatgatgacatcactacagctctacggaccggcttccatcaccgacgtccacgcaggatgatgacatcactacaactctacggaccggcttccatcaccgacgtccacgcaggatgatgacatcactacagctctacggaccggcttccatcaccgacgcccacgcaggatgatgacatcactacagctctacagaccggcttccatcaccgacgcccacgcaggatgatgacatcactgcagctctacggaccggcttccatcaccaacgcccacgcaggatgacatcactgcagttctacggaccggcttccatcacagacgcccacgcaggatgatgacatcactgcagttctacggaccggcttccatcaccgacatccacgcaggatgatgacatcactacagctctaggaccggcttccatcaccaatgtccacgcaggatgatgacatcactacagctctatggaccggcttccatcaccgacgctcacgcaggatgatgacatcactacagctctacggaccggcttccatcaccgacgcccatgcaggatgacatcactacagctctacggaccggcttccatcaccaacgcccacgcaggatgatgacatcactatagctctaggaccggcttccatcaccgacgcccacgcagcatgacatcgctacggctctaccgaccagcttccatcacccacacgcctttttcattttgttttgttttctagagaccaggtcttgctacattgcccaggctggccctgaactcctgagctcaagggatcctcccacctcggcccccctagaagctgggaccacaggcctgtgcttattcaaaaacagacaaaaaggaagcccatcgttcctgctacgggaatgctgccagtgtcacatgctgcccatcttctcatccagagagccacactatgtttccttcagaattcaactgagaccaaaacaagaaaaccacagcacaacgcttacccagcaaaaatatgaaaacaccaggcttctgggttaagccagaaacaaaaaagtagttctgctttggaaaatgtgaattatatggtcatattaaagatgatcacctctatcatacaacactggctcaaaagtcctagccgttgctagaagaaaaacaaagacggcatgaacacgaagtggagacacacctgccattctctgcagaccttttcgcttacttaaaaaacccgatacaagagaatcaattgacaatagaattagaaagctcagcatcattgttagctctaagatcaacatccaaattatctataacttcccaatacaccatcaataaccattatgacacaccaaaggaggaaacagactcaaaagtatcaagaatcctaacaagaaacaagcaagacctttccagagaaaaccataaaactttcctgaatgacagaaaagacaacctcaataagtcgcaaaaaaatgttcgtggagtagaaaagctgattccaaaattcacacaaataagaggccaagaacactgtccaaaaaaacaatgaagaaagagtttcttatggccgggaaaggtggctcacgcctgtaatatcaggactttgggaggcctgaggagggagaatcacttgagcccaggagtttgagaccaccctgggcaagatagtgagaccccatctctaccaaaaaaaaaaaaaaaaaaaaaaaagaggtacttactttgctagatattaaagcatatttttttttaaaaaaactaaagtattaaacagtgtggtaaagacctcactaaataaattacggtataacaagacaatggaatactatgagactcttaaaaaaaaataggctattgtgggctgggcgcagtggctcacgcctgtaatcccagcactttgggaggccgaggcaggaggatcatgaggtctagagatcgagaccatcccggccaacatggtgaaaccccgtctctactaaaaatacaaaattagccaggcgtggtggcacacacctgttaataggatattctaaccaggattctaagacaattcaaatgacaaaagaactgtcttttcaacaagcagagctggggcaagtagatattcacatgcagaagaatgaaactgtatctccaccttgcactacactcaacaattcacaaaaaacaaatcaaaaacgtaaatgtaaagccagacacaggggctcacacctgtattcccagcactttgagaggccaaggcaggaggcttgcttcttagatgtggtatcaaaagcaccggcaacaaaagaaaaatagatcagctggtcttcatcaaaatcgaaatcttaagcgcctcaaaggacatcaagaaagtgaaagagaagccacagaatgggagaaaatacctgcaagtgtacttcccagacacactaggatatctagaatcagaaggtcacatatcacagtgctggcgaggacatggagaaagtgcaactcttggctgggcgcagtggctcacgcctgtgatttcagcacttttgggaggccgaggcaggctgctcacctgaggtcaggagttcaagaccagcccagccaacaaggcgaaaccctgtctctacaaaaaaatacaaaattagctgggcgtggtggcacatgcctgtaattccagctactcgggaggctgagagaggagaatcgcttgaacccgggaggcagaggttgcggtgagccgagattgtgtcactgcactccagcctgggcaacaagagcgaaactccgtcaaaaaaaaaaaaaagggggatagaatgctcaacaaaagattctaaggcaagtgtatctttcttttagaacaaaagaagttagatccctatcacacataaaacaaatttaaattggttctaaaaaatataaaagagaagcacttctttcggaagaaaaaaacagaagtcataaagaaaaaaactgaccttacatcaattatatctcaataaaaagctgttttttaaaaccacatactcagaatgatgagactacacctataagagcagccaaaaattatacctcaataaaaagctgttttttaaaaccacatactcagtatgacaagacagcacttaccagagccgccaagattaagaagctagcagcaccacgtgtcgaccagtgtgtggaggagccaggaccctcatgcttcttttttgttcaacattttggggttttttttatttttagacagggtctcgctctgtcacccaggctggagtacagtggtgcaatcttggctcactgcagcctccggtgattctcccatcttcgcctccctagcagctgagattacaggtgcacgccaccatgcctggccaatttttgtattttttatacagacagggtttcaccatgttgccccggctggtctcaaactcctgaactcaagtgatccttctgcctcggcctcccaaaagtgctgagattacaggcacgagccaccgtacctggccagcagcttctcaaaaaattaaccacgcacttactataggatccagcaattccggtcctcggaacgaaagcatagaaagtcacagatgcaaatgttcacagcacattcataacagccccaagctggaaacaactcagtctccaaaccctagtaaacgggtgagagaatctgtgatcattccgcaccatggactattttactcagccccaaaaatggatggacacggggcgtagtgtggccggcaggcggcccatggactattactcagtcccaaaaacggatggacacagggcagcagggccgacaggcggcccatgaactattagccatgaaaacggatcaaaaacagatggacatggggcagcgcggctggcagacagcccataaactattactcagccccaaaaacgaatggacatggggcagatggactattttactcagccacaaaaacggatcaaaaacggatggacacggggcagcgtggccggcagggatgaaggagggagccggcctcccgctgcctacgcgggcttcagggagaccacacaagttctcggggtctcagttcccccacacgtaagactgttcctcaggttccacctgcctttcagccctgtacatgtatgagttcaaaattcagtcggcagacaacccggcatgcagcagtcagacaggagaaaataaaaacaatgtggtgggggtgggtggaattctactaagaaaaacaattcgggctcccagggagcctccacagacaccagccaccactcagccccaagagttcaatgacacacaatcccactgccagggcagtaatgcttcttggggcaaaataccattggtcttaagtattttggatcagagcaaattctcaaggccatgaagttcacggcctcatttgatggttttataaagctgcggtcttcatgctctagtaatacacactgattttcaagattacaaaagcagcaaatccagagcctctacacgccggttcaagccaagtagccctgctcccttccgctgaccaccacctgtgccccgcgttctggctgtgcgaggcgcaagccccacagccaggcggtcacgccagacgggtttacagccaagaccatgaaacacccagggccagaaagactgcacctgggaacatggtaccctgggcttactgtggcccacgaagccttctgtggccactgcactcacacagggcagcatgctgcacccacccactgcactcacacagggcagcgtgctgcacccacccactgcactcacacagggcagcgtgctgcacccacccactgcactcacacagggcagcgtgctgcacccacccactgcactcacacagggcagcgtgctgcacacacccgaggccttgtctgagccctcatggtccttacacggcaccttgacacatggaccctgccctcgactgaggctccgccggctcgcagccagccacaggaagggatcctggtctctgctagtgggctccatgaggtaaccagagtcagaaaccaggggtgagtctcttccccaggaccagctggccaggtgactgaaaccagcacagcacccacgcctctgcccctggcacctccaggctgctaagaatcagctgtcaagatgctcgtggggacggaaagtgttgcacacataagggattcttacgaggcagaggaagccaggggggttctgctgacatgctgacagcagtggactgagggagcccaccttccatttccaggcagccaaacagcactgacagcagcagggaggcggccaggtcatcacaggggcctccacaccagcagccactcggctggctctgcatggggtggtcacgcgtatgccgccttcccccgcatacggctccgtggcttcagacagaaacagagaagctaagggtcccctttagtgagactggagaggcagggggagggtgaaagacagaaagacctgccgagtcacatgacctcccaccatgtccgccgaccccaagggatgctgggcagcaggcctggctcagccggggccccacagtcctcccgaaggacatgtgtcatttgaaacctcatcctcacaacccgctcaagtgggaaaccaggcctggaagggttaaaggaacgtgaaaacagaactcctaaaccccagctccccggggagggcttagctatgaaacaggaagcagacagggcaaaccctgggacccctctggtccacaagaggaaaggcccaaggcgccaaccccagcggcagaacctcctgcccgcagagctgaggaggacagaagcggcaggtgccagtccctcctaagaccagtgggcaatcatacagcccagtcaccaagacacgagacaggcccatgggagcaactgttcctcctgccgggccaccacaagccgcccacctccccagcactccaggccagcagggccctccgggatggggagctcagcaaacaacacccagagccgagaccctgaggccctggtgcccaggaccgaggaacggccaaacctcaccaacgccagacagaggcaccagggactgaagcctgggagagtgagtgcacccggcccaggaggcttcccgggccaagcccacaggcctgagtgggaaccggaacgctgaaggaacactccccaaggggcgatgaagttcccatcacttggggacgtggcggcgatcctggcgcaagctcagagtgctcatgctgtgggaagaggctgcacggggccccgggagtggccgctgacccgcaggctccccagacggacgttgctgggaggacaacacaatggcccacggggggacacaggcttctccatcctcgatggtggattccggaggttcatccaggatccactgggggaggggagggaagcagcgcagtacttttccacacgctcccccggagcccaggaatgctgctccccaggcccagccgcccaccctcctaagcacttgggttcagcttcacaaaacgcttgaaacttttttttttttaaaacaatttcccatgagaaccagggagagtcagcaaggaaatatccatattagcagagacaccccatttcactgggagactggctcccagacatacaagaacatgagcccctgagcccccacactccatctgaaaaccctcccagtagcccggaaactggccacaggggcatgcagtttgcagagaatccagctgaaggcagctccctccgccagctccctcggaaggaacgtgctgccgacccctgctggtgaaccgggctccaccgagaccgcattccctggcttcccaggccctcttcccgctgccagctcctccaaaggctaaggaaccagctccaggtcgcttcccaacgctcagctgggcgggcctgagaccaactccacgccagtggccggaaagccaagtgaaagctggtgactctgccggcagctgcgtgttacagaccagcagagtccagccctcaaagcgtagctggaggaaacaaaggctttcttctttcccctcttgctttccagctttcttttaatcaacacgtattttaataatgaaaaataatcacatactttaaaataattacttgaacctaaacaaaaggacagacaccactccctcacttgggcaggagttttaacctctgcccacagtcaccgtaagccgagctgtcttgggggtgctgccagtgaccagcggcctgtgtggggatctggctggaggagggttcaccaagaagggagagccagaagcctcttgactcaactcaaaaagtccagggtgacgccgcgcccaccaaagtcgtgtgtgcctgaggctctgcggaattgagactgggctgaaccacagaacaagagctccagcagctctcgggaaaccagcgtccatctggaacccaaactaaaaagcacaactggacctcaggctgtgaagaaggagtgagtaagaggcagtcggggggtggggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaaaataaaaaaaattttaaaaaagcacaaaaaaaaaaaaaaagaggcagtcagcctgggagacacaggaattcaacagcctgcggaggaggagccgaaattcaaggtgaggctcaggtggaacgcggggctgcctgctgacccgctgcgcgggagccgcaggacctctgcacctgccaggcctcagcctccgggtgaccttggggtgttctgctagagagcccaggacaagctgtctggctgtgcttggggtgctgtctggcttccctcgcccggggggtggcagtgagagacgaccctctgagacagccaggagctcctctaggcacacaccccagcttctcccctccacccacgcctgctgagccgcctgcagccacagacgtggtggacgtgatttcacaccaccttccgagagctcagcactgcctcattggacaggatcccagagtgagctgggccacacccagcaaccaggcacactccaccgtcccgggcatccgtggctgggtagcccagggacccctccaagcactggctgtgcccacctcctgctggaagccgctttgaagggcccacgtgggctccccctttccacctccctttgcacagcggccattttctcatttcatgaaaaacagggccacctgccaccccacatctcacaatggcacactgccccaggcacgagacctccagcactaatcaatggcaaagcttgaaccctggtgtcaccctggggaagtgaacaaatgtaacaagccagcaccgggcccctgcacaactcagggacccagtccacctgtcacttactgatagagctttaaaataaatcctgaaaatatgtgcccaaaccacagaatggtctcaaagtttaaggacttaagcaacaaagctacaacactactcttgttcccatttactcatctatgtcagcaagggcgctcagcactgaaatctgacatgagaacaggaacaaagcctgtggaaacccgctttctctcgagcaatgacagcgcggatccacaggtgagtgtgccatccgcagacacggaaagccctgcccttccacggggtggtaacacggggtgacaatgctcttaccacgatgtgacgcgcgcgtcgtcagatttcactttatgtagaatcatttgtgaaaattcctaatctattatgctgtttcgatcaactgcatgctcctaatggtaaacacagctcaatgcagaagagaaattttaacactcagaacttggtgggtcaaaaaattttttatattttcaaatttaaatgtatatgcatctttttgtggaagataaacatgatacagtacataataaaatactttcaagaataaaaatgcagggcctggagcagtggctcacacctgtaatcccagcacttgggaggccgaggcaggtggatcacgaggtcaggaggtcgagaccatcccagctaacatggtgaaaccccgtctctactaaaaaatacaaaaaattagctgggcgtggtggtaggcgcctgtagtcccagctactcaggaggctgagacaggagagtgcatgaacctgggaggcggagctggcagtgagccaagatggcgccactgcactccagcctgggtgacagagcgagactctgtctcaaaaaaaaaaaaaaaaaaaaaaaagaataaaaatgcaggccaggtgcggtggctcacacctgtaattccagcatattgggaggccgaggtgggtggatcacttgaggtcggaagtttcaagaccagcctggccaacatggtgaaacccggtctctatcaaatatacaaaaaactagtcgggcgtggtggtgtgcacctgcagtcttggctacctgtggggccgaggcaggaaaatcgctggaacccaggagatggaggttgcactgagctgagatcccaccactgcactccagcctgggcgacagagactgtgtctcaagaaaacgaagaataaaaatgcatcactttaggagaagatggctcacgtgtcttttcaagtgaatggtggtggatactcaaatctcaacgttattcataacccgctgcacaccgtttagaaagtgataccaataggtgattttcaaacggacaataatcgtgttattcgacacgaacatttctagatgtgcatttttaaacacaggctttcaggacacgcctctgcacatgcccaggtgaggagccgcccctcgcaccttcccagggcccaaccgaaggcctgctgcaggcccctcaccatcctgcatgccgccaccaagtcccctacacaacacagcacccaaaacagcagtttcctggcagctaagaaaggcagtcatagggttccaactcaaaatttactaaaatccttctttgtcctacaatcgcttctggaaggcaccaagccccaccacgcctccgcacctgttccaggctctgctccacagagaccagcaggctgagccaccccctctccctccagatcagataacaggtggatcccagagggcagggccagtgaagcacaggcggccttaccttggagccggctccttcgccacttggtgcagcctcagggcccagcagtggcccctctgctgacgccttcttcagctttttgttctttttctctgtcacttcaggaacttttctcttctgttttgccatcctgcaacagagaaagtaaattgctgaagacaaggaaatgaaaggcttaactcatgtaagatttttaaataaaaagaggtagggcactctcccattaaaaaaaaaaaagagtattatggaaaacatataaaagttaaaataaactcaaactcccacatttcataacctatggacaaccaacttgacacattttggtatatttcctttctgtcttttttttttttgagtcagggcctcactctgtcacccaggctggagtgcagtggcacaatctcggctcatcccaccgtcacccgggctggagtgcagtggcacaatctcggctgatcccaccgtcacccgggctggagtgcagtggcgcgatctcagctcatctcaccgtcacccaggctggagtgcagtggcacgatctcggctgatcccaccgtcacccgggctggagtgcagtggcacaatctcggctcatcccaccgtcacccgggctggagtgcagtggcacgatctcggctcatcccaccgtcacccgggctggagtgcagtggcgccatctcggctcatcccaccctgtcacccgggctggagtgcagtggcacgatctcggctcatcccaccgtcacccgggctggagtgcagtggcacgatctcggctcatcccaccgtcacccgggctggagtgcagtggcgcgatctcggctcatctcaccgtcacccgggctggagtgcagtggcgcgatctcggctcatcccaccgtcacccgggctggagtgcagtggcgccatctcggctcatcccaccgtcacccgggctggagtgcagtggcgccatctcggctcatctcaccgtcacccgggctggagtgcagtggcgccatctcggctcatcccaccgtcacccgggctggagtgcagtggcacaatctcggctcatcccaccgtcacccgggctggagtgcagtggcgccatctcggctcatcccaccgtcacccgggctggagtgcagtggcgccatctcggctcatcccaccgtcacccgggctggagtgcagtggcgccatctcggctcatcccaccgtcacccgggctggagtgcagtggcacaatctcggctcatctcaccgtcacccgggctggagtgcagtggcgccatctcggctcatcccaccgtcacccgggctggagtgcagtggcgcgatctcggctcatcccaccgtcacccgggctggagtgcagtggcgccatctcggctcatctcaccgtcacccgggctggagtgcagtggcacaatctcggctcatcccaccgtcacccgggctggagtgcagtggcacgatctcggctcatcccaccctgtcacccgggctggagtgcagtggcgccatctcggctcatcgcaccctgtcacccgggctggagtgcagtggcgccatctcggctcatcccaccctgtcacccgggctggagtgcagtggcacgatctcggctcatcccaccatcacccgggctggagtgcagtggcgccatctcggctcatcccaccctgtcacccgggctggagtgcagtggcgccatctcggctcatcccaccctgtcacccgggctggagtgcagtggcacgatctcggctcatcccaccgtcacccgggctggagtgcagtggcgccatctcggctcatcccaccatcacccgggctggagtgcagtggcgccatctcggctcatcccaccgtcacctgggctggagtgcagtggcgcgatctcagctcatctcaccgtcacccgggctggagtgcagtggcgcgatctcggctcatcccaccgtcacccgggctggagtgcagtggcgccatctcggctcatctcaccgtcacccgggctggagtgcagtggcgcgatctcggctcatcccaccgtcacccgggctggagtgcagtggcgccatctcggctcatcccaccgtcacccgggctggagtgcagtggcgccatctcggctcatcccaccgtcacccgggctggagtgcagtggcgccatctcggctcatcccaccgtcacccgggctggagtgcagtggcgccatctcggctcatcccaccctgtcactcgggctgcagtgcagtggcacaatctcggctcactgcgtcctcaaaattccaggctcaagccatcctcccacctcagcctcctgagcagctgtaaccacaggcgcatgccaccatgcctggctcacttaaatcttctgtagaggcagggtcttgctatgctgcccaggatggtcttaaaccccttggttccagccatcctccgcctcggcctccgcaagtgctggggccactgccatgagccaccatgcccagccccgttcggtcttttttctgagtgtttttatttaacatagctgcaatcatacatggattacatattctatatttctaactggacatgaacacaaagcgtttaagattaagagaaataccatttttagtgacattatcataatttcccaaaggtgaaaatctgcctgctctctaattactgaatattttgaattgttttcactttctcctatcaggctcactcatgctccccatcaactagcaaagctgtggcaccacacgggctgcgggcaccggtcctgcccatcacaggacacctggcaccctcgggtggaggggctcaaggaccaccgtgagtctggggtctcctctgagtgggcaaggagcatggagcaggccacgtatgagggtggatgcggcattcaaggggcatgtggttaggcctcctttctccagcacagctgtctccagaacaccacgccaggacggagaagtccagggacggcagaacccgtgtcctttgtggactgtgtgatgagggagccgaaagaggcagctgaggccaccagacttgggagcctgctggaggggctgggatagcaggccctgggcccctgatggaggggtgctggtggctgtggccaggacctaaggaacaacctggggtggcagcgggcagggacaaggctgcttctaggagggagaagcaggggcccggcccacgcctgctgctgcagcgaagcctcctgcatgggctcactcatgcaggacagcaggagcagaagaagccctcacctgaccccatgcccctgtccccacccctcccttcctatccccaccctccccagggccaccccctcacccacactcctccctacactcctccccaccctccagctcccagtctcctctgccgcccccactgggtgcagccgaaaaggagctgagaacagaaaagtgtcctgcagagccccaggctatgtgggccccgggcgggtgggggcgggggggtgccacagaggtgctggggagccaagagacaggagctcaacaaccagcacacgcggcatgcacgctgcttcaccacggcctccagcccggacggctcagacacacacccacaaaggaccacgtcagtaagccagggaacacccagaaagccagatcccaccccaaaagtaaaacagtccaggcatagtggctcacgcctgtcatcccagcattctgggaggctgaggtgggcagactgcttgagcccaggagtttgagaccagcctgggcaacatagcgaggctccacgtctacaaaacattttttaaaaattggctacgcttggtggtgcacacctgtggtcccagctactcaggaggtagaggtgggaggattgcttgagcctgggaggtcgaggctgcagtgagccatgactgtaccactgcactccagcctgggcaaaagaatgagaccttgtgtttaaaaaaaaaaaaaaaaaaaaaaaagagtaaagcaggataggttacagaagagcagcagtttaaaaagcatgatcatcatggaaagggcctggcagcattgagcccacctagggcccaggtgtggtctaaatacccctcgctgtgaaaaagagtcaggggaggtcaagacaggcctgggatgccaggtgaggccagaaaccaaggagacagtcaaagagcaaaggccctgtccaaaaggcagagcctgcacaagggttccccccatcccactcggggctatcactggtaacagcacattggaagaatattcctattgtggaatcagaaaaccccaagccccttattctttaattgagccttatctttaaaaagcatcagaagccagaggctacagatttcaattagctatgtaataagaaatcttggaagaatgagatactgttgacacaggggctctggaaagacaagagaccatgccagccaattaccttgtgagagaaataagaaaagttcagcaaatatttacacacccattactataaaagttaagtaaaatctatattcattctgtaagttatcatttaaaaacttaatcactatgtctatttgctaataagggataaaagacttttccatattatggaaaggttccttttaatagttctaagggaaagtgactcaagctttgagataatgaatgtttgttatggaaaatgacgtttactttcatttactgtcaactgattttcaacaagagtgccatgacaattcagtgggaaagacaaatggtgccaggacaactggctaccaacatataaaagaatggatttggagccctacctcacaccatacacaaaactaactcaaaatagatcaaagtcctaaatggaagagctaaaagtgtaaaattattagaagaaaacacaggattaaatcttcatgaccttggattaggcaatggcctcttacatatggcaccaaaaacacgtggcaaaagaaaaagagataataaattggactacaacaaaatttaaaatttttgtgctgcaaaggatgccagcaagaaagtaaagaggctgagtgcagtggctaatgcctgtaatcccagcactttgggaggccaaggcaggaggatcacttgaggccaggagttccagaccagtcccggccacacagcaagaccacatctctacaaaaaacaaagcaaaaagaaaacccaggctaggcactgtggctcacgcctctaatcccagcactttgggaggatgagatgggaggactgcttgagcccaggagttcaagaccagcctgggcaacatggtgaggctccatctctacaaaaaatacaaaaaattagctgggcatggtgatgcacacctgtagtcccagctacttgggaggctgaagtgggaggatgacctgagctctggaagtcgaggttgtaataagccatgattatgccactgcaacccagcctggacaacagagtgagaacctgtctttaaaaaaaaaaaaaaaaaaaaaagacaccacccatagtattggagaaaatacctgcaaatcacttatctgagaagacactagtaactagaatatataaagacctctaacaactcaacaacaggagacaaataacccggtttttaaatggggaagggatctgaagagacgtctctccaaagaagatacacgaatgaccaacaggcacatgaaacacagctcagcatcgggtcatttaggaaatgccaatcaaagagaaacgaacacatctccataaaaatgtgtccaatgatgttcacggcagtatgtgcctaatattcaagcggtggaaacaacctccgtgtctgtgcatccatggacgaagggggaaacaagacgtggcgtattcacacaggggatactattcagccaccagaggaaatgggatactgacatgtgccacaagacaataaacccagaagacactgtgccgggcaggagaagccagacgcccaagactccacactgcaaaattccacttctgtgaaaagctcaggatacgcaaattatactgacagaaaggagatgagagattatttagggatagggcaagtggagggaagagtgggtgaccactaaggggcacagggtttcttgtggcagaaggaaaaagtcttaaaattagattgtggtgatggtttcacaatccctcgatatactgcaaaaaaaaaaaaaaaaaaaaactataatccctctcaaattatttaccataaatttaaaaatgtaacacccaagtgcggccaggcacggtggctcacgcctgtaatcccagcactttgggaggctgaggcagatggatcacgaggtcaggagatcaagaccaccctggctaacacagtgaaaccctgtctctactaaaaatacaaaaaaaaaattagccgggcgtggtggcaggcgcctgtagtcccaactactcgggaggctgaggcaggagaatggcgcgaacacgggaggcggagattgcagtgagccgagatcaagccactgcactccagcctgggcgagaatgagactccatctcaaaaaaaaaaaaaaacacccaggtgctactttacgataaataaataaataaatgggagaaagatcatttgctataatgtttgttgtgagacaaaatttaggctggaacacagtggcataatcacagctcactgcagcctcgaccacccaggctcaagcaatcctcccaactcagcctccggagtagctggcactacaggtgtacaccaccacgtagctaactcttgtattttttgtgggaatggggtttcgccatgtttcccagactggtctcaaactcctgagctcaagtgatcctcccaccttggactgctgggattgcaggcgtgagccaccacacctggccccaaaatatatatatatatttttttaattcgctgggcatggtggtgcgtgcctgtagtcccagctacttgggaggttgaggcaggagaatcacttgagcctaggagttcaagggtgcagtgaatcacgatcacgccatgatactccagcctcggcgacagagtgagagactgtctcttaaaagggtggggggcaaggctgagcgcagtggctcacacctgtaataccagcactttgggaggccgaggtgggcagatcacctgaagtcaggagttcgagactaggctggccaatatggtgaaaccccatctctactaaaaatacaaaaattagccaggtgtggtggcgtgtgcctgtagtcccagctactcgggaggctgaggcaggagaatcacttgaaactatggagattacagtgagccgagatcgcgccactgcactccagcatgggtaacagagtgacactgtgtctctaaataaataaataaataggccgggtgcggtggctcacgcctataatcccagcactttgggaggccgagacaggcagatcacaaggtcaggagatcgagaccatcctggctaacatggtgaaaccccgtctctactaaaaaatacaaaaaattagctgggcatagtggcgggtgcctgtagtcccagctactcagctactcgggaggctgaggcaggagaatgatgtgaacctgggaggcggagcttgcagtgagccgagatcgcaccactgcactccagcctgggctacagagtgagactccttctcaaaaataaataaataaataaatacataaagagtcatctacctgccctgtctctgactcctttccttcccccatcccatcaggcttttgccccaaacaccctaccacaatgacacccacgtggctaaatcccattgccaactctcagtatgcaacttatttgacctaacagcgttggactgttgatccttccttctctcttgacaggcatttttcacttggcatccagcacagacagcagaacttctgcttttgctcccacctcttaatcgccgtgtccttgaacactgaaggacccaggcttagtgctcagcctcctcactccctcgtgatcccattcagtcatgtggcttcaaataccaactagacgctgatgactttgtttcctctctttacagtctcttattaaccctctccttcaactacacgccaactcaactgtgtatatatatagctatagttgtatgtatatacatatagttatatatatatacatggtcatatatgtgtacctagacatatatacacatatatatacttgaactcctgacctctgtttacactgtttatacacatatatctacatgtgtgtatatatatgtatgtgtatggccgggcacggtggctcacgcctgtaatcccagcactttgggaggccgaggcggggagatcacttgaggtcaggagtttgagaccagcctggctaacatggtgaaaccccatctttactgaaaacacaaaaattagctgggtgtgctggcacctgcctgtaaacccagctactcgggaggctgaggcaggagaatcgtttgaatacgaggtggaggttgcagtgagccgagatcgcgccactgcactccagcctggacaacagagtgagactccacctcaaaaagaaatatatatatatatatatatacacaatttatttatttatttatataaaataaatatataaatatatttacataaatatgtatttatataaatatataaaaatatatatgaatatataaatatataagtatatataaaaatatatataagtatatataaatatataagtatatataaatatatataaatatatataagtatatataaatatataagcatatataaatatatatataaaatatatatgtatatataaatatatgtataaatatataagtatatataaatatatataaatataagtatatataaatttatataaatgtgtatataaatatatatacataaatatatataaatatatacataaatatataaatatatatacataaatatgtataaatatacataattataaatatatacacaaatatataaatatatataaacatatataaatatataaaatatatataaatatatataaacatatataaatatataaaatatatataaatatatataaacatatataaatatatataaacataaatatataaatatataaacatataaatatatataaacatatatataaatatatataaatatataaacatatatataaatatatataaacatatatataaatatatataaacatatatataaatatatataaacatatataaacatatataaatatataaacatatataaacatataaatatatataaacatatataaatatatataaacatatatatgaacatatataaacatatataaacatataaacataaacatatataaacatatataaacatatataaatatatataaatatataaaaataaatatatatatgcggatgtgtgtataaactgtgtatatatataactatatatataaccatatatatgtacttatatatatcatctacacatatatcatctcaagcttaagaattcgtaatcaatacccctgatcaccctccacaaacctgagcttcctagtgttcatcctctccataaacatccatctgatgaggttcacatagtagctcaagcttaaaaccttggtccatccataaatcctctctttctcacatactcgtccaacccaccacaaactcctgttggtttaccactgaaatacacccagaatgtgactcccttaagatcccataggtacccagtccaagccaccacctctcacgatggcttttaaactcctaaatcagatggtgtgtcacctccactcaaaaaacttcccaagctgtccccttccacttggagggaaagtcaaggtccttgccacttggtaaggtccacacgactgccctggcccctcctcgcatctctgggaactcacctcctctttctctctctgttcccaaattggctgcagccacactgggctccctgctgtttcccctgcacctgctgtttcctcgacctggaatgttctggtgcctcactcctcctcctgcttcctttccattctcaaaacccctgttctcatcttctccatggcacttaccatcacctgctctgtgcaccttgttcatctgtctctcccctccagaatggaagttcactagatcacagacttgtctccacttgttgacagctgtagcccaatgccccgaacagtgcaggaggaacccaatgaacgttttttaaaaatgaatgaatgaatgacggaaggaaggaaacggaaagcatgcttatgatggaaagtgaggccaagcgcgttggctcactcctgtaatcccagcactttgggaggccgaggcaggaggatccatcgcttgagcccaagaattcgagaccagcctgggtaacatggtgagaccccatttctacaaaaaacatttttaaaaattatccgggtgtggtggcgcgcgcatgtggtcccagctacttgggaggatgaggcgggaggacggcttgagcccaggaggtggaggctgcagtgagctatgatcacgccattgcactccagcctgggtggcacagcgagacactgcctcaaaaattgaaaaagagaaagtgggagctgaaagcctcggagggcaatcagggcgtcttcagagaaagacaatgaaaccagagccactgcaagccctgacggcctgaaacctaggagccagctgagtcccttccactcgcccgcgctgagttaacccagaggcgggtgcgggtgtcggagcccgcgccgggacgcaccggccgcaccggccgcaccagcctccccagcaccgcggaccccagggccgccgcccggtcgcgccgcgccgggcctccgcgcacccacgtggagggggcggagccccgcgggagcccgccccggggctctgggtctcctggcgccctgacccgccggccaccccgccgccgccccacgcgcctacctgcgcccacctgcgcccacgtcgcccacctaagcgtgaacagctgcgtcgcggacgccgccttccggc

SEQ ID NO: 1011 - DNA, 141271 bp, Homo sapiens; identical to SEQ ID NO: 1010

SEQ ID NO: 1012 - DNA, 141271 bp, Homo sapiens; identical to SEQ ID NO: 1010

SEQ ID NO: 1013 - DNA, 446769 bp, Homo sapiens
tcatccacaacatcccctttttattgatattaatcacagttatgaggtcttgtccatcagaaagcacaatttgcattatgtagaactacatacaaagacataaaaataaaacatacatacaccaaccaccacaccagttaatctcaaccaatcaaacctctgaatgtgtcttcaattttgatcatcagtgcttcggaagaacgtacatagacccagcccaaggttggcctttggggtctgatagcattcacagagcaggagattcacccttggaagcaattgaatgtgtaaactctgagagcagacactgacaatgcaatgcctgcatacctgactcctgggctgccttccttctcagcagagcccactgaaagtctcacgtgtgcctttaaccaatgaggatggcaggccttatctgtgtttgaagtggacaggtcattgctacccctgttggagaagctatgtaagaaggagtaggctggcttctggtctagttcgactcattctttatagggacatttcagaatgatgagttggctaaaatttactttaaaggggaaatgtaaaattacctcttcttttcctatccccttcttcctttcccatcctgagccctctggcaaggcctgttgcagctcaagagtttttgtcagattataagttaccaaatggtcaacagggaaggacccacagcagattccaaaactctttcattcacttgagttaactgaaatggctccttctttgagtaattgaagagtttgagttctagcagtttgctggtgtctccaagtctcttagaaacatgatggctataaacttatcaaaataaatgcctaagaaatttggaaagcgcgacaaatggccttgctcctggaatccattgacagcagaggcctccgaacaaacccacactctgtctgtctcttctttccacagggctcactgtgagttcacagttgtcctcatcccctttccttcaataatgtcaatctttgcctttaaaaaaaaaaaaaaaaaaagccagactagccaatttccttccctttttctgtgtccccctcccatgtagtatctccttagggggaggtaaaggaagacatgctcctctctgggctggctcggccttggaaggtagcttgctatctttatgatgctccagttccaacattctagatggggagaggctcagcagtgatggagcaggaggggcggatgagaggtgtgctggccactctgccctgagtcactaggccaccaaaatgcttaggagacgtcttttggtagctcgcttctataggtgaccttgaggagttgggaggcagatagaaggtcccgaagtggagatttccctgatctgaagttccttgataatcccactgaagagagagtccattcagtggccaaaacaaagaatctgtatttccatgacaccttaaaattccccattaaatcaaaaatctccctcaaagcaaagtaaaaatggttctattataatcagagtcaatcaggataatgagatgaagaagagaggaaggaaaaaagttttaatgtgaagaaagaagcttgttgtcccatagaagccaaccactgctgtttcttcgtatggcctttcccggggtccgaagcgtctcagccctagcccaggccaacgtccagtgacatcatcactacaaatcccaggatggaggcccaggatgccagtttcccattaccactggaagagaaggacaggaagaaaagtaagaccttaatgatccctgaggccacggctaggctgaaggcatcctctgcaatgtccaattccaagagaaagcacactaccattaataatggtaacatttactggggcttactatgtgccaggcaaactaatgaaccatggaaccccaaacaacaacctcatgaggtcagtatcataattatcctcattttactggtggggaaactgaggcaaagagaagttacttgcccaaggtcacctatgatcgttctgtggtccatgtgtgagtaatgaagaggggtgattatttcttaaagatattacttaatctggccttttaaactagcctcagagttattcttctataaaaaccaaaataggctgggagcagtggctcaagcctgtaatcccagcactttgagaggccgaggcaggcagatcacctgaggtcaggagtttgagaccagcctggctaacatggcgaaaccccgtctctactataaatacaaaaattagctgggcgtagtggtggttgcctgtagtcccagctacttgggaggctgaggcatgagaatcacttgaacctggggggcggaggttgcagtgagccgagatcacaccactgcactccagcctgggtgacagagcgagactctgccattaaaaaaaaaaaaaaaaagaaaaacaaaacaaaacaaaacaacaacaaaatggaacaaagcaaacccttactcccaccttctgacacctggcctatagctagccagtgaagacatgcatgtatcaccttcactgacattttagagctcacctctcccttcattccagcccgagaatcgagagacaggatgagagagaatatacaaaaacgatagtctactgcatcaagggacggggggcaggtgtgtatgccactgcctggtgtcacctcatttcttgacccacatgcccttagcttcttttcttttagtttcagagagcacagttgaggaggcagtggggatgatcttgggaaggggcagagagggggagggaataaggaaaggaaaggcaaatgaagaaagagcatatcccaaggctggggtcccagctgggactgggacagggacagacagggagggaaggttctccaacctgatctgggcttcggggatgatgtcgtccatgaccacgtagaccatggcaccggcagcaaaggccagagcgtagggcaggatgggctcagccagcaccacggcaaaggcaccaaagaccccggccaggggctccaccatgccgctcagctgcccatacctaaggagagaacagagacatttaccaccgcagggggaggcaagcagacactccacgtgcccagactgttggctcaaccctagcacatggatgcatgccattctacgtcatatctgagcatggcagtgcaaaagcacatcactgttttgttgaaagaagcccacatggaggatgctgtgacatggccttgcccttgggcagcactcaccagaaagctctccaggtggagaagcctgcccctcgcaagggaaggctgacagccaggccctcggggaaattctggatcccgattccaatggccaaattcctgaaaaaccaagaaagcacatgaaggctgctgtctggaataggtgctcacacaatgggagtccctggccgaggccaagacctccgtgggtgctaggaagccaggaggagacctgtgacctgcagtaggagaggaaggagaaaggtcaggacgtgtgtctaggtaaagagcaggggctgcaggagggagtgacgtgagccctctacccatcatgctgtcctgggtcctgggcaggctctgtccttacaatgctttgctacagcacagaacacactggctggctctcagggtgccctgagttctgccacgtggctgtataactgcacttttcattttactttctacgcctctgtttctttttctttttttctttttctttttttttttttttgagatggagtctcgctctggagactccaggctggagtgcagtggcatgatctcggctcactgcaacctccacctcccgggttcaagtgatttccagctaatttttgtatttttagtagagatggggttttaccatgttggccaggctggtctccaactcctgacctcaagtgatctgcctgccttggcctcccaaagtgctgggattatgggcgtgagccacggcacccagcctacacctctgtttcttgtatacaatttagggacaacaatatctaccataaaggattgctgagtgacccagtgacccaataatgcctatcacatcctagcatagagaggtgcttaatgcattttggtttctattctgttacagcacagaaatgagtatatcacattttattcagaggccacttcagaaatgggacaaggaagtgcagctgcagacgctgatggtgccacagatctggctctgggctcagcttctccgtgggctctgcaggtctggcaccatcgctgcatttctttgggccccagtggtgctcacagtgatcctctcacctcctgcctctgcaggacagtgacaggctgtgctgatagatgcctgtctttgagaagctgctttctgcacaaaccaggcattggagtgtgagaggagggagaagcaaaatgggatgcgtacaaatgcaatctgtgaccacatgcctggcctcagggggcttagtatttagccatggagacaacacaggcatgtacatgaagaacccttattgtggatgctgcaaactacagcaaatcagccaaaagtcaacttgcacaggaaacagaggcatgagggaagcagaggagggaaatggggccagtccgagtgccttaggaaggcccttttgcacgtgagactctaccttggccggacagttccaagaagcagcccctccatgaagggccatctgatcaacaatgatctaaagggcgtgagaagagggtgccactcggcaagcaatgctggtgtgtggcccgagggaattgtgggtagattagatagagaagagaaactccaccatcaccgactttcaggtcaactggctcacgtccatccatcttgctgccaataggaatctacccattgctgcaagggagtgttgtagactggtagctgggacccctgcctatgacctgccccaggctcccgggactgggacacactcgtggccctgaaggtcctgtcaggcctgatccggctgaggcccaagttccagcctctaacaaagaacaccaaggcgaatccccagtttagcatctgacctccattttgtttcagggtttggcctttaccctgttttttttacctttatcccccaactcctgcacatgtttcattgaggttcgtagttccagatacctcaggaagaagtagcccccacctcgagtctgccagtcaagtagactcttaggaaaagtccagccctaacagaatctcatacctgtcaccacttagctcacatgtggttcatagaattagtgcccatccctttttgacaagattacaatgagcccctcagcatctacccatcagcttaaaatctgcccctgtgtgcaacagcgttgagagccactggcctaagcaggcatcatgggaggtgaggatgaggaaagcagtcaagcccacccccctcccaggagccccttccctgctatcccaattcccaacacaggctgggagccgaggacacctgtggccactactgaatgcatcaggagcctgcagcccagggtgcttactgtatacaagatctgatgtggagagctctggaggagatccggagcaacacaggacaggagtaacaaaacaggtggcattaggggacatggatatgtaacagaagtgatggagaatagtgagcaccccgtggcagggatggtccccctagggtggggttgggggaagaagccctgagctgacttaggagctgtggggcctagactggctgggggtgggaaactgtgaagagggacaaagcagcttccccagggggcatctgaaaagtgatagcatccgaaaactgatcagttccttaataaaggaaatattatggtctcttgggactgacagaagcattgagcctgtctctccaacctgcaggcagaactgttcatgaagtggagtggacagacaagaagacaccccaccacaccagcccaggacatgtccacaaaagctgcatcactcagcatttcccacgagtctacccaaatccctgtctatatcacccaagtttgtgctctcctttgactccttagagaggggctcaaacatgctccaacttcatccctggatctagggggcagcaaactttttctgtcatgggccagatagtaaatatttgaggttttgcagtccactgagtctctgttgcaaccactcaactctgacattgcaggtgcaaaagtggctatggacagtacataaaccattgagtgtggctgtgttccaataaaactttatctacacaaatgagtggggggccagatttggcccatgggctgcagtttgctgacccctgccctgatagctcagtggctgcagaaagatctggcaagatgaaaccacagaccctgggcattgcagaccctatctcttcttatgttctcatggccatgcatgtggtagttgaagtttgggctttgcagtctgacttcttctgtccaaatcctgggtctgtgctttgttagctgtgctactttccatttctccaactgcagaatttgaagaacaatacccaccctcacttcacagcgttgctgatatgattacctgggatggtccctctcaagcccttagcacacgggagctagtatgcagtaagcacgtaatcaatgcctgtcctggggtgagggtgagtgttatcactgaggttgcagcgtgaaataacagagacagggacttaaagcttttccaagaactcatgcgtcctctttccaagagagactaagattttctaccctaaagccaaaactcattcctctgcaaagctctgtttcaaagagacctggcttggctgttttgcttatggctcatctatgcttgagtttccatcggcactcactcatttgctcttgttgacacttgtgtgagatttttacatcacttgtaagattttggtgagaaccactgtgcaacctgaaggcatttcagatactgtgttcctatatactgcttggtctgtttgggttgtacagaaactcccgggagatgtggattcttgcttctcctaggctggcacatatagaagaattccttctatcacctccagacccccctgagccccagtaaatgtctggaggctggacgcttccctgggcacagaggaggggagagctgctggaagggagtagggggcattctgatgagcctggtgggcttgactcttctgttgcacgctttttttttcttttttttttttgagatggagtctcgctctgtcatccaggctagagtgcactggcacgatctcagctcactgcagccttcacctctggggttcaagcgattctcctgcttcagcctcccgagtagctgggattacaggcatgtgccaccacacccccctattttttttttgtatttttagcagagacagggtttcagaatattagccaggctggtctcaaactcctgacctcagatgatccacctgcctcagccttgaaaagtgctgggattacaggtatgagccactgcaccctttttttttgttttggtttttcttttcttttcttttctttttttttttttgagaaggagtctcgctctgtcacccaggctgaagtggtgcagtggcgtgatctcagctcactgcaacctccgcctcatgggttcaagcgattctcctgcctcagcctccccagtagctgggattacaagtgcccaccaccacgcccagctaatttttgtatttttagtagagatggggttttaccatgttggccagggtggtctcgaactcctgacctcaggtaatctgctcgactcggcctcccaaagtgcgggattacaggtgtgagtcacctcacccggcctgctgcactttaaagtatggaaagctccattggataattgagccctgggggtcacctctgaagattttgtcctgggcagctggggacagttttacacttccctgagaagtgcttctaggaggtgaggccctgggcaggaagtcaactgtagcttacatatcctccacatagtcttgatctgtcctagttcaacaggagagaaggatttggagaaatgagacaggatgaaaaaggaaatctagctacagatgtttaggaaaaaggtgtcattctggtcccttgtgtttaaaatgtgcgtgtgtgtgcggaagggtggggcatggggagtgagcgggtggccctgcttagccatcttgcttttccttattttctgggtccctaacatgtcttcctagccagtctataggggcaggacaaaagggtcaggagctctcttcctcaccttgaaaggtcctaggctcccctcttctgctgctctgccagggagggtgatgggtgccgcttctggcattgggtataggatcggagttaatggcctcacttcttccctctggggccccaggcctaggactcgaaagctagctttggaagacactgttgaacgttgcttcagttataggatgctgacaagcgtgttctaaccagccctgggcagaaatgcggcctgttctcgcagcttctgctaccaatttcatgtgcaagctgaccctgagctcctattccaggagttggagacatgtgaatatatttatgttgaggacaaattcttaaggataaattcttgccaatatttcataagcccctgccccgccttcccagatagaccctcaggggggccccttccctgcgactttgttcagcatctccttgtagccctcaaaatggttgagtgaatacaaccagcttccttgaccttttgcaaagtccgaagtgcaaggtttctttccaatgaggaaggccaaggcttctgatatcttgggctttgccaggcacttggtggctggctctcagtccgctgccattgcctgcacctcatattcacaggcaggcacacgaaggtagccgcagagtgaccagcccaatgtcactgacaaatcagaggtggggctccccatccaaagtcctcgccgtgacatagcgctgactacagccatcgcccggcgggctgtgggagcctcctccacatcctgtctgggagccaccatcctgataagcagcacagaaaccccattcttccatccctggcaagcctcgttacctctgccttgccccagccctggcacggggctgccagcccaaacagctgccatgccctctggatcctgccaggcctttctcagcagggcattgcattgctgggcggtcagagtccctcctgacactcctgggctcctttgctccccagcaggggctggcaccacagtttctctgcctttcctacctgtcatgcacaacactgcctaactgggctctcctccacacacccgtgcacacgcacaggcccatccaagttccctcgccccgctgcttgttgggcattggtcagaggcccactggtgggggtggcccagtggaggacacagtcccttccagccctctcctcttcttcaatcacctgcatcagctccagagtgggatttgaatccacggctctcagacctgacgacacatgccagtcacagggagcaccggcaaatgccgatgcctcggccctgccctggagatctcggtttattgccgtggcattgggccccctgtgtgcagattttaagagtgtgcgagggcgttgagagccactggcctaagcaggtgtcagaggaggtgaggatgaggatggaggccaagcccgcctccctcccaggagccccttccctgctattcgaattcccaacacagtctgggagccgaggacacctgtggccactactgaatgcatcaggagcctgcaaccggggtgcttactatatacaagatctgatctggggagctttggaggagatctggagcaactgagggcaggagcagcaaagcaggtggtattcggggatatggatgcataacagaagtgacagagaatattgaggaccccgtggcagggatagtctctcagtggtagggggtgagccgtgagctgacttaggagctgtggggcctagactggctggaggatgggaaactgtgaagaagaacaagggcagcctcccggggggctggtggcgtggaggatgccccaggctcaccagctcccctcctgcagccctgctgtgcattcctgcaaggccttcagtctaactaaacactctgagctgacgatcctgggcaggtggggttggtgggccattccctccctcctttacgctctgggaagggaaaggtcagatgagaggtttcctttccaggatgggccatgaaaattcaaaacagcattcaaaagccacggggaaaatacaaacccatgcccttctgaagacagtgaagctgctgtcttctgggttctgttcctccccagcagtagcacaaagacactattactagtctggaccacgacacattaatgggaaggagagggaagtggagatgaagggctcttttagaaaagaaaccgcaggctgtcccctgacaaggtcccttgtcccttccgtgacaagccaagtcccatggcaacctgtcaccggagcctgactgagagcaacaaggcagagatctctcgagaagggccaggagaggggcatccgtgtgtagagtgggacaggagaggagagagggagcgtggaaagggaaggagacgggggaggcgggaagggagggtcgacagggcagggagtcattggggaggaggatgactcctggggttgggctgcaccagcaaggacaagagcagccctgacaggcctctcccggggaggtctgtctgcaggggctgcctcatggaggcagagtttgcctcagggcatccagacttctcttttccttttccttaggaatcagaatttgctaggaagggacaaaaccagagaaccgcgaggaaggggggtcccatccagcattgggggaatcagggtttatttttaaagttcatttcctattatatgtttatttttattattttttttaaacatcgaaggccgggcatggtggctcacacctgtaatcccggcactttgggaggctgaggcaggaggactgcttgaggccaggagtttgaccagcctgggcaacatagcaagaccctgtctgtatataataaataaaaataaataaaaaagagaaaaaagaagaacagcaaagaacacaattatcaggcatatttcaaaatcattcctcaaaaaaataaataaataggccaggcacggtggctcacgcctgtaatcccaacactttgggaggcagaggtgggcagatcatgaggtcaggagttcaagaccagcctggtcaacacggtgaaactccgtctttactaaaaatacaaaaattagccaggcatggtggtgggtgcccgtaatcccagctaccaggggagctgaggcatgagaatcgcttgaacccgggaggcagaggttacagtgagccgagatagcgccaccgcactccaggctgggcaacagagtgagattctgcctcaaaacaaacaaacaaacaaacaaaagataaataaataaataaaaataaacatcaaggaggagcagagatggaagagagaatggcaagaaggaagactacagaagatcacttgactgccctgactttgggcaggagtgagtagcaatggtttacctcattagaatgtacaggccaatatgttaagaggtcagaattccctgaatacagtgtcccttttgggacaggaactagggtgcccaaccattccggttcaccagggactgaggggtttcccaggatataggacttactcagtgctaaacctggcacagtccccagataactgatgtgagttggtcaccctcagaagtagtcagaaacagggtaggtggcagaggcaagctagggtaagaattttaattttccacaggggatatatacagaatcctacaagctaagcagatgtttgaaaaagtaaaaagccctacctaaaactcgcaatggtctgatgcaaattttgaccgcttttagccccttggatctactgccctctagagagccagcttccctgaaaccctcaccagccccattgatgctgggtgggtccttgcgggctgctgtctccagcccagccctgagtggcatccaggaactgggcaggcacggcagaagcagaagggatggcctccctgtagggacagcagcagacactttgctttcttgggtagggacataaagaaacaattcaggctgcttaggaaacccccagaggtgacctgtaaggaagtggggaaggcgctgggcctgagcacaaataatgaatcctagaagatggaggggggctgggcccacaaggggtgccaagggagtgtaggcgggggaaaggtgcccattcatgggcttggcctctccgtgggctggatgcaggggcagaggcggacagtctgaggtacttttccagaggtctctcatcctttgctcttccaacctggtagaggctgagggccaatggccagggtcccatccgggtgctaggtaagaagggcctccctcctcgtatcttcagggaacactaatcccaagcagtgggcaacaggaagaaaggcatccccggtgggcagttgtttctgctttttcttagaggcctgaccctgtttcgccccaggggctgacttctcttctccagcatcctcctcctactaccccccacccatcacccatgttaaaagttagggcccttggaggtcgcctggctcaatgccttgattgttaagattgttaaggtagaaaaaggagatgcagacaagtacaatgcctttggaggccctgtgatgtgtagtgccagtcaaacatatgagtcaaacacatctgggtgggaccccaggtgcacaggtgggacccagtgcaagctacagatcactcagcctttcctttaactgaaaaatgggcataaaactcccccaccgacagggctcttgtgtggatggcaaatgatcactgtgaagtgccaggcttatctcggagcccagagtgggtgctctttaaatagcagccactgttaaaactgcccgaggctgctgaatgaggcggtgatgagctgggcactgaagcctcctattccccccagactggtgacctcccagccacacaccaatttcttctacaaagggtgtgccttagccttctcaattatacgacctcctgggcagaaccatgtcctgcagtggcaacttggccacctggaagcctcttctcaggagtcactccagagtcaaccgctaagccctggccatgtgcaagagctcatgccacatatgaagaaagacatttggaaggtccctgtcttcaaggaacttataatctgatacacagcaaaagacctgcctgcaaatgactccagcacagcacgggacttgctaaaggccataagatctagcacagagcattaggggcgaggatgattttggcggagacagatgatccaggaaacctttgtggagaaagcaacatccaagatggactgtgaaggatggggacaattttaatagataaagatggggaaatgcatttcatccagaaagaaggaacagagaaagcaaagatgtgagatgatctggcggggtgagctaggtcttcctttctctccccttctccaagtccaagccaacatacaaacaaaaataaaacatgcattcgagccaaggcctatctctcttacacgtgtcctctgtgactctttttttttttttttttttttttttggagacagagtcttgctctgttgcccaggctgaagtgcagtggcgcgatcttgggtcactgcaacctctgcctcccgggttcaagcaattctcctgcctcagcctcccaaatagctgggattacaggcacctaccaccatgcctggctaatttttattttattttatttttttgtatttttagtagagacagggtttgaccatgttggccaggctggtctcaaactcctgaccttaggcaatctgcccgcctcaggctcccaaagtgttgggattacaggcttgagccaccatggctggccctctgtgattctttcttagctgaacctgctggatttttagggaaaacctgagtgttaaacaccccagccatacctcaggtgttttccaaggccggagtgcgaagtaccaccccaggggtccctatactatctttgggaggcagatgcctgtgctgagtgagttactcaggggtgttcccttgaaattcatttattagccatctccactcaaacctcaatgtctcaggccttgagcttgggaaatgcttccagctcgtgtcagcagcagcacagagcatgtgccaggagctgtgcacagcactggagaccccactgcaaccgcctgcggttgaaaccagctcaagtctttcattaccgcacccatcagaggcagcccgaggtcctccggctagaataaaaatgacgataaccactgctgttatttattgagtattactacgtgctgggcgtgcttgtaagcatattacatgtaacaacatgccttgcccctcaaccacctcatgagcagctttcaccattattcccattttacagatggagaaattgatgctcaaggagttaaataactggccctgaaggttgtggagctgggaagtgacagagcagggcctcctaactgctactgtgtacacataccgggttttctgggcctcatgcagacccatcgaaccatatggagataggggcggacgctgcccgacacccacttggctagtgagctgaggttctggcctcttctggtcaacagggagggcaggccagactcagggggtttcgagccagagacctgcagggtttaatggagtggaacgtgccatccacagcgggatttctcaacctcaccactactgacatttcacaccgtgagttccttgttgtgggggcctggttctgtgcagtgtaggatgcttaccagcatcctcggctcctatctgctagatgccagcaacaacctctcagctgtgacaaccaaaacgtctccagacatggccaaatgtctccggggagggggaggggaccaaccctgattgagacccactgaccttgagtaaacatgttagatgagcttgcttccttagcaaatagctggacgacaaaaactgctcagactgagtgtggagaacacctgatctcacgcatctcatttgagaatttctagcctcagtggagtgcaggcttctagggaacttagctatggcacgacagatttggggctgagcaaccacctttgagaaccaccaggcctcagctcccttagtccaaagccagtggtcactctcaaagctcactgttgcacaattccaggggtacttttcaccttgtgttctctgaccatggcgccccctggagttgtgcagtgggacactcctgcttgagcgcagattgctgctcagcctggggtgtagttctggggttcgaggtgcacgctctcaggagaggtagtggagagagtcatgggtttctctgagaattggcaagcgaagggacggcaacctgcagccttgctctccaggctatattccctggccggttgattatgaaaggagaatggcatatccctgacaagccctgcttcaccccggctttcagatcctcccatgtgcgatgagcgtgtgtgttcttgtgtggcaggcccttacatactgttttgattgttatcatcttgccgtgaaaggcctgattgttcaggcctggagatgacatcaccggcttcccactagggcagcctgtcgaggtgtttgatgagcctgcaggtgggaaggggctgggtactccccgcagggctgcccggccctacctgctcagaggagctggcttagcacgcaagggatcttcccccaccctcttggtgcagttctcggaaacttcttggtgcaggctggcgagatgagatgacccatccattcccttacagtctgctgccttccttcgagggggtgaggaagagcccaaggaagtcagccggaaggcagggtggtggctgagggtgattcaggccaccactgtgcacttctccctgcagaagtgtagacaaaccgcccacatttctatgggatcactgactcccagaggaatgctctgaagaccttcacctgctaagtgtcccagcaaagcaaaccaatcctatgggctagccaagtatgaggctgcctcatacaatgtggtgggggcacacatctgagagcaatgtgcctctgtagccatcaaaagacacatcttaaactgggcgcagtggttcgcgcctgtaatcccagcaactcaggagatgggtgggaggactgcctgagcccaggagtttgaggctgtagtactatgatggagccatggcagtccagcctggactggccaacagaatgaggcctttttttagaaagaaaagaaaggaagaaagaaaagaggaaaggaagaaagaaaagaggaaagaaagaaagagagagggagagagagaaaagaaagaaaaggaagggaaggaaaagaaaagaaagaaaaggaaagaaggagggaagaaagaaaaagaaagagaaagaaagaaaaagaaagaaaagaaaaaaaagaaaaaggaaggaaaggaaggaaaagaaaagaaagaaaaggaaggaaggagggaagaaagagaagaaagagaaagaaagagagaaagaaagaaaagaaaaaagaaaagaaaagaaaaaggaaagaaaggaaggaaaaggaaagaaaaggaaggaaggaaggagagaagaaagagaagaaagagagaaagaaaaagaaaaaagaaaagaaaaaggaaggaaaagaaggaaaagaaaaagaaaaggaaggagggaagaaagagaagaaagagagagagagaaagaaaaaagaaaaaaaggaaggaaaggaaggaaaagaaaagaaaggaaggaaggaaggagggaagaaagagaagaaagagagaaagaaagagaaagagagaaagaaagacaggcacacacatcctgggagtgctgttattcatggcagtgctatcaataatagtcataaactggaaaccatgcaagtgcccctctacaacagaatgagtaaaataaactcattttattccttgtgttctattcacacaatggaatactgtgtggcaataagaatgaaaggtttatacctctgtgtgagtctggagccacgtcacagacacaattctgagtgagaaaaactagacacaaaatagtaagtgttgtacagtcctatttacacaaagtccccaaacaggcacaaccaagctatgccttcttagctactaatttaatggccattagcccattggcagtttaatttgttaattctccttaacatatttgaaattttacaaacaacacgtttgagcagaaaccgacaactctctaaaggtaggatttcagttcctagggaggagtcatatttttgggaaaagagtatcttcccattacctttttaaaaagatattttactgcagttgaatgtatgttcagaaaagagcagatccgcctgcgttgtacaggataacgtttcagaaactaagcaaacccatgaaacccacatcccgatcaagaaacggaacatcaccagcaccctgagaccccctcaatcctgggctcctgctcctcatgggcctctcctgaaggagaatcactatcctcacttctaacagcagagcctagttatatgtgattttgaactttatatagatagttgaggcagcagtgcaaggccccagaagaggatcgcctgggggtctgaatgatgagggcctcagtctcatttcctgcggacctggcatgtggacagtctccttagatcatgagtttggacatccgtgtggggtattgcctcaggatatgaacgtctgtcccgcgaagcatctctcactccagtttcttattcacggagggcttcagcctctccatctgcagcaaacacatcaggggaggagatgcaaccaaaacatttagttccccagctctcaaaatactatcgcaaaccactaacaatgtttccagaattttagtgctttcttcttgagagcttgtttggaggttctagcaggggagcgcagctacttgtatacccttgaccgaagaccggtcctcctctattggggatggtcgtcctcttcaaccaagtgcacagcttcgggagggacgcacatggagcggtgagggaggaaagggacacccgcctagccagccagatcagccgaatcaaccctggcaatcaatggagtgacagatgtcacagccagattgccctcacatccttagtgctttcttctaaggagctttaagtgcctttataaacagttattatttctatgacagaggaggtccattttctattttgtagatgtagtaaccaaggtccacaaagggtaagccatggactgaaggacacgccgtgggtccctgcagtgagggaaaggatgctggatgccaagccctcttccatacctcattgctccacataaaactgcagaaggcagggagggaaagtggtcagtggcagctttggggaagaggagaccataaaccgtggtgccattcttggctactctctgtcacaccttatatgcaatttgccagggaaaccagaggcggggatctacctttagatctgatgagaatccagccacttctcccctcttccatggctatactaaggtgcaagcctccatcatgtccttcctgggctacagtaacagcctcctaaccagtctccctgcttccacctttgcccctataaactctattctctgcaaatttgctaagtctgattatgctgctcctgtgttgaagacactgcagtggctccccattccactcagggccagggcccacatcccctgctggcctgtaatgacttacacattcatgccctccgttctcttcttctcttctgatttatcttctctccattctctcttctctccattcttttctccctccattctcttcttctcttctgatttcttcttctattgatctcttcctagctccagctacaccagccatctggtctccttgctgttcctccagaatgcctggttacttctaccttggggcattttcactggaacattccttctcagttatcagtggctcatttcttcaactctttgaaggcaaggccacaggaccttcccaaggccagatcataaaaggcttgtagcttctttctctcttctctctctctggactactagctctgggggaagccagttgccatactgtgagaatattcaagcagccatgtggaggtgcctacatgatgaggaactgagacttcctgccaacagccatgggagtgcgccatcttggaaatggatccttcagccccagtcaagacttcaggtgactgcagccccagctgacctctcttgattgccacctcatgagagaccctgagccaggaccactcagcaaaaccactctcagattcttaacccataaaaaaattgagataatctttgttggtttaagccaccaagttttgaggtgtttttttttttttttttttttgagacagggtcttgctgttgcccaggctggagtgcagtggcatgatcatggctcactgcagccttgacctctcaggttaaagctatcctcccatctcagcctctgaagaccaaggcatgtgctaccaggcccagctaattttttaaaaattacttttatagagatgggggtctcactatatttccccggcttgtcttgaattcctgggcccaagtgattctcctacctcagctcccaaagtgttgggattaaaggtgtgagccaccacacccaaccaagttttgaggtattccgttacgcagcaataagtaactaatacagtcaccttctcaatgaaatctaccttttttctaaaacctagtctttctctttctttttctttctttctctttcttttctctctcttccttttgatagcatttattatctcctaacctactatatataaggtattaattgtttatgtttattatctgttctttctcccacacctgacctcacactcaaacaagctaggattctctgttcactgatttatcccaagcacatagtcaaatgccaggtgcatacagcaatgaaacagacatgtgtgcagatgcacgtctaagagttctagcaggtctgatgtctgctcccagctgcgtgtaatcaatcagcagggagcatgtcacaattctctgggcctcggtgtcttcagctgtaaaataaggaggttaaattgggcgacccgtaagttcttttccagatcctacgttttgtgatccctaaacaacgagggtattgtgggttctctagattccaggggttgcagagacaggcctctgcctttgccaaagctcattttcctgtccattttccgtgcacatctggaaagccaaaaagcaaaaccatcgcattgtgcacatctggacagcataaaccgaccactccaagaggaaactccaaaacggctgctcagcaaaacggcagtggaggccaaatgagaaaggttgaaagggctcctttcttttctacccgcaaaacaatcttctgggcacaatcttaggagctgaatgctttgccgctgaataacatacgctctcaataggcttcgactgcagtctctgtcactttgctctctgcctggctcctggccaatgcaaaacatacagaagggggctttctcccccactgcccccttgtttagacggatctataccttcacttatccttggggcatgtggcccaagttcaaagctgaacaccaacaccacctgctcctcctcttccttcagggagagtgattgaactgcacgcctaatgcaaactaaagggggagttttcagggctcgtgagaaatccttggctatttgcatgcagttagaacatgctcccttccctccgtggctgagaagagaaagctgcctggcagtatgtagtcttgttgtttgacaaccagcttgggattccaaaacaaacaggaatgattattcctattcctttgcaaatgatttgaggtttcaggggcattgaatttatgcagtgcagggagagcgagaggcatgtcctgaaatgtggggtgcttcccatttgcaccttcagagctgataatgtccagggcttgctggggaggacactttggagcacaggaaagtttaagcggcaatagagagcctttgagtcaatgtcttgtgaatagcaggggatgcctgcaaggggagaataaaggtgaatggagaccttggggttagggtcattctctagacctccctgaagggtgtaggtgaagaggcaggagcaagatgcaggaagttaatagccctgaagtctagccctggaccctcaccctcaaacagcggcatctccgtatgactcaggacactctatgaggtgagactcctgctgttaccctgaagcctaaccatatggaaagcacatggcctgctgactctaggtgcagggggcgctttagaaaaccaggcgagaagctggcaagaaaaggaacaaaagagaaatcttttccttccttgcactgtgtatttttggacttgctttctagctagccagggactcagtgctttgccattgggaaacaattgtgttttcttggcttcccagtatggatggctgagggcaagtgcagggtgcatggccaggacgccagtgccagtagggtggctggggatatcatcagctgggaggctcagcacctgctgctttgcatatgctaccaatgctatgaagatggtgggcaaagcaaccaccctcaccagagccacttcttccaggaatgcctggtgcagactgcagaggcaccaggccaatagcaaccatggcaggaacaccagcactgcttactaagcccctgccctacaccaggcccaatgctaagcactgttcatgcatcttctcatttttctctggcacttgctctatgcagaaaatattaccaacccattttatagatgaagaaactgaggcttacagaagttaagtactctctcccaagttcaccagcctgtaagcagcccagctgaaatttcagttcaggtctgctgactccagagctcaagggcttcccctgtgtggccatgctgcctcccatattcctgcagaaacagtgcagagtgagggtggatcttgctgtaatcttggtttagggtagcctgtgattattagcaatactttgtaccatgaaatcatgtattgccaattttcctctgtggggtggaatctgacacagacaatgtgaaagatttctataaatattaatgctgtttgctataaatattaatgctgtttaagaatcttttaaaaaaaaaaaagaagtttccagtattttcagtgactcactggcttctagcacatacctggtgggcttttctctcttgaccaagtcagtaactataaagcaaaaaaaaaaaaaaattccctagctctgattagatgctgagtttaactggctctgacggatgccccaggaaatattcccaaggtgccaaactccggtcttctgggtgggaggaagccaatgtaatacttttatctctgtagctcttgctggtcagtccccactgaagtttgcaaactctgtgtgctggtttgtgcaagagggactatgaagctggttttgactttgcaaacagcacagacctctgagggataactcagcaatgtgcagaggggtagaaaaaaggaatgagaagttcaaagtgaggagagagagcacaaccacagctatgaatgggcatgaaggaaggagaaaagttgggaccagtgtccaccacatggccaagaaagtgtaatcatgcaacaactgcttggtccccacctggagagccactcacagacacacagtgttcagagcccatcaactcagagctgagacttaataactaatctgtggaaataggagtttatagcaatggtcttctacccctgttgaaaactgcatcctatggaagacagccagttctcagggcccttcaaaaatgtcagtgtcatgtgagacagaaaaggcagggtacctgtcttccattaatggagattaaggagatgggacaaccaaagcaaacaaataaaacgatacaagggaaacacataaaacaatagcaacaactaaccaaactaacaaatccataaaggacattgggaatgttaagaaaacctgaacagggtcagtatattcgataattttattatatcaatgttaaattttctggatgggataaccatattgtagttatgcaggagaatgttttgtttttgtttttctcaaagttatataggttgctctacctcaagacttctcgaaaatgtacgtaactgtaagacgatgatcaaaactgggaaatcacattggcacgacactatgaactaaaccacagactttattcaagtctcatcaattctcccctgacatccttttgctatttcaggatccagtgtgggatcccatgttgcatttagttgtgatgtctcctttgcctcccctactttgcaataatgtttcagtctttccttgattttcatgactttgaagagtgctggccagctattttgtagaatgtctctcaaatttgggtttctctgatattttctcatgattacattgaggttatccttttttggcaagaatatccagaagtgatatgtccacatcagtcagagggcacaggaaaactcgatgtgtcttattcctggtgatgccaaccttgatcacttgcataaagtagtttgtgctgggtttctccactatgaagccatcatttcccttttatagttagtaaaaatttgaagggagataccaatatgccaatatcagccaggtgcggtggcttaagcctgtaatcctaatactttgagagactgaggggggcagactgcttgagcccaggagttggagaccctcctgggcaacatagggagacccccatctctacaaaacaaactatatgtatacatacacacacacgtatatatacatatacacgtatagatgtatatacacatatatatacgtatagatgtatatacacatatatacgtatagatgtatatacacatatatatacgtatagatgtatatacacatatatacgtatagatgtatatacacatatatatacgtatagatgtatatacacatatatatacgtatagatgtatatacacatatatatacgtatagatgtatatacacacatatatatacttgtacatatatagtttgttttgtagagatacgtatacacacacacacattttatatacacacacacacacacacacacacacacacacacacacacacacacacacacatatatatatatgccaggcatggtggcacacatctgtggtcccagttactcatgaggcggagacaggatgatcacttgaggctgggaggtcagggctacagtgagttgtgattgtgccactgcactccagcctgggcagtgaagccagaccctgtctcaaaaaaaaaaaaaatgcaaatatcctgtttctccttaaattttctcatagtaatcttagttctcattggtggatcttgcctacagcaattattactgtggtattctagtgagggctttccatttcctcccttccttctacatttattaattgaaatttatctataagcaagatctgtttcatctcttccatttaagaaaactattcaattatttatttgtagcaatatgactgtacagagtctttattcgatggatcataatccactactatcattatttattttgttgctccaattgttccagctttggccattgggagctccttcaggatggctcccttgttcttttgataggtcaaaagatgcgttttgatatgttcttttgacatggccttttggaaagatgtacttaccttctggcatcccaagtatttctggctcatcttgtattttcactccctagtccttgaatcaactacttccccaagaggttctggtcccttttgctgaggaatggtgtttaggaacaaaggtccgggctccagaggcgctcactgttactggggtatcactgttccatgaaatatacgtacacatactgtgacagttgcagataccaggatgaaatcaccttgtttgtcagacccaaacaaactgaagccaggaaagcacaaaaagagagagctcctggatgtgtgtctgagataaggactgtctcaagggctttctaaaataaccctacaagagatcccctctttaggactgcagtaattcagataagatgctctcaaaagaacagttgcccagtaacagcatctccaccaatgaactgacacaaactctggctttgagctcccagaaccaatgaactctgtttccaagtagcttatgtgaacttctcctttctgccaataaaagcttccccttaccctctcctctgcaggtgcatctgtggcttgccatagctgtgcatcccagattataatcttttttgcttattccccaataaattcattatattattaggttgacaatactaaaccacacatacaaaaatagctatatttaggctggctgcggcagctcacgcttgtaatcccagcactttgggaggccaaggcaggtggatcatctgaggtcaggagttcgagaccagcctggccaaaacagtgaaactcaatctctactaaaaatacaaaaattagctaggcatggtggtggatgcctgtaatctcagctactcaggaggctgaggcaggagaatcgtttgaacccaggaggtggcggttgcagtaagcagagatcgtgccactgcactccagcctgggcagcaagagcaaaactgtctaaaaaaaaaaatagctatatttgtttctatagctatttacttcataagtaaatcataagacaaatactgaacaatatcacctatatgcagaatcttaaaaagctgcattaatagaaatagagagtggaatggtagttgccaagggctgggaagtgagggaaatagggaggtattggtgaaagggtaaaatttttcagtaataagatgaatcagctctgggaatctaatacacagaatcgtgactatagtagacaatactgtattgtaaacttgaaatctgttaagagaatagatcttaaatgttctcatcatacacatacacacacaaacacacacacacacagatggtaactatgtgagttgatggatatgctaacaaatttgactgtggtaatcatttcactataaatatgtatataaactcaaaacaaaacaaaatcatgttttcaggctgggcgcatggctcatgcctataatctcagcactctgggaggctgaggtgggtggatcacttcaggccaggagttcgagaccaacctggccaacacagtgaaaccttgactctactaaaaatacaaaaattggccaggcttggtggcgtgcacctctagtcccagctatttgggaggttgaggcatgaaagtagcttgaacccaggaggtggatgttacagtgagctgagatcatgccactgccctccagcctgggtgacagagtgaaactctgtctcaaaaataaaaacataaaaaacaaaatcatgatttcatggataactctcattctcgaccagcaccataagattcatcttaacctaaaaagacagtgaactgtggccgttgggccaaatatggcctacctcctgtttgttttgtttttgtctgttttttaatttgttttttgggatagggtcttgctttgtcatccacgctggagtacaatgacactatcatggctcactgctgcctcaaactcctgggctccagtgatcttcttactcagcctccagagtagctgggaccactgaaatatgccaccatgctcagctaattttttttattttttggtagagacaaggtctcactatgccgctcaggctgatctccataaactgaactctggggctcaaatgattctctcacctcagcctccccaagggctgggattacaggtgtgagccaccacgcctaaccctgcttcaataaagttttatttaacacactcatacctatttgtttacatattatctgtggccgtttttgttcaaaggcacagttgaatagttgagaaaaagactttatggcccacaaagctgaagatacccggcccttaaaagaaacagtttatgggcccctgttctaggattccttctttctctctttttgttgttgttgttgtggtttttgagacagagtcttgtcttactctgtcacccaggctggagagcaatggcatgatctcagctcactgcaacctccagctcctgggttccagcagttctgcctcagcctcctgagtagctgggattacaggtgtgtgccaccacacctggctagtttttgtatttttagtagagacggggtttcaccatgttggccaggctggtctccaactcctgacctagtgatctgcccacctcggcctcccaaagtgctgggattacaagtgtgagccaccgtgcccggcctctttctctatttgtatcttcttttgccaacactgaggatgagattcttgtatctacaatgtatcttatttatttaatcatagtttgcacatcaggtggtaatagaattcctgtgagaaaaagatttaccatccagagaacaatgtttgcacagttttttttttctttttgcctttagccttgtagtatctgttcaaaagactgttttccaaagagattggtgtggttatgtaattcatttgtaatacaacttagtttcatttgttactgcttgtattccatttgggctcccccatattttggtttaattatttattgatttggggcaatgtgaaacacttctgtaagaaacagtcggagttattcaagaagggaaacttggccgggcacagtggctcacacctgtaatccagcactttgggaggctgaggtgggcggatcacttgaggtcaggaaggagttcaagatgagcctggccaacatagtaaaatactgtctctactaaaaatacaaaaattagccaggcgtggtagcatgggcctgtaatcccagctacttgggaggctgaggcaggagaattgcttgaacctgggagaaggaggctgcagtgagctgagatcgtgccactgcaatccagcctgggcaatgaagtgagactctgtctttaaaaaaaataaataaataaaggtagacttgtatagacaactgtcacttcctcctcacccttgttccccacccctactccctccttccctcccttgccacataccctctctaggtaatctgtcttctttggtcctgttttatccttccaagtatcttctgcacaagtaagtggatatatgtgtattttcttatatctccttcctttttacatcagtgacagtatactacagatactcatttgtatttagcttttttcatttaacagtatatcctgaaaactcctctaaatgagttcacagagatcttcccactctttttgatggctatatactaatccatggtgtggctacactatagcttactcatccactctcccacatatgggcatttaggttgcctccaatattttgcaattacaatgttgtaatggattaccttgtgtgtctacgtagtttcatattcttggaggtgtatctttagggtagattcttaggagtgggtttcctggatcaaaaaggaaatgcgtatgtacttttattagatattgccaaatttctctccagaagggttgtaccaatttgcatgcccaccagcaaggtatgagagagccatttctccatatcctcatcacagagtataatttcacagttttacattttccccactgataggtcagaaatggtgtcctagtgttgttacaactagcatgtttataatgaggaggtgagtttcagcgtttttctcatctgcttgaggatgatttttaaaacgtgttttggtgaattatctggtcacatctttcccccaatttttctatcaaaatgtccttattcttaaaagatgccactgaaatatacatagatgagaaggatcctgaagtgtcaagtcgttcattggaaaaaaaagtgtgtgtgcgtatgtgtgtgtgtgtgtgtgagacacagagacagaaagagagagagaaagtttatccatctatctgagagaacaactgccccccgcttccatacacaaagagctagttgtcaacaggctactatgttcccttccatagcgctatggtctaatgtgtgtgtgcccccaaatttcatattgtgaaacctaatcacgattgtgatggtattaggagctggggcctttgggaggtcactaggtcatgagggatccaccttcatggatgagatcagtgcctgtataaaagaaaccccagtgagctagctagttcttccactatgtgaggctacacagcagggaaacaccatctacgaaccagcaagtgggtcctcacgggcactgaatctgctgggaccttgttcttggacttcccagtctccagaactgtcagaaataaatttctgttgtgtgtaatctacacagtttacggcattttgttttggtagcccaaatggactaagacatgtagcaacagtcaacataatctcccaacctccccttcctttgccttcgtggcttctctatgacaagacactcttggaagaccttagctgccaacaggctgagcacagccctgggagtcccagcaaactggctgagaacttgggtctctagtcgttgctctgtgagtgctgccagtgtgtgatgcccggcgccagatgtcccaattgtgtgtgtaagatggtgtttcactcttgttgcccaggctggagtgcaatggcgcaatctcggctcaccgcaacctccgcctcctgggttcaagtgattctcctgcgtcagcctcctagctaggattacaagcacgtaccaccatgcctggctaattttgtatttttagtagagatggggtttcaccatgttggtcaggctggtctcaaactcctaagctcaggtaatccacctgccttggcctcccaaagtgctgggatgacaggtgtgagccactgtgcccggcccagatatcccaatttacttgaggatcctgcccagccaaagtcctaaaggtgggttacaagcccttgtcactctccttcaactcacaatgtttcacacacacacacacacacacacacacacacacttgctgtattaaagcaactctctttttttcaaataaaatggtaatatggctataaagaaacacctgccttatttgcctgaaacaggaaataattataaaagtaaacatgtcgaaagcaaaatagaaatagagggctggcatggatgtgatggaaacctagacactgcgggatgtccagggagggaccccagcccctgataccttctgaagtaaaaatcccagaagggtgccttcaacagaaatcttagataatttttttgaaggcagatggagagagggtggttccaagagcaaatgggatctgtaacctcgatgatcacaacatttcaatatggtacctgggaagtagatgaaattagcacatcgaaagagctggtacacactagatgctcaataaatgctactgctagacttcttatcgtcatcacaatcagcagcagcatgcagaaagagtaaacatagcaggtgtgagactgctgtccttagaaatgtctgcttacaaagttggcccttaggcagttcctgggaacttgaatggtaaacagttccctacacagatataaaaattccctaaataagaagagagccttgctgtacctaaacagtttgtgcaactaatattgcttacgtcaaatgctcgcttcacttatggaagtctagacttttggtatacgttaggcagagggtgcctatgtgaccagtaccctcaataaaatctcgggcactggttctcgaatgagcttctctggtcgacagtattgtgcgtgtgccgtcccacctcactgttggaggagtgaagcccatctggtgtaactcccctggaagaagattcttagaaacttgtgctggtggtttccggacttttccctgggtaccttttttctttgctgcttttgctttgtagcttctcactagaatacatctcagctgtgactatgtgctgagtcttgtgagtccttgtaaaatcaccaaacctgggtgccttgggtagccactgcacaagcagcagccgcagtggctgagggtggtgtcaggtggctggacctaagggaagcctctctcagaacccatcacatcctagcactgtggatggaaggcagccagcattcctgaccctagtggggtgggagttgcagggctggggttggaagaggctaagtacataaaatccagggccaaagatgacagtgggaacacagggaccagcaaaagaggcacacaggaggccatggccaacaccagctgggccctgctacatcacagcagatgctgcaaggagaaaggccaacatctggtcagatgccactcctttcgggtcaggagatgggacattctgagaacccagatctcctttaggaaaaaagagaagagggtgggagaatctcaaattgaatgcatctgtaacctgaactgagcaaatttaaagccggaagtgacgcggccatctttaaatggcatgtttttaacatcagggcaaatgagggtttgtgagtgaggttcaccaagagcagtggttctcaaacccgagtgtgcatccgaatcacctggagggtttgttaaagcacagaccgtgggcccctccccggcaggcatagtatccaggaacacttggggtattgggaaaatgaagctagaaagactccctcaattttggtcctcctccctagagaattactagaacacagcagagtagagggccaggaattgcaagtagagggcaggataaagaaaatgtggtacatttacacaatgcgggagggagagaaggctaccgacggcctttcccctgatactcaaggtcgtcttggaaacaacgtcaccacctacaagcccatccagtgctcccgtgttctcctcttagtttgaataccaagcttaacctggcaggagcgccctttcccttgaggatctcggaagacagtcaaatgcattcatcaactaatatcccacaaacagaagcagagggtccatgtttcaatggcattttgggcatacaaaaaatttataactttcctgagctcacagcaaagcttcccataaagggctgccataaatggcagtttggatgcccgttccgctcacaaaagcccatttaactcaagtgtgcatagtttataagtatttaagtgccttgtgggttatgtaaagcttgtgggggagttcaggaactgaatcaccatttacaacgtgttttttttcccccactgtgggaaaataccttccctgtgaacagcgagaaggagggtactaaagaaatgtgtaagagatggaaatgtggaggctggagggatgttctccttgctttgaaactccaagaacatggccaggcacggtggctcacatctgtaatcctagcactttgggaggccgaggcgggcagatcacaaggtcaggagtttaagactagcctggccaacatggtgaaactccgtctctactaaaaatacaaaaattagcccggcatggtggcgtgcgcctgtaatcccagctactcgggaggctgaggcaggagaattgcttgaacccaggaggcaaaggttgtagtgagccgagattgcgccactgcactccagcctggacgagaaaaaaaaaagagagaaactccaagagcatgcctcatgctcttggggtagcaatcatgaagcagtttagggattcatcgattcacaaataatttctgagctcctaatctctcagagacgacatccagggtgcaacaaagaatagtgcttgaggctgttcacaagagccaagacagggagtcaacctgtgttcatcaagagaaaaatggataaagaaaatgtggtacatttacacaatggaatactattcagccataaaaagaatgagatcgtgtcatctgcagcaacacggatggaactggaggccattatgttaagtgaaataggccaggcacagaaagacaatggttgcacattctcactcataggtgggagctacaaaagttgatctcatgctggtagagtagaatggtggctaccagaggctggggagggaagagaggagaagagtgatcaagaggtgggttaaggggtacagtaagaatacagtaagatggaaggatcacattctagtatttgacagtatagtagggaaattatagttaacagtaatttattgtatgcttcaaaataggtagaagagaagaattgtaatgttcccagtacaaagaaaagataaacgtttgctgtgatgggtatctcagttaatctgatttgatcattacacagtgtctacaggtatgctaaaaatatagacaacaattacctatcaattaaaaataaaataaaagaatagtgcttgaatccctgtcctctggctgctcagagtctgagatgcgcagacacagagaaaggcactaaccccccagggaacctgttctgcaggaggaaggcagcagctattggaacttgaatagagacagccgcgcccacctcgggcttcttcaagggctcctggaggaagctggccaggtaaggagttgaagacccactggaggcaaaggggccaacgtgtgtagagacatgttgcaggaggtattgatcttgattgggctgggtggcaggtggaggatggcctggtgggaggtgggcttagaggacacgttaaggatttgttaaagaattgtggtaaaattggctgggcacggtggctcacgcctgtaatcccagcactttgggaggccaaggtgggcggatcacgaggccaagagatcgagaccatcctggccaacatggtgaaaccctgtctctaccaaaaatacaaaaattagctgggcgtggtggcgcatgcctgtagtcccagctacttgggaggctgaggcaggaaaatcacatgaacctgggaggcagaggttgcagtgagccaagatcgagctactgcactccagcctgggcgacagagtgagactctgtctcaaaaaaaaaaaaaaaaaaaaaaaaaaaaagaattgtggtaaaattaatataacatagaactcagcattttaaccatttatgaggtgtacatttcagtggtatttagtgtatattcacagtgttgtgcaaccatcaccacaatctagttccagaacatttttatcacccaaaagcaaatgctatacccattagcagtcactccccacccctaccgccctcagctcctggcaactatgactctgcttctgtctctatggatctgcccactcaggacagcacatgaatatgatacggtttggctgtgtctccacccaaatctcatcttgaattgtagctcccataattcccatatgtcacggaagggacctggtgggaagtaattgaatcatgggggtaggtctttcccatgctgttctcatgatagtgaataagtctcatgagatctgatggttttataaagggcagtttccccacacacactctcttgctgctgccatgtaagacatgattttgctcctcatttgccttccgccatgattgtgaggcctccccagccatgtggaactgtgagtccattaaacctctttcttctataaattacccaatgtcaggtatgtctgtattagtagtgtgaggatagactaatacaataaataaaactacacgcatgtggccttttgtgttggctttttccacttagcaaaatgtttcaaggttcatccatattgaatcatgtatttgtatcagtacttctttccttttacagctgaacaatattccattgtatgggtatgtctcattttgcttatccattcatccactgatggacatttgggttgtttctaccttctggctattgtaaataatgctgctgtgaacagtggtgtacacgttttcggtttctttgtttgtttttttgagatggagtcccactctgttgcccaggctggattgcagtagcacaatcttggctcattgttaaccttcatctcccgggttcaagtgattttcctgactcagcctcatgagtagctgggattacaggcacacaacaccatgcccaggtaatttttttgggtttcaccatgttgaccaggctggtcttgaactcccgacctcaggtgacccgcccacctcggcctcccaaagtgctgggattacaggtgtgagccacagcacccggtctacatgtttttgtttgaatgcctgttttcagtgatgttgggcctactctgaggagtggaattgctgagtcacaggctaaggatttcatgcttaggagcatcataggagcagctagaggccatgtaagtgaggagctgcatgattagaactgtgtttctaagcattggctatagctgctgtgggtggaaagttggagggaagcaggagtggccagaggtgacaatagtccaggagagagaccagtggaggctggtggcagggggaaggagagaagtcacgaattgcattctcctcatctcttttgctcctgctcttctccctatcacagccgcagacatctagccacaagcgagaaataaccattttccctgcagacattttcacattctgaaacaacgaggggttgaacaacaacccttgagcaacacaggtttgaactgtgcaggtccacttacatgtggattttcttctgtctctgccaccccagagacagccagaccaatacctcctcttcctcctcctccacagcgaactcagtgtgaagatgatccacttccacttaatgaatagtaaatatattttctcttccttaggattttcttaataatattttcttttttctcatttactttattgtaagaatacagtatataacaggggtccccagcccctcggccacagacctgacctggtccatggtttgttaggaactgggcctgcacagcaggagatgggcggcaggcaagcgaacgaagcttcatctgtattgacagccactccccatcactcacattaccacctgagctccgcctcccatcagatcagcggcagcattagactctcagaggagcacgaaccctatcgtgaaccgcacatgcaagggacctacgttgtgatgatcggtcactgtcccccatcacccctagatgggacggtctagttgcaggaaaacaagctcctctacattatggggaattgtataattatttcattacatattacaatgtgattgtaataaaaataaagtgcacaataaatgtcatgtgcttgaatcatcccgaaaccatccctccccccaccccagtccatggaaaaattgtcttccatgaaaccggtccctggtaccaaaaaggttggagactgctggtatataatacatataaaaaatatgtgttgatcgactgtttatgctattggtaaggcttctggtcaacggtaggctatcagcagttaattttttggggagtccaaagttatacgtgtaattgactaaatggaactgactgtgtggggagggggccggtgcccccaagccccacattatccaagggtcaatgtagtgagctggtaagcacagctgattgtgggcaagacaggtggttttgaacttcttcccagctggactatgagaaactcactgacccccacaaaaaaaacttttcatggtctcttttagctccaagcctccatgatttctgtgggaggctgtcctgtaaccatcagctcttcacctccaatcatgaagtggtttccactgtaaaggaagctgctgattcacgtggagactctactatcttcttatcagtcctttatttatataactgtctgacttatgagtcaatctttaggacaggataaaagttcacatcttctcccatctgaataatctaagacctagaacattatcttgaggcacccattttgtcaacaaacaaacaaaaaacaaaaatgccagcaaaccaaagaaaaatggaaactgtccacttgcacctcttttgagtcctcctgcaaactggcatctacaagaggaactgtcactcacagcacctttactgtcatgtggcaaggtatcagtggcttctgaaggtgctgcttcatgcagaatgttttgggtgccccctacattctaatttactacaggtaactgttggtaaaaggcccactcagactttcccatgtagctggttctcaatagatcctctatggaaggaaagaaggaaggatgaaccgaaaaatggataaagtatacacccccatggaagaaggaagaaatagatccaatgtcatgatttgcattggttttgctgccccatttccttgagactaatttttttttttttttttttggatacacggtctcgccatctcctataggctagagtgcagtggcacagtcacggctcactgcagcctcaacctctcgtgctcaagggatcctcccacctcagcccctagggtagctgggactacatgcacacaccaccacacctggctaatttttaaattttttgtagagccaggggtctcactatattgcccaggctggtctcggactcctaggctcaagtgatcctcccgcctctgcttcccaaagtgctggtgtgagccactgcgcctggcctgaggctgattctggcagtagtgaggtcaacaggggattacacacccaatacttgtgccataaaagctccaaccaagagtcaaagggttgatctcgtagaaaactctttagctaaagacagagccaaaaaaccaaagtgcagctcaaagtcagatgtgctcttagacaggtcccccgagagagctgggaatcctgggactccatcacttacattttcctagagaagtctaagcccctgggttcctttggcagtctggcagcttggggctcttcccaggctgtttttgaaaggggggaatcaccctgcctgacccttttccaacactacccatctgactcctgctagtggaggggctctttaagtcccaggggaagggctattcaagtgcttagaagattttgcaatcaaactttcaagggtaaatatttgcagtgactcaccagagaggtttttctgctctccttctggcccctggggagccacagggctctttccccaggtctgttagcagtttacgatgattatccgtaggctccctggacagctcatgagtcaagagactgggttcccgtaacccactcccttgcccggaggcacctgggctcaccataccagaggtcagcagcacatttacagcaccatagcctagtaaagtcaatggtacaagtgtccagcttgtggcctggaggctttgcccaggctcgtgggacaggcagacaatttacaaggtaagtaacacatcataaaattgagcagcaaacactaatgagcctacaagccaggacagaggacctttctctccgaccagggaaactgacacagccactgtcccaggtttgggcaggcgtgccctgctagcaccgaccacagtgaccaaggataacgcatcgtgctttcctctagaccccaagaagcaactgtaaaccttgggaggctttcaagagactccccagatcaagggaccttaacactgtccccaaactctatttggcagctggtttatcgcggccaccactatcatccacccccatgattatgactttggtgagtctctctcctgcttcaaatcacagatgtggtccctgactgaggctcactctgtttgcagaaggggactacggtgtcatcagagagctggggagtggaggggtgagcttcctcagagtgtagctacaagagaaagcatttggctctgcatttgttggtgctctgtgtgggtgcccaatggcttgaagttgtcagcatatctgggcacacaagtttgtctcaggccccccgggggttctgatgacacgttaagctcataggccatgtggcaatcatcctgcagaacttttggttccgtctgatcccagctgaaccaattcagaatgggccagacacaagatacaaatggtgctgagcagggaaatgatcatcgattcaactccactgagtagatgttcgtccatttagttggtaacaatttattaagcattcctacatgccaaggcccaaattgggtgccggggacacaggggtgaatgagacagggccaggctcttaggaagtttgggagcagacaggtggtatgcaaacagatacccccacgctggacactctgctccgatgctacgaaggaggccacctttgggagctgatggagaatttcaggggaggacctcgtttaggaagggtgtttagaggcggactctttgaaaaggtgcaactgcaactgaaattgagatctgaagaattaaagggggaggggcggttgagggcaaaataactttctgtgcagaggaaagaacaagaacgaggcccagcgatgggcaggatctttgtgtgttcaagaaacttgaagtcctgtgtatctggagtctagtaagtgatggggagagtgaacttgaattttacttcaaacacaataagccccaaaaggattcatctcaggaacgtggcaaaggtcagttttcatctgacctgggtttttaccaggtccccctcatactttttctttggctttccatgcaacacacagatgcaacatggtcatctaggattagggaatgatttaggaatacagggacattttctgattttgaaacagcccaatttccaacctctgcatcagatctatccacaggtgggctgtgcgtggtggttcatgcctgtaatcccagcactttgggaggccgaggtgggaggatcacttgaggtcaggagttcaagaccagcctgggcaacatgaaaccctgtctctaccaaaaatacaaaaattagccaggcgtggtggtatacgcctataatcccagctactcaggaggctgaggcaggagaattgcttgaacccaggagatgaagattgcagtgagctatgatcccaccactgcactccagcttaggtgactgagactctgtcttaaaaaaaaaaaaaatctattgacaggtggacctcttgacccttgacctccatctgcaggcttggtcttgtccctaggaccaatctggacttatcacaaggtacacttaggggttttcctcaacccataatgtgacactcaacatctgttctttgttgttctgcaaacagtatctctatctgcctttttcctgggcttggacgagtccctgtcccccaggtctgttgctggcatgcttccagccagatgctgtgctttcctaggattggagcctcatccctgcttctgagccatcgtccagtgtcaggagtcttgctatgtggcgacagaccttccagaagctgactggggtctgcctgcactttcaaacagtgcctgattcgggatcccactgctgtcccgctccacccgtctccttacccagcatggctcttggctcgttcgtgatagtaaagacaggtgcaccacaccctgcctgggcccttccctccagacccccctctgcttggcaggtggagctccctctcaacatctaaaactgttcttctgtccagtgagggggctgagtctcagggccaggcctctgcccgtctcttccccaacctgctgctgtgaatgcccagctatggcccaacgacatgctagcctcagcgtgtgctccacaggcaggaatcagggcatatgttcaagtttataaggggcctatgaaaaaagagactgccagcagattccctattaaatgggcttcccttgcagtaaaagatttaaattagagtatcttctaaacaggggcgtaatgggaccaccacaggtcatttaatccatccctctgccacttgccattaaaggaagagcatgcttgtgtcacctgctagtcatcacctagacatgctaaagaaatatacagactcccaagaggcttccgaatagctattttccaaattaatcaggaggggaattcttttcttcaaataaagtccttttttttaagtgttttaattttgttgctgttgttgagacagggtcatgctctgtcacccaggctggagtttggtggcacaatcacagctactataacctcaaactcctaggctcaagccatcttcccacttcagtctcccaagtagctgggactacaggcgtatgccatcatgcctggttagtttttttaaaaaatttttgtagacacagggtctcactacgttgcccaggctggcaaactcttgggtaggagcattttttttttagacagtctcgctctgttgcccaggctggagtgcgatggtgcgatctcggctcactgcaacctccgccttccggctcctgcctcagcctcacgagtagctgggactacaggcgcgtgccaacacgcccagctaattttttgtatttttagtagagatggggtttcaccatgttagccaggatggtctcgatctcctgacctcttgatccacctgcctcgacatcccaaagtgctgggattacaggcgtgagccaccgcgcctggccaggagcataatattgaaaacagatgagagcaaagctttgctcctcacacccaccataaactgtagaactctgtgggaggctgtttgaaaaccattgctgaaaatacagagatcctaagatgtggggcaaatagactcctgtgaggaggaggcatggagtagggaaggtccatcatgctaatagtgttgaagctgacaaaatcctggcagcagccgcctttgaccaacaagcatatgccaagacccggctggatgctctataggttctattgttgaacctgcaaaatctttgccaagtaggcataattattccaatttttcacatgcagaaactgaggctctgtggcatacagtgacatctccaaggccacacacctcctggagagccataatttgaacctcggagtgccccactgacagccaacgacaccagagggtccctttgtatgtaaggattgcatgactccagttgaatgacccaagccggggacaaacaggaaagaacccagcagctctggaggccacttgagctgactgtcaaatgctctgggctgattaacgactacgaacttcagggaagacaagtgtgctttgatgccacagagctatcctgggcctgtacaggcccgtttctgctctgaatgaggaagctgtactttgcaggcacccggcagaacaagaatagggcctaagatacctgaatgaagggcacagaggaagtacaaaatacagtcattgttggagctagaagctggtgccaggctacgagggggcccagtggccaagcattatggcaggagagagatgtgaatattttccaggcaaataatgcagcttctctacctggaaaccctgcagccgtgtcatgctggacaaccccctcagtccaggcgaggccaactggcgactgccaggccataccatgtgtgccttcagctgccctccactggggacaaatgcctcctctgagcgatcctcttcaggaagtggaggatgcagtggctgctccccatgtgtcccccatggctccccaagtttaacaggacttcaggtggcaatgggagatccttagggcatgagcagttcacatatacttttcacagtagtttccagtcgtcaaattacttcacatagggtaagggatagttccaggcaaacttaatgtagcagcaggacctcaggggaaagggttcgcttcagtgggcatcaactggtctgtgcaaatccctggaaccaaattgctgtctctgatgtagaggggtccaagaagaggtgagaaaggtcaggttccccctggtgggtagactctggggactccagaaatatggctgcagctactctagctctgactttgttcaacaggtgcaaataccaaggtgatttgtgacatctgtctattcacaccccgcaggctctgggtacctctactccccaagacaactggtgttctgtttccccccacactgcccagggcccctcttggagcaggtacctgaggtgggccagccagtcatccctgtcctgtctcctgtgccatggacccctcccgagccccttgccaatcaaaaatccggtaaatatttggtgtcctctgcacagtgacagccttgtaggtggctggcccgatgctcgactgtactcagtttcatgctagagcgttaataagtggttctaaatgcagtcgagaagataaaatctcacctccgctcactctcccaagatagggaggaggatttgccttttctaagaaattaaccagccccttgaaagtaattgtttgaaagcgttcagctgggtctatgtgcagctatagaggtcatggaaggcccgatggggcagttttgaaaagtggggagaagagacacagaattaccatataagtcagcaattccactcctgggtatacaccatacagaaatggaaacagagacttaaatacacacttgcacacacctgttcatgtcagcattattcacaatcgccaaaaggtagaaacaacccaattgtccatgagcctatggagggtcaacacaacgtggtgggcatgtaggagaatattattcagccgagaaagtgaatgaagtgctgatctatgccacaatgcagatgaacctcaaaaacatccatgctaagtgaaagcagccagacacgaacggtcacatattgtacgattccactgacatgacatgccccaaacaggcaaatccatagcaacggtagatggatttgtggttgccaaaggctgtggggggagggagaagacagggtggctgcttatgggtatggacttttcttttggggtgatgaaaacattttggaagatagaggtggcagttgtacaacattgacagtactaaatgccaataaatggttcacttccaagtggctaattttacattatgaaaatttccaaagtgggggatgttcaaagaaagcctcctctccaccgagcgctgtgtgaggggatcatacactccactgggagggggccttgcaagctgcagggaagccaggaaatactctccttcctccttctggggagcgtgtgtgatccaggagtgacgcgctggggcaagcgaggcccatctgtacccaggctggtggcggggctcaagagcccaggtgagactgtcccatgggatgggggtaccaaagctgccacagcaggacttcctgaaactttgaaggcatgtgcctgtgttggtgttgggatctgacagctgggaagaggggatgaaaccaaacctcctcccagggggacgtcctggtgaggtttcctaaaaacaagttaggagtcagaggatacacgtcggagaattccccaaggggctcctggctctcagaagaagggagaatattgaagtgctgggggtactcacacggggtttggaggattagcttctcgggtacttttcccttgggatatgaaaagggaaactgaaacagataaacacgtacttgtacacacatgtgcatggcagcattattcacatcaccaaaaggtggaaaccacccaaatgtccatcagcttatgaatggatcgacacaatgagatggacatgtaagagagtattttgtgaacagttctataacctccttccttcttgtgttataatgcccttttggttcccccaaatccttcagtgacatcggagacaccagatgcaccctgtggtggtgggatggaaggaaagagaggtggtggagtctcagggaagggaggcccactctatagactccactccaccctctctcataagaccatcaagcacttgtgaaggtcacagcagggctcctggtgtgcccgagaccaacaagaccaggtccagtgcagggctgggaggggagaggagaacacagctccaaggaatggcagtcacctggaaacgtctagagtagataaaccagaccagatttcccaaatctgtacaagggaggaagtggccacactggggaggggaaagtctcagaagggccacaccattttataggaggactctcaaaggcttagctcaaaggaatgattccatacatggagtctgcacaggtgagggcagactaggggtgggggacctcctgggagctttctccaaacacagatgctgactctggaggtgaggcctactgaacaaccccgagggtgattcagaagtgcaatcctcacagatgaccatgtgcagggagaagggacttggagtaatcttgagctcaatcctggctcaggcatttcctagaggtgactttgggcaagttattctttcccccaaattctctgcacctgtttctttccgtgtcaagtgtagacccggccttacccttggtccagcccctctgagatctatttcatgtatataaaaaaaaaatggttagccagtgtaatcacctgataactaatggtccttccagcagacagattcatctactcacttgacagttacttactgaacacctactttgtgccagaaatgtaagagttgacggtttcgtcctcattcgctgtttccactaacagttcagtggctggatcaaaaggtattttcaatgaaaaacagtacattaaataatttcagctgtttgagatgaattccactaacatggaaattgtgaacctgtggcattttggagaattattcataagtggaaactaaataaaaatacagcttgtgcatgctcttgactcacactggagtcattcccatgcgtagatgactttcatttgggaatgttttctctaaaacattcccagaaccttgcaaacataaagatttctggatcagatctttctctgccagctacgacactgtccaagtttggtcaacagtgccaaataggaggtttagcactatataggatatgtgacctctgtccttgaggaatcaggagacaggaaacgggactcgcctgctgaacctgggagcctgtgcctaaacagggggattataatccctcccccacctacctcaaagtagtggattttttttttttttgaggcggagtctcgctctgtcactcaggctggagtgcagtggcgcgatctcggctcactgcaagctctgcctcctgggttcatgccattcttctgcctcagccttcctgagtagctgggactacaggtgcctgccaccacacctggctaattttttgtatttttagtagagacagggtttcaccacattagccaggatggtctcgatctcctgaccttgcgaaccacccgcctcggcctcccaaagggctcagattacaggcgtgggctaccgcgcccgaccaaaatagcgcatttttattaaactgctcaaatcctacaatgatgaggtgatgcattagtctgttttcatgctgctaataaagacatacctgagactggaaagaaaatgaggtttaattggacttacacttccacatggctggggaggcctcagaatcatggcggaaggcaaaaggcacttcttacatggtggcagcaagagaaaatgaggaagaggtaaaagtggaaatccctgataaacccatcagatctcatgagactaattcactatcacgagaatagcacaggaaagaccagctgctatcattcaattacctccccctggttccctcccacaatttgtgggaattctgggagatacaattcaggctgagatttgaatggggacacagccaaaccctatcagatggggtggggatgagaacagagaggtaaagaaagttgttcatgtgttcacatcaatgtccatgagatacttgtacacacaggacaacttgggactggaaaaaagaaggaggggcagagagcatggagctgaaacctcatggctggatctcagcagcacctcatcaaagcactcactctcatctggacggggctcagacctaaccagggtctgctttcttagacaagacctgtttgccaagaagtgctaatattatacacaatttggatacacccagcactaaaaggatattaaatactatcagcattctaggggttttatcggatgccaaatatcttcttataaaccaaacatctggatcaatttgaaattagagtcccaagacaaaaatagaaggcaaaagggaaaataatgaatctcaaattcaaaggcagcctccaatctaggtcaaaaggctgagccctcatgaagacatgccctttggcccccctcccctgggcccacccaccctcccactgtcctcttgtcccaggaagctgtgtgagaacatgctcctcaggtgcccccacttctacaaagctgcagggaacactgaccagccagcaagctcacggtctgggaaacttcctttcctctctcctccccatctttaatcaaaacagatgttcagactggcagtgctgccctctctttagaatgctttaaacaggcagctgccttgatgccgggtagggctgggccaggagagctcaaaagcctttaaacattattaaaatgttttacttaaaaattagatcaataaactgtccattccttgggcggtcgcacaatagtaagcatcttgctttccaagcgtggcagatctcacgaaagccgctgcacgctcagcagcacagaatccaacagcacctgagacccacagccaaggaaacagcagcccgcagctgccacaatcaacttcctggaggacaaatggccatgccactcctcaatctggagtacaatggcgcaatctcggctcactccaacctctgcctcccagattcaagcgattctcctgcctcagcctcccaagcagctggaattacaggcgcccaccaccacgcctggctaattttttgtgtttttagtagagacggggtttcactatgttggccaggctggtctcgaatttctgacctcgtgatccacccgcctcggcctcccaaagtgccgggaccacaggggtgagccaccgagcccagcccccagctctttatagaaaaagcacccacctccctgccctgactctcccgaggggacagagtcctctccttgctcagtctggggctggactgagggagtcccagaggaagaagaggaggaagatagaggaggttgtgctgggcttcccagcttgcagcatggctggcagacacagtcttggggaagtggagccagcggtgggtgaggcagggtggcccgagccctctctcatgctggctctgctgagcatggggactcctgagaagggggtctcacaaaatccactgtgaggttgccaccgggctgtggaacatgtaaatgaaaaccaaagatggtgcttcattctgagctcatgtgattttcttctttattaaacttcaggaaggagagctagaattggctccttaggatacctccccgagccctggtacccatcgtggcttccttctctggctcctgtttcagagactttggaagaactgtctccttggtctcagacatcacgatacccggatctcagctgctcgccactgtgcagctgtctgcagggcggctctgtggggctcccctccattgccccaaccactgcgggacttgttttgtagcagggctggtttggaaattccttttgggtcacctccagtggttccacggcaagctaaggaatggtggccagaagatgacggacaaaacttgaatacgaaggtggaggaaccttgtgggcagggtggggtggtcccctcagggtccgtctaccacaatccaaaatagcattttccctttgacaaaccctgggccaccagagagaagacctggggctggggtctgctgactgtcatcccaggctactttgccttgcagatgctcctgtcctggctctgtgaactggagatgctggtggcctccatggacatccattacgatatttcctccccgggagagtctctgtctctcactccatctttctggaccgaggccaggcaggtgctgtgggcatggctgcccttagttgagcatagaccttcccttgacccttcttttgtgatctcctccctttaagaagcagctgcccctttctttctgctggtatgcagttccttggttctctttggaaatcaagggaatggggtacacaaaggtcagaaatgccaagaagggtagaaacgggaagtctgttttgagttactctgacctcatctcccagaggcctctgtccctcccttgattgggtctctgcctcagtgtctcctcctcaaacagaaccctctctacccccactcctccctatcatgttctcaggagttttgagccattcctggcttgagtttttcttcccggcacgtagtatccacagcctgacatgtccacatgcatctgctcatccagggaataagctccatgagggaaggagctgcctgggctgcagccagctggattctgtgcctaaaacagggcgctgcaccccctgggtgcttcctggcaagctgttattgctgaatatttctcccatccaagtactaactgggcattatggccatagactgaaaacttctttcctttgggagaaatctcacacagaagagggtgcagagggttgcatggtagtccccaaaagatagccatgtcctagaacctaggaatatgatttatttacaaaaaaaagggtctttgtggatgtaattaacttcaggaggtagagataagatcattctagattatctaggtgggccctgaattcaatgacgagtgtccttagaaaagacaaccagaggagagacccacagaggagaggaggaggaaggctgcgtgaagtgaaggcagagacagagaccggaatgatgcggccaccagccaaaggatgcctgcagccaccaggagctggaaagcagcaaggaagggtcctccttccagagcctgcagagagcacagctatctgctggcaccttgatttccaacttctgtccttgggaagtgtgagagaatcaacttctgctgttctaagccacccagtttgtggtaatttgttaggcagccacaggagactaatgcaggggcaggcaccaccacacctggatgctgggcgtggtgaaacagaccccgctatggggcaaagagtctgcaaggagagacagacaataattaagcgaggaaaaaagtgtatataattacagcttgtgaagatctcggaaggaaacaggtgggattgggagtcatggggcagggggaggggaaggcaggagttggcatttcagttgcggtccaaggtggagatcggaaagcatggcaaagcctgagtccccacctggctccttaccccggcctctgagtctacttgctccttcccctgtcctccaccccacaggagggatgatccttctaagcacaaataatagcagtcgccatttacaaggtacctaccaggacagctgcaagaggggacgtggctaatactaatccccattctaagatcaaagaagccaggctcagggagggtaagtgactcttccatgtttaaaccgagatctgatcccggagtctgttcctgttccgctgggcttaatggactctcctcaccattcccatctcgctcaaaagcgcccaggtgttgtctgctgtctgacatatgagacccacgctcctcagagaagcattcagggccccctatctctctgatttccatataaattttcttccaatctactgccacaccccaccagggaacttccaatgtatccacacagacctactcacctgtttttagcacctttatgaacctgcttttaataattatgttataaagtgtattataaatcatattataaaaaaatacaattgtgacattgttactgcctaccatttttgagccctgctatgtgtcctgctctgtgctagaggcttggcctgtatgatcagcttgcggttacaagcgcctcatgagatacgcttcagcagctgcgttttatagacagaacttaggaccctggcccgagactgctgattatgtgtctgggcccaatgtgttctactacattctgcccacaatgttcttgtttctttctgctaatagccataacaccagacgtttcattttcacggctttgcaaaatacttttacatatttcttattctttttctttttttgagacaggatctcactcgtcccccaggctggagtgcagtggtctgatcacagctcgctgcaacctggaactcgagagatcaggtgatccccccatgtcagcctcctgagtagttgggactacaagtgcacgccaccacttctggctaatttttgtattttttgtagagatggggtttcgccatgttgcccaggctggtctcgaactcctgaactcaagtgatctgcccaccttggcctcccaaagtgctgggattacaggtgtgagccaccaagcccctggcacatatttcattttattgcaaaaactttcctgattatccccagatgaaggtgtctatcttcaatttgctcccagtaagatcagggacagagggtggaggctctggggagaggctctgtctcacccaatctcccacaatctccatcagtgcccatcaccaccacaccatctcaacgaagcccaaaatccaagtgttccaaacaatgagctcgctatgccacagtgcaaatccctgggttgctctgaaaatcagatcaccagtggcagctaagtcctccctctgagaaacactgagtcatatcccctggcagggaccatgacctctgctccattctgtccccctcagagcagaaccccccacccccgccccgaccctcatgatcctaggggctccataaatgctcctatgtctgatttgactgatacactcgccacgtggatgggctcaggaaggatgagataccacacaatactcctgccaatgccccctggctgtaaccccagggctgggcaatttatgaagtagacaggagccacacaagctccgttatcacagtaaaagccttgtccaggaacaatgttgcctttcaaattgttttccgccttggacagtggatttataaactgaactggtggctaggaacagaagcccatctgcaaagactaaacgccttgttctacgcgggcctggtttagtattatcctgataagataaacacagatcatagctggctggaggtggggtacttttctatatgtgtctccacgtctacttttacttatgcacaggctgaaattgggggactgctttgcaagttaaagggagaagaaaaagccattttctggatctctttccagaaaggaagttgaatgtaattataagatgttaggtttgtctctaaatagctcagaactaaactgatgtggttactctccaaaaccgtttattgcattttcagtgtggtaaagttggtttgctattgttgataattgttgaagctggataacacacatacggggtttattatggtattctcctatttttatgtatatttacaagtctccataataaaaaccaaaaaaaaaaaaaaaaaaaaggcagttgggtctgaatatatgctgtagctgtgtgatgagcatatggggttttatgattctagtattctcctttttgggtgtttgcttaaaatgttacatggtttaaaaaagaaaagacaaaaagaaaagtactttggttgaacaacagtgacttaaagccactttccttttatttattcattcagcaaatatttatttgtgccatatattcttctagctactgagaagacagaagtccctgccccagtggaactggcattatccccacggtacaaacattcctccagtgtgaatacctggaggggctttcacagcagtgaaagggtagctctggggtgtggaggttggttctttttttgttttgttttgagagggagtctcgctctgtcgcccaggctggagtgcagtggcgtgatctcggctcactgcaagctctgcttcctgggttcacgccattctcctgcctcagcctcccgagtagctgggactacaggcgcccgccaccacacctagataatttttgtatttttagtagagacggggtttcaccatgttagccaggatggtctcgatctcctgaccttgtgatctgcccgccttggcctcccaaagtgctgggattacaggggtgagccacagcgcctggccggaggttggttctttgggaggggaccgaaatcactctagaccatgggtgtccaatcttttggcttccctgggccacactggaagaaaaagaattgtcttgggccacacataaaatacactaacactaaggcagctgatgagctaaaataaaaaaattttgcaaagaaatctcataatgtcttaacagagtttatgaatttgtgttaggctgcattcaaagccatcctgggctgcatgtgacctgtgggccatgggttgggcaagcttgctgtagactttgctgggaggtaggggcaaagaggagcggccctggcttggcctgggaatctatccagtctgttactcttaagcaccctacagcagctcagatggagggagaggagcttcaggaagcccctgcaatgtgtgctggtctatccattcattcattaataacagctgcctccttgtccctcctctaaggctgaaacatatttctagaaagagtttaatccactccttgccttggggccatgctgtaaacacttgggatagatgcctgcctatcccacatttaaagatctctggggacagagcaaccctgagacagagctggcaagggcggccagggctgtggatttgtcagccagggaccaggggacaaagccttctgtgttgctctgtgctgttaactccaccgcatgtgattcatcttacttggcaggggatgggtagctgaaatcctgaaatcactagctttcgggtttgctacctacatccgcccctctggaggcccttttcagcatctggggtttggtagagacccacaccaaaaaaatcagtccacgaaaaacctcaacacaggagctggcctcctccagagtggtacttctggtacctgacttatggcaagatagatcaggggtttctgcaagaacagaagctcttgggagacgaaggttgaatgtgtaatcttggttgccagtcagcctgccatcgtgcgcctggggcgaagggacatgatgctgctggcttctttggcgggagatgggcaaagtttgggtcagcatctttgttaaaatccgtatttcacatcctgtgcttgttctactgcattctaccaggacaaagaacttgactgcaattttattttttaatagttttccattaacagttggggtggagcggtcattttaaatctcagaatcataaagtcatttctatctaatctttgggcagtaagtacagctgcttctgaatcacatacagtttgaaggaaacctaaaatgccaggaggacatttaactatttttatatacaacagccaacatctggatgtattcagtggtttctgaacatctccaagatacaccgccatgaaaggcggggctggggactgccagggaagggacacaggagtcagaatgcacagccctgcccccagggtccccaggccttaatgaaggagacagaacaagcaatccaaggcaagggcaagaaaggggtaagacagaggtggggctgtgtattagtccgttttcacgctgttcataaagacatacccaagactgggcaatgtacaaaagaaagagatttaatggactcacaattccacgtggatggggaggcctcacagtcatggcagaaggtgaaaggcacatctcacatggcggcagacaagagaagagtgacagccaagcgaaacgggtttccccttataaaaccatcagatctcctgagacttatccactaccatgagaacagcatatgggaaaccacccccatgattcaattatctcccactgggcccctcccacaacataagggaattaggggagctacaattcaagatgagatttgggtgggaacatagccaagccatatcaggctgacacacgtggtacacgtgggccctgcacaacctgcagcctgaagctccaccaagctcagatgggacgacgtgcttgggggccacattcaccttccatcacattccatcccagtggcagagctgggaaactttggaagaactggtctcattttgcagttctcacccagatgtttggcatggttttggcactgccaacaatgccttccaggaggttaaagacctggaatttcgcctgaagagagggaggtgtggaggaagctgatcaagcctcagaagtggggatctatggaggacaaaaactagctccgctctccactgaggagggcacacaaggacgtggtgttgagggaccatctccttgtgtggcgatgctaagcaggaaggctgtggggccagaaagagctctttcaagagatagtgagtgatgcagtttaaagaacagagacctggctaggcatggtagctcatgtctgtaatcccagcactttgggaggccgaagtgggcagatacctgaggtcaggagttcgagaccagcctggccaacatggtgaaaccctgtctctactaaaaatacaaaaattagccaggtgtggtggtgcatgcctgtagtcccagctactggggaggctgaagcacaagaattgcttgaacctgggaggcggaggttgcagggagccgaggttgtaccactgtactccagcctgggagacagagggagattctgtctcaaaaaaaaaaaaaaaaaaagaaaaagagaaagaaagaaagagaaagaaaaggaaggaaggaaggaaaagaaaaaaaaaaagaacatagacacgcagagtgtggtggctcacgcctgtaatctcagcactgtgggaagctgaggtggaaggactgtttgagcccagaagttaagtttgagaccagcctgggtgatataaagagaccccatctctatagaatgtttaaaaattagccagctgtggtggtgcctgcctgtagtcctggctactcaggaggctgaggtgggaagattgcctgagcctgggagatggaggctgcagtgagctgtgatcacaccactgcactccagcctaggtaatggagtgagactctgtctccataaaataaaataaaaaagaacatagacatttctcagggtggacagatcactaaccttggatataccaatccacatgctctcataaactcgcaagctaaccctatcttcctgtgttctactgagtccaaagataggaggctactgtttttttctttaggcagcacctagcacagtggctggcacatagtaggccttcaagtgcttgaagcatgtactacctagggtggtggtctcaaccaggccaatttggacccctagggaacagtgggcaatgtctgcagacatttttggttgtcacaactagggggaaggcatctagtgggaagaggctaatgcacagggcaccccccgcctacaacaaagaattatctaccagatgatcaacagtgccaagttctagagaccgacggtcttccactctaccaaatgagtcatcaaagtacacgacagtgccaagttctagcagtcatatttgcacaaaagcaggaagggtccatgggagagtatgggaattcctcttttccagggaattttaagagtggattccagccaggcatggtggctcacaaatgtaatcccaacactttgggaggctgaggcgggtggatcacttgaggtcaggagttccagaccagcttggccaacacggtgaaactccgtctctactaaaaatacaaaaattagccaggtgtggtggtgcatgcctgtaattccagctactcaggaggctgaggcaggagaatcgcttgaaccctggaggtggaggttgcagtgagccaagatcacgccactgcactccagcctgggtgacagagtgagactccatctcaccaaaaaaaaaaaaaaatggaagaaaggaaaaaaaaaattgattccctctgtctttgtggggttgggagtcagaaagaaagaagacataaatgggctgcctgatctcctaagctcccttaccgccccatcaccagacaccagagctgtcggttggcaggtcttcatctgtctgcctcttcctcccacttgggtttattttataggcttttcctgagatattagggggtttccatcaggagtggatcccttccaaaccacaaggcaatgaaaagtcctgcatgtgggactgatgtgctggtgtgtatgtgctttaggagcgagaaagacagcaacataaaccctgtgcatcaaagccaaatccctctacactcaagttccaacttgcagaaatttttatagccaagtaatgatatgcaaagctgatggccttttaattatagcagttccgtgtggggagaaataggagaactattataataaggagacacagtaagcaaaagaacacctttgaatgggcattttcttgctggggtaaaggtaacatggggggttggggggcgataccccacagggttccaagcatgtcacccacattctttgtcttgacaatatgcccgtgaaacacacagagtaaggtttcctgcccccacttttctgatgatctgtttctccatggccaaactgaagtccagacagattcagtccttaaatccattttggaaaactgttaacatccatggccaaccaagatcaactcagagttttcagaaaccaagaacctgaatgaacataggagatgtttagctatcttctatctcagtgtctctttgggagaggcttagaaattaatttctctgtttgatgatccctaaacagaggaacccacctcaaaataagacaaactgttggccgggggtggtggctcatgcctgtaatcccagcacttcgggaggccgaggtgggtgaatcctttgaagccaggagttcaagaccagcctggccaacatggtgaaaccccatctctactaaaaatacaaaaattagccgggcatggtggcatgcgcctgtagtctcagctacttgggaggctgagccatgagaaccactcgaacctgggaggtggaggttgcagtgagctgcgatcatgccactgtactctagcctggacgacggagtgagactctttccaaaacaacaacaactattatttttaccagagcatacctgctatttgcccaaacactgtatggagcattttagacatatcaacttgctagttcatgtaatcttcttatgggagataaactattatcatccctcactgacagatgaggaaaccaaggtacagagatctcgattcacttgttcaagactatgtagctagtaaatcgcagcacctcgatttggacctaggaagtctgacttcagggtccttgctctaatgtggtgctaggctccctttctggagaacagctccccagttttcccatcatttagattaaagaagtcaaagatgcggctagattcactggtcctaaggaataacagtaaagatgaggatgtatgttgacaaatcccttttatttgatacgcttttcagtgggtcctgcaaggccctgaattttatggtagactctatgcataaagtgatgctgtccctcaaaaaagccaaagcgccatctgtgtgcattttatccacaaaccaatggaatcaaccatgaaggaccaggggtatgaaggtcccctctcataccttagcatgacctggcagttccctggggggtcctcttcccctctcagtccatgtggtttagctggagctccagtccaagctctagggataaactgtgaccctaccctgaacaatgggtgcaactccatctctctagccacagtgattggtccaagagggagtaagtggcccaagttggtctattaggattccaagggagctattgagaggagacggtctattttgtttggacttgaacctgggaggatatagggctggagtcattagcaggaagccatcttaacaccattagaaatgggcaatcatgcctatgctgaagagagcagagctgagggagagaaaaaataagcagagacctgatgatataatttgagcctctggaccaaactgtgcctgaaaccagcatcccagactcttcaggtccatgaaccagtaaattctctttttagtttaggacaatatgaattgtgtttctgtgtcttgcaaatgatataaatgaaaactagaaacatgtcattaaaggagacgcaaaagtacactataatgatacttttatagtgaagacagtggggaaaaggcggttatcaaggtcctgctccctctcccccaacctttatcttaaaggagaatgtaaacttttgtagaacatgaggaatgtggttgaatttatatgttccatattaataagtacagctgattgcaactattatcagtaatttcatagaattggttcctgtgtaagttatttacccagctgcatcaattctctcatccacagccacaatgtacccttgacaccagctggccacttgtaacgatgggatctgggtgacaggctggattaagggtgaatgggttggcccatctcttccatctgaaggtcaacatcaaaggtgtggcaccctagcagacagagggctacctaactcgatggcggaggttggattttggaatcaaccatgaaggaccaagagtatgaaggtccctgctcttacattaatgtgacccagcagttccctgggggaaccctcttcacctctcagtccatgtggttcagctggggctccattctgagctccagggatcagactgtgagcctaccgtcgacaacgggtacaattccatctctttgtagtgaatgtgcgacattcactacagcaaaaatcttttgcctggaccagttacttactttattaatcctggatccagagagtaaagatcaaggaagcacatttcttcctcccaatggttctattctctgtacattttttattccaaggcccccagaaaactttcagctattttctggtccccaggacacgtggctgccagctctctgccatcttgggaagtttaagtgtgagggaccaactggccagatggagcctcaggtgtttgggacctgctggaaccggcaaacagctgcctgccgacaccttgggtttcagatgtggggtgtcatcgtgtttgttttccttctgattgaattattcatgtctcatttgtgcacttccctgaaacaatctcttctagatgcatttagaaacttgagtctctgcggtttgtctggactggtttctatttgagaagaaggggagtttgcttgtctaaagcaaagaaaaatgggttgtacacaagtcacagtatccttgattttctgtctcatatacttctttagttctctccaggaatcaggattcctgatggaatgccttccttccctttggaaactcccagtggagcacaggggcgtgtcttgccaactctgtagtgttcctaaagaattctcaattctcaaagaacactctggcaaagaaagaatgggaaacacattgcaagcttaaagggcagtggcaaaacaaataattactgagcctgttggtaaacagacccaaggagacaagtgaattcagcttgttcactcttgcctgtcagaaagaatttaataccaccctgcttctgtttttcttcccctcatgacccaagttagagcttgcttaatttctgtttacaatgtaagtctcatggggaagaagggggagaggtctggccagagtagggaagaggatctgccttcccagggagtgctccctatggaagagtggttctcatcctgtctgcccaacagctacctgaagagcctgggccccagcccaacacaattcaaacagaatcactgagtaacagggcccaggcatcagtatttgaaagttctccacttgattccaacgtgtagtcaaggtttagaaccactgctctagggccgggctctatccaatatggtagccatgggttatgtgtggccgttgagcacctgaaatatggtgaatccaaattgagatgtgctgtaaatgtaaatatacagtggatttttgagagttagtatgaaaaagagaatgtaaactatctcattagcaattttgctaggccgggcatcatggctcatgtgtgtaatcccagcattttgggaggctgaagcaggaggactgcttgagccctggagttagagaccagcctgggcaacataggaagacccccattgctacaaaaaatgtttctttaagtagctgggtgtaggggtccacacctgtaatcccagctactttggaggctgaagtgagaggatcatatgagcccaggagttggcagttgcagtgagctatgagcatgccactgtactctaccctggatgacagagcaagacagaaagagaccccgaatgacagatgtctcaaaaacaacaaagaaaataagttttgctatattgattacaactgacacaatgtggacctgtcccaagtgagaatatgtatacatgtataggcagggagacactggtggtactgcagggcagacaggaaagcaaataaagatcacttaaggaggagaaatattgaagaactcctgtgtcatcaagcaactatgaacacatcatcatctccacatttacgagttgcacaaagtcccgatcattccctctggcacccctacatccacatgggtacacatccttgttctgttatattaagtcagggttcatcttgtttccaccaaagagaaaacggttaggaaggcaaagcgtacggcatggaataataattgccaagcaaaagccaaagttcagccttgaagcctctttttatccattcttctcaagcatggcaaaaatatcctcaaaggacaaccagtttaaacgataagggttttatcagtaagaggcaagtcaatagaatttaaagataaacacataatcaattctaatttctgcagaacaataactacactataataattttgtaccagacatggtagtcaatctgcttgccaagtccattgtacagaaccagactgctccactccagttccgaggttctcctggactctggacattggccacttgccctgtatcctgcttgagcagccccagcaattctcatgtgtgatggttaattttatgtgtcaacttgactgggccaggaggtgcccagatatttggtcacacattctgggtgtttttgtgagggcttttggatgagataagcattttaattggtacagtaggccagactgccctcctgaatctaagtgggcctcatccaagtaagttgaaggcttgaatagaacaaaaagactgatccaccaccaagtaggaaaaggaaaaatactctccagcagactgcctttgaactagaaccacaccatcaactctcctgggtcttgaatctgccagcccactgtgtgaatttggacttgctggctcccataatcacatgagcaaattcttcgtaacaaatctctttctatatatacacatcctattggttctgtctctccagagaaccttgactggtacatcatgtcattcttgcctacagcctgttacctcatctcctaatatcggggatggtctcagggacccccaagttcaggaagacccatggccacagcattgcttctccattcttctacaatctctctgccctttccaaggagagttcactcagcagttccattcagtctccttgaagatattcttcccaacccatgactgagcatcaagattgacttgttttgagaagctgtagctagctcaatgataagccttggatttgctttcttgccttcctgtgttgttcacttccttttcacttttgcttctgcggcagcacactgctcacaactcataacgcatgaactttgcctttggctctgttttctgagaaacctaggcaaagccttttttcttttctttttttttttttgagacggagtctcgcgctgttgcccaggctggagtgcagtgacgcgatctcggctcactacaagctctgcctcccaggttcatgccattctcctgcctcagcctcctgagcagctgggactacaggcgcctgccaccacacccagctaatttttgttgtattttttagtagagacagggtttcaccatcttagccaggatcgtctcaatcttctgacctcgtgatccatctacctcggcctcccaaagtgctgggattacaggcgtgagccaccgcgcccggccaagcctttttctttttaaactcacttgcctgatgaggaaatagctgagtgcttttttattgtggagacagggtctcattatgttgctcaggctccagtgatcctcccacctcagcctcccaaagtgctgggaatacaagtgcatgtccccatgcctggcttgagctctttcttgataggtgtgctcaccaattggcccaggtgtggacacctgcctcaagagatctgatgtataggctgctctttcacctattgcttgagggtttctccttgaacagagatgagctgagccaaatatcttccttctcacttaattaaaacttgataaagaaaaaggtattcaatggacaatggctgttgggcaaagaaatgatgaaggaagtttgtgtgtgtgcacgtaagtgtatgagagagacagggagagagagagaactttccaggttcaatttcagttcatgaagctgaagattttcttgcccctatttcctgtatcctttcagtgaatgtcccttttcacttctaattgctgatcaacctgaacttaactcttttataagtaacctgcttttcctatctggatggttttgtgatattttatgtatctgcaactcaaaagttttcccaggatatgtcacattgcaattttcttttcattaaattcaactaaaatgtggttgatttcttttgagctgcatcctcagattattttcccctcaggttccagaggttttattttcaattataattttgattgttgctcctgttcaaattgatctggttgctctttgaggaacatgcagaagtctctgggtcatctgttctgccaaccacacctattgcttcccctgtctctcttaatttccctcttcgtcctttgcttacagggagaatatatcatttttctttcatacagccagcatgcttttctacaatgccagtgctgttcttatctcctgccagtgactttctactctggcaccatgatttcagttcccctgtggttctcattttttaaatccacccacctttgttttcaccttgatttgttttctttgaatcacatcctgttattctttcatctctgctttggcttgaatgtgtatgtccctccaaaattcatatgttgaaaccaaagacccagtgcagtagtattaagaggtggggcttttggggaagtgattaagtcatgagggctccaccctcaagcatgagattagtgctcttataaaagaggttgaagggaacacccaagtcttttttgccctcttgccatatgaggacacaacaaggtgccatttgtggagcagagagcaagcccttcaccagacacagaatcttctggtgccttgatcttggactttacagcctctagaactgtgagaaataaatttcaactattcataaattaccctgtctattttgttgtagcagcatgaatgaactaagacaatctccaccttataaatcttataaattgttgattttatttccaagaagccacgtagtgtcttcctagattattttagttgaatgagaatttgatttttcttcctccacctccactactggctttaaaattaggggaaattctgcccagatgttgctgtctttatttttagcattgttgagcaagttttcatcattttaatgtcttcacacagggcttctggcaagatgctattttaaaccaaatggcccaaagtgaagcttctagaatacaattccaatcacatcctccctcccccttttaaagccctttagtgtctctgctttgctcttgcgacagaattgcacaaccttcatacagcatgcaaggcctctgatgatgtgggtcctgcctacctttgcagcctctccctttcctccttccccacctgcctgcctaattcttatgcaatcctcaggactcagcctggttgcctaaggcaggctctgctcattattcccttatccattcctcaataggaaaagaatccctgatccttggctggacacatggttgcatggaataaagacagcctcccttgcagctaggtgagaacatgtaactaagcttctggccaaaaaaatgtgaaggggaaaagacgggtgcaacttccggacaggtccttaaaggggggaagtgtatttcttctttactccctctgcctccatcccactatttgggatgtggaaatgatggccgagtaccactgtggaccaaggggctagagatggtaaagtagaaatctagacacaatctaagtcacagatgaccgtggtgtcatgctacttaactctaggtgagagagaaatcaacttcttatttataccattataaatttggattctgttacaaagagcaaacccatattctaaatactacagaactggcactgtaagtgaagtactgcaagtaacaagacctaaccatggggcaacagcttcctggaagcccttgagtgcaggcggtggggacacaggaacatttaggctgcaaagctggagattcccatcaggttgagcaacaccgtgagtgacatctcccctggctgccccttgatggtcatagctctggggggaatttttctgtaggaaaaattcagaagtgtggcatgtgctcacttttagaaaattctaacgaaagacatgaacagccagaaatggaaaggaacagacttgtgcaagaaaagaacctttctctgtctcctgctttctagattgatggaaaggcccttaatttgagaaaatgcttctgtaccttgaacagaagcagttaaaatgaaggctgcaaagcacagggcttagtgagggattagactgatgccttgtcctacaaggtctgctggcagaggtgggacaaagactgttgcctccccatgcaagcacatttgtttcagaagactcaaagttgttgtcattaagctgagagggagcagatgggctgagccagagacctatagagaaaggactgggtcttcaagaaggaagacagacaggggacaggctccaaagacatgtgacatatgtggacttcttctccctgttttcatctgcctgtggcagggcctgcctgcctatttgagctagcctgccgggggataacacagtcaaccttgctgggcagcgtaaggtatttaccaaacactagaggccagttctcactccatcttgaaagaccaaagaaaaataacaacaaaggtcaaccctccctttattttttttgaaagcttctactgagtttcagttaatagagtttttgttttttaatagaaggtgatctgaaaggcaatatggagagaacacttgcaggatgtcttggatccacctaaaattttggatggccttaccagaaagcagtgtttgtgagttttgatgttagaattttcagtgtgctttgaaaggtgtccagtgctttgccaggcgacatgaggaactttccacgaagcttgaaggtaaccctcccctagaaagctgcggtgcttccttgtttcctcacccacaaagacccttagtcaaaggatacacattcatgtattttactagacaacagagtgaaacattttttaaaaaaatttttaccttgaaaatctatattgtgggtcagagtggagatatgatcagcagcaggccaagggacaggccaaggaatcccggatccacaataggaacagataagacatgacatgagggcatggggagaggtgaagtcagtcggtgtcaggaaggcaggttaagtccagggcaggaaaccaagttcaagaccctgcagatgagggggcaatggaaaagtcagtgccaataaggaaggatggattagcagctcaagattcaagcagacaagacagtcctaagagtccaggtacaggggaaggtaaacaggaagaagcaggttcgagcaggcaagacatggcattgaagcccggggtgataagacttagcccgtggagttcgtggtggagacttctggatccacagaccaggtttgtaacagggtaagaatctcggctgaaagattaggagccacagtcctaaagcctgggtcagaaactgggtaacgaggtgggagccaagcacaggtgagcagcagcatctccctgtttctccatccacaaaggcccttggtcaccttgatagtgggcccgcatcttacaaagcaggagctcctcctgcactcccagccagggtgtagatgggagagtttccagggggaggcagcagccccacaccactgtcctagacaaaccacattacccttaatacagattagtgactgccaggtcaacagagtgaaacccgaagggttctcatacattgcccttaactcagtcatcaaactcttcttcttcctcctcctcctctggatcccaatctctccgaaaggtattaatagccaactagctgtacacataaaaaaaactgggaggggtttctagccattctcaacccctatatctaattggaccccaagtctagctgattttattatacttacaaaatggtaaaaccaaatccttcccctgcaatgttcttccatcacctccctgccatccctcatctgagggtgataataacagctataacttctctcattccagggctgtgctagatgcttttcaagtgcactctcgctgaatcccccaacactttgaccctggagccattcataggcccattatacagattttaaaaaagcaaactgaggcccagagaagtgaaatgacatttcaaagctcacccagctggtaaataataacgtcagggacctcaaatttagatctacagtccaccacaaaggccgtgcatagatattaggtttgccgcaaaattgtgggttttggctgggtgcagtggctcaggccgggcgcggtggctaaagcctgtaatcccagcactttgggaggccgaggcgggtggatgacctgaagtcaggagttcgagaccagcctggccaacatggtgaaacctcgtctctactaaaaatacaaaacttagctgggtgtagtggtgcgcacctgtactcccagctacttgggaggctgaggcgggaggatcgcttgaacctgggaggcggaggttgcagtgagctgagatcacgccactgcactccagcctgggtaacagagtaaggctctttctctctctctcaaaaaaaaaattaataaaaataataataattgcggtttttgccaatgaaatggcaaaaactgcaattacttttgcaccaggctaatactgttcaataatgggtcgccaaaaaaggaaggaagcaggtaagaagcgcagcagccaagttcataaccctgctgctgacagtgtcaacatccacctcctgctgagtgcctgctacgcaaccagtaccacccaagggctttccttccactttcatttaccccttcaggaaatcccatttacagatgaggaacctgatccttaacaaggagaaagagcttgagtttgcacaccgtgtctgtgttgagcctccttggtaaagaccagagaacaccacctttttgtgattatggggctgtccccaaacctgtcaggaaggcggatgacatggtctgcagctgttcacctcctgtggactgccctgtttcagatctgggttcatggagtgtttcacctgcctggctgaagaaggaacgtggccgtacttgtgaagctaatagtgagaggttcatttgtttaaacagcagttggtggaaaagcatggaatcaaggatctttacacgtacatattcaaaaccacttcacctcgcatcttgcatccatgtagccccttcacgctcacaatttttcctctcgtgatgtctattctcactcagggccaactccacgggtgtgcgaccagtgcagcatcccagggtctgcactcaggaggaggtaagggttggctgcatacatctcatgcacccagccacgaaaggggccccgggagcccgcgagaggctctctcctccaggaagtacccctctgcccaagggcacgatgttacaaggcagataagatgcaccatgactaagttcttcaaaaaattaaaaatcaaattaccgaatgatttagcaatgcctcttctggccatataccccaaagaacctcaagtggggtcttgaagagatattcttacattcatgttcacaagcagcactattcacaagagctaaatggtgaaacagcccaagtgttcatggacagacgaatgaacaaacaaaatgatgcatccgtgcaacctaatattgttcagccttcaaaggaagaaaattatgacacgttacaacatgatgacccctgaggacattatgctaagtgaaataggacggacacaaagggacaaatactgtgtgatgccacttctatgaggtccctagaggagtcacattcatagagacagaaagaaaatggcagttgccaggggctggggggagataaggaatggggagttagtgcctaatgattaatgtatacataacataccatgtaccatctttttttatttttgatttttggtggagtctcgctctgtcacccaggctggagtacagtgctgtgatcttggctccctgcagcctccgccacccgggttcaagcgattctcgtgcctcagcctcctgagtagctgggattacaggcatgtgccacctgtaatttttgtattttgagtagagacgtggtttcaccatgttggccaggctggactcgaactcttgacttcaagtgatccgcccgcttcagcctcccaaagtgttgggattacagacgtgagccaccgtgcccggccaaaatgtaccatcttgatcaatttttaagtgcacagacaggtcatggtaagtgtgaaaaaatacctaactcccgccctcgttctcctcgcaccctccctgacccaccccaaaaaggcccaagggagcccccctgcattcccaacctgcaggcatgaggtcatacaagcggggtgttgggcagaggcccctggcagatggcagggtagggcccccagcactccattctggacagaatgaaaacctgacgacctatctgatggaattacacggaagaaaggaaattcgtcttttaagaacaagcgggaggcggatgactgaagtcccaaagaatgctgtggttgaacctttttttttttgttgtttgttttctggcacagtctgtctctatgactgagctgagtaacgtgtttcccgtgacaaaggcccctttcttacgacagtttaatagctccaatacgggggacagccctgactctcccatgggccagcgtctgaaggcggccacagaaaaagggagggaaagccgccgctcttctccaagttggtccagactgaactgagagagtataaggaaaaaaaaaatcggaaactttaacccactcctgaaataaaaaatagaagttaccaaagggatggggaacacacatgcagaggcacagagaagaatatggatgaaaaagtggcctcagagcccggtgtggtggctcacgcctgtaatcccagtactttgggaaatcgaggtgggcggatcacttgaggacaggagtttgagaccaacctggccaacatggtaaaaccccatctctacaaaaaatacaaaaattagctgggcgtggtggcaggtgcctgtaatcccagctactcaggaggctgaggcatgagaattgcttgaactcagggggtggaggttacagtgagccaagacgatgccactgcactccaccctgggaaacagagggagaccctgtctcaaaaaaaaaaaaatatatatatatacacacacacacacacacacacacacacacacatatacacatataaaatatatatacacatatatacatatatacacatataagtatatgtatatatgtatatacttatatgtgtatgtatatatgtatatatgtatatacttatatgtgtatatatatgtatatacatatatataaaaataaaaattttaaaaaatttaaaaagaggaaaaaaaagtggccttggggctttgcgtccaactgtgagaggaagtggagaaagctaagagaggacctcagggacagagaagacgccgatggaggtagggagacccgatgccctggtttcttaacagctgctgtgatgaagtaccacagggatttgttctcacagccctggaggccagaagtccaagatcaagttgtccgcagggctatgctccccctgaaggctctaggggaggatcctccctcggctcttccagcttctggtggccctggcacttggtggcattccccagcttctagacacatgactctagtctctgcctccactaccacaaggccgtcttccctccacgtgtccctgtgtggccacggggcactgtcctctccgcatgtgtcatccctccttgttttataagggtacccagtcatgttggacttaggcccaccctaatccagtacgagctgatcttaactaattacatctgcaaagatcctaccgccaaataaggttacagtcacaggtcctggggattaagacttccatacctttctggggtgcatgacttcagcatcgctccttattctggaacttacaggacaggtcactcttgctctgtagctctccctcggagtgaccctgcacatcggctgtctaggaggtgaggctggagaagtgagtcatgaccgcaaggccaccagatcacctcagtaccacctgtctggagttttcccttctttcccccttcctgcccccggtatctcactgctgggcggcactggcaagggttatggttcttaccaaagtaacactcatctggagcaacactcaaaaccatctttaacagaaatatttgcttccagttaacaccgaatacaaaatctctatctgtccctcactgtggattttttacctaggcttgcatttcgtaatgagccaaatgaggtttgattttaaagaagcatctgggctgagggcagcagctcatgcctgtaatctcagcatttggggaggctgaggcggacggatcttttgaggtcaggagtttgagacctggtgaaaccccgcctctactaaaaagagaaaaaaaaattacctgggcatagtggcaggcgcctgtaatcccagctactcgtgaggctgaggcaggagaatcgcttgaacctgggaggtggaggttgcagtgagctgagatcaggccactgcaccccagcctgggcaacagagcaagactccatctcaggggaaaaaaagtgtctgacaaattggaattactatagtcaatgttcaaaggattcataatgggagattagacattttcacaactgagttgaccccatttcccacacgactttgggggagagttttgaagaccttggggtcacagccaggcacgtcacttaacagcagagtgataattaagagcacaggctctggagctggtcacctgggttcaaatcctagaggagtcaaattcatagggacagaaagtacaatggcagctgcccctcacttgctgtgtgctcttggacacagcctgcttctgtaaaatgggaatgataatttccagctttcttgattgttccatgattgctagaggctggcagaggaagtttattcgtgggcttctgaatcagatggaagtaagtcttgaactcctggcctcaagtgatcctcctgcctcagcctcccaagtagctgagattacaggcatgagccaccatgcctggctagacagaagtaagtcaaatcctgaatctaccaggttcagtggctcacgcctgcaatcctagcactttgggaggctgaggcaggcagatcacctgagcttaagagttgaagaccagccttggcaacatggcaaaaccccgaatctactaaaaatacaaaaaaaaaaaaattagccaggtgtgatggcacatgcctgtagtcccagctatttgggaggccgaggcatgagaatcacttgaacctgggaggtggaggttgcagtgggccaagatcatgccactgcactccagcctggacaacaaagactctatctcaaaaaaagcaatcctgaatctgcctcttaccagaagaatgacctctgagcatttcccctgcctcccgaggccccgtggccacatgtccatactgggatggcagcgaggactgagcaatgcatgtaagcagcaccaagtgccacatgtccccacgagtgcgacacaagcaccagtgctcctgagctgcctttcttggcgtaccaagcagaatgttttaaaatgaagaccctgccccccagaactaaaccgcacccacagctccctctgtagtggcctgaccttcctcagcaggctgccctggaagacagaattgctttcttccccaagtcgcttgtaacaagctgttggggaggacggacagggcagcagtgggaacggagaagagaaaagaagtgtgcgtcatctccagtgcccgggaaagccgcaaggaaaccacactgccattttcagagagcttgacggggccctccctcccccaaggtctgctccaggctaacagagtatacgttgtgcagagatagcttcctgtgccaagatgtccaatccctgtcgccagggacttgggtgggggtggctgggggcagtggcagaggaggaaagggccgcagcataaaagccccttgtgctgctcatggaggagacgctgctgcccggcggatgggggaggggcagcactgtcatcttcctttttgctctgagaaggtgacttgtgtggttagatggaaggggcccccaaatgagtccaggaaactggggcgcaaaagggaagcagctcgtgtgcttgtgtggtctggaggggccgacccttgccgtcgacacccctagcacagagctgaccacgcattgcctggttctgggtcccgtgcagagcataaaagaggtgacccaggctctgctcccagggaggacacaggagagagaaaaacaccacacaacgaaggctggggacaagggctgggcagtaccagggccagggctcatgagcatgcacagtccatgctgtgataagatgacgaagtcagcctgggagggcctcgggggaaagagggcaaaggatgtgaaggccccttataaagcacggagctctagaaacaggagtagaagcagtgggagggcagagcagccaggcacactcacagaccctgctcctggacctgggctccgagtagccaggcacactcagagaccctgctcctggacctgggccccgaggcttggatgtcaattccctgcagacagtggaagctacttctgagacagttcttctcctggggaggcagggagtggggagtgcttgtcctggacctgagtggaaatagaaatgggctggccatctagctgtaggatgtgtcatgggtgtgccaggaagcaagagcagtagcttcaccatggacagtgctacctaccatccaccaggctccactcagggagcttttcctagagaaattcagttcattggtcagaacaatccactgaggtagatactattattctcatcttgcagattaggaaacagaggcacataagaaaagcaacgcatcaaggtcatagacccagttgatgaaagagccaggatttgaacccagggagtcaagccccagaatccatggtcttatatagcatcaatagtgcctattcatcccccgaacacatacaatgaggtatgagggggtctgcagtaagttaaacttgataggaaacaagacccacccactcccccaggctctcccacttagcttctcctcctgcctggccaggtcgcctcatagcctagaacaccccaaaagaggtaggttctggggccagagactagactaggcacagacttgactgctgtccctcgccttttttttttttttttttttaagttttgagacaaggtcttgctctgttgcccaggctgaagcgcagcagcgcgatctcggctcactgcaacctctgcctgctgggttcaagcgattctcccgcctcagcctcctgagtaggtgggattacagatgcatgccaccatgtccggctaatttttgtatttttactagagacggggtttcaccatgttggccagtctggtctcgatctcctgacctcaggtgatctgcccacctcaccctcccaaagtgttgggattacaggcaagaaccaccatgtccggtcttgactgctgcccttactagctacggggctgtggacgagaggcatctcagtgcctcaattttctacatctgtaaaacagggctcatcttgggtccatgtgtgatgattcaagagaatgaaggtaaaagacagcacaggactgggcacacaacaagcactcagcagagctcccctacataacactcatcattactgtggtccatggaccaagatgcaggatgtggccctgagaaaggcccttgtcatgatgatgctctgtgtttgagaaacagaactttaaaagttaaaattggctgggggtggtagctcatgcctgtaatcgcagcactttgggaggacgaggcaggcagatcacttgagttcaggagtttgagagcagcctggctaacatggcaaaaccccatctctactaaaaatacaaaaattagctggatgtggtggtgcatgcccataatcccagctactcaggaggctgagggaggagaatcgcttgaacctgggaggcagaggctgcagtgagcagagatggcgccactacattccagcctgggcaacaggcaagcctccatctcaaaaaaaaaaaaaaaaaagtataccctgtaactcagctgtgaattaaaaaattatttttctctcggatattattctgtcccagggcccccatttccatgaagtagccaaagaaaaaaaaaaggtcaatccaaaggaattcagtatcttccagtatcaatttcttttccatgctaatgattctcttttgggataatacttaggaattcaagaatcgagatccctcctagggctgtgacttccttctctcaaaaagactccccttccctccctgccctcctctcattgatggcttctgcacacagggaaagacaacagggaagcaaaagtcaagggaacacattttaaaaatacaccgtccaatttcaagaaactagattttcaacagatgaaaacagtagcagaataaattgcagagtccagatcatcttgtcgcattgcccaatggagttcaaacggattagtttgtatcaagagcataatgacaaaccaggtattattatgcaaggttttcatattgttttacagaatttgaactggggtggggtgggggagggaaaaagtaaggtctttggaaggtctttggtctttctgtttggaagacagaaaggactttgttttatcctgagctcctgatttcatgaactaatttctggtggtaaataacacttttttttttcttttttgagacagagtctcgctctgttgcccaggctggagtacaatggcacgatctcagctcactgcaacctccgcctcccgggttcaagcgattctcctgcctcagcctcccgagtagctgggattacaggtgcctgccaccaagcctggctaatttttgtattttttagtagagacagggttttactgtgtttgccaagccggtctgtatctcctgacctcaagtgatccaccagcctcgacctcccaaagtgctgggattacaggcatgagccactgcacctggctgcactttctagaagggtgatctctcataaaataattcactgaccatggcggtctacgattgcatctttccttcaatgccttcactttgaaaaatataaagggtggccgtcgtttgtcagtctttacatatttgggggacgtcttcattgtccaacaaagcccaacagtctcatagccatggatacaatctgcctttctcacatgatgcacgtagaaactgaggcacatacagtaagggccgagtgctcagtcaggttgtcaggtgcttgtcaggtgaagtcccagatgcttcatagagagatgtcaccaggaggacagagtgctgaaatgagcacgtgtcttaaaatccctcccaggattttctttgtctttgtaggagtgtaagagtgtgtgtgtgtgtgtgtgtgtgtgtgtgtgtttgcagcctagctgtcaggaggtctggattagagaatttctccatccttcaaaggaaaaccatctttcagagtaagtagtagcaggaagagatggatgacagtaactggatttgtaataccagtgaggccaaccccaaacacacacaaccatcaccctacatgtggattgtctgtgctaggagaagaaagtacaggcgtgaagagtgctaacttcagaacaccccaaaatcaactagatttttctttttgccatttttgaggtgatacatttacttttcgaatgacttccgttgaataatgttatttgttccatcagtcctggggagtgaagaaagtgggtcgtaaaagtctgccagacacagacgaagccagaccaagatggaaccttgtgggcaatctcaggttagcaggtaatcagatcattcacccatctgtccatctgtttatccaattcaacccagagattcacaagcaccaggctccatgatggcatattttgcaggcaaatggctattaagttcttcattctcctccacgtgttctggaaaatcaccaggtttccaggtaacgacgggattgtatttgtcagcacagaactggggatgtggaggacaaagtctccaaggagtagttcttcttccctggtaggatttctcagtcaaagaaaaatcttagacgtgcaactattgggcgatcagtggtgctaacacgggaacacacatcttactggcaaaacactgtcccttttatttttttttttctgtaaaacgttgctcttattgggagcttgaaaagcattatcataaaaagccatgggaagggagaaggggagaggaaagagagggacagagggggataagaattgcccaggtttggacaaggactctggagatgaggcccaagatgattcatttctccctgttcgcttcccagccctcaatcccatctggctcctttcatttgagttttctattgcaatgcacaaaacagataattttccaaaagcttgctcaaaagcttccaggtggtccaagaatgggaggggcacttcttgcagttcaaatgggacaagagaaaaaacatcaagaaagcggtgggggggagtgagcttcagaggggaagctgagacaatgaggaaagcagaccttttgagacatcctggatgttccctccaccctctgaaatggaaacatgaccagctacagacagatcagctcttagaggggaggaaagagccccagggttcaggaaccaggagctctgacttgagtcatccctgatgacttccttttccactctgagacttcagtttcttcacttataacattagagacttgggctagatcagggattttctgccaagtgcagaggggaactttcatggaaagggtggtatctattccatccagagtgttcgcttaggaacttgttccaaaagctcaactgctaaaaaaaaaaaaaatacttaagaggcaagatgatctttcaaagtcatgtccagcccaccagtcctacaaattcaagcctgttttcccagttgcagttgatgaaataactattctaagttctctctctccaaaaagatgaatcctgtgctcagtgaatctctgtggattgaagggatggatggatggacagactgatgaatgacttgatggcaaattacataggatggtgagaacctgtttgatcctggtctggctttgcccatgcatccggtggacttccttggcctggcccactttcttcacttcccagaacgcatgcaataaataacattatgtttttaagtcactagaaaagtaaatgtcaccctctcccctccaaatggcaaaaagaaaaactgaactgatttttgggtgtctggaagtgaggacttttcgcacctctatgctcccctgctagggtagaccatcaaaagcttggagtagcttctgacactttaattggcccatttcacatttctacccctctacgtagggtcacataaaagctatacttttattcccaacatgggaaaataagacaataacgagctttataaatgcttaattaaatggggggtgaaaaatcagggtataacagccagaatataaggatgttactattttgaaaaatatccaaagcaaagttggacatgtccaaagttacatgtaacttacatatatggtccttagccttctgcagatacaccttctgtacaagccgaacatagatttggatagcgacacacagtcacctttcctggtcaaactttttccttctggtactgtgtctagcaacctatgctaccaagctaccgcgtggtggcgccgtctgtccaccgctgccagccggcactttcaaattccactgtctctttgtaaggtgaggctgtgtagtgtggcaggatgagccaggaaaactgaagagaaggagctgccaatagatcactctagaattccagacagggtagtgtgataggttcaagagaagagcttgcctgcataaaataaaattgagagcacaatgtgcgattgcagataaagaatagaacaggattgtgccgaagtgactcaagggtgggaggggcatttttctgctgtgaaagggtggggacagtgggatcaagatgtcaaagtattttctccacaagtaccttagtgtcctcaggctgggtctccaattctcaggctaaaagccactctccagggagaccaggctgggaatgctgagacccaagttgctaggcagggaggaggttaagatcagcaactttgaggaagtaagggtctccctaggatgctccacgagtctgggagactgagtgctgcctggggcaggtctaggcattgcaagagcagctgcatggaggcttggagggagccagtgaagacagcttgcttgttcaaagatgttagagtgaactataattaaaatgtttccatgtgagttctccgagactcctccccgccacaacaatgaagtctcctttgtaacttctctacaggtaacctgcaagcatgctttcaataatctacaggatgcacacctggagtcccagctacttgggaggctgaggagggaggattatttgagcccaggaggtcaaggctgcagcaagctatgattgtgccactgcactgcggcctgagcaacagaacaagatcctgtctacacacacacacaaacacacacacacacaatctactggagcaaaagtagaggggctgcttggacaggtagacacacatgtaacgtatcttacacatacagacatgctcatctactagctaatgttgatgaatgaccaggaaaatatgtcaaaatatgccacttttctttctaaataaagggttgctttgttaactaatggctgctgtcttaaataattgttaatatatcaacatatatatgtataagccaggggaaaggatttatctgacttacgatctttcctctttgatcagagaggcaaacatatatcttaaaattggttttgatgcctccatgtgtaatttaatgggctatactacatccaaatgtagactaatcaaccatgcctcctttaccaagtgtctgggtgttgattagcagtagctggtccggtcatatcttggggatgtgttttgtggactatccatggcacactaaagttcgcagccagcctcctctgctgtgcacagcctgctctgggatggccgctgcacctgtaggtcaaggcaggtccacagactacaaacgtctcttgacgcgtgcttagtcaaagcttaaaacaggaagtggtatgtgaagctgagtgtttaagcataaacagtcttactctccctgctggtttgaatgatgcctgccactgagtgaagtgggagctgagggcatgtctcctctccagagaacatgttctttgaagtgacgatacagcagaaaggaaaaccgcttaagcatgcaattccccaagcacatacggtctgaagaattcctctgtgattgaaacagaaagaaactgctatgggaccagaacagaaagaagcaagctggggccaggcacagtggctcacgcctgtaatcccagcactttgggaggccgaggcgggtggatcacgaggtcaggagatggagaccatcctggctaacacggtgaaacccatctctactaaaaacacaaaaaatcagccaggcgtggtggcgggtgcctgtactcccagctactcgggaggcagaggcaggagaatggtgtgagctcaggaggtggaggttgcagtgagctgagatcgtgccactgcactccagcctgggtgaaagagtgagactccgtctcaaaaaaaaaaaaaaaaaaaaagaaagaagcaagctgtgtttcccttgaactacaggcctccctctgctggctgagagtcttcctaattcaggagacaatgacctctgaatgaacaccttggtgcaagctgacctggccaggtagggaggtggacagatgggaaggagctggggagggctccaggaaggtgaggaagtaacggcatctgtacaccagatggcagcagccacacacacatgataggcgaggtgcctgcctgtcttcttcccaggtcagaaacccctgaagtgggaactgaagacagtgccttcttggaatagttccttttcttgtgggtggctataatgccacaggcgacgtttatatgaagcctcctgcttcaacagacagggcacaagcaagaggtcataaaaaagacagttggcctcagagtatttaatgatgaatatgggctaaaaacagggattgtgtccactaaaggaggggtctaacgctttctgaaaagggtcagatagccaggtgtggtggctcacgcctgtaatcccagcactttgggaggctgaggcaggcagatcacttgagcttaggagttggaggccagcctgggcaaactcaatctctacaaaaaatacaacaattagctgggtgtggtggtatgtgcctgtagccccagctgcttgggagggatgctgaggtgggaggatcgcttgagcccagggggtcgagggtgcagtgagccatgattgcaccactgcactacagcctgagtgacagagtgagaccctgtcaaaaagaaagggaaagggaaaggaaaggaacaaaggaacagggaggtcagatagtaaatattttcagctttgcagatagtaagtatttccagcttttcagccttaagatttctctggccattatgcagatcagccactgtagcacatatggagccaaagacaatatgtaaacaaatgggtgcgcgtatgctccaataaagcctcatttccagaaataggtgttgggccaaatttggcccgcagaccatagtttgccaacccctccactaaaggagtcataaactatctggctcagttagcttggtgcacgtgtaccctgggcctgtactgggtaacgctttccccaatctgtgtaaatggagtccttcttccctctcagttcactccacggcacgagattaacctacgtctccttgtcacttggactcaaattctcccttctcccttccacgcgacaacaaaatcagctggcaaacgctgtctgtgggttctgtacgcaacagctcttcctgggatcagtcctcattctcatggtcatcacaacatccagtatcttcttcattgctgctaaaacacacagcagtggggtgggctgtaaatattctttttcagttggtgcattcttcacactggtttatctccccacctgctctcccagattattttatcttagccagatgcatgtttgagttacctcttgggtgatgtctcttgcctgcatcggaacccaccatagttgccaactttttgctgagtaatgcacctgtttctttcctgcctcaatccaatcctttatttatttagttttattttttttgaggcacagtctctctattgcccaggatggagtgcagtggcacgatcacggcttactgcagcctcaacctccctaggctcaggtggtcctcccacctcaggattcagagtacctgggactacaggtgcatgccaccccacctggctatttatatatatatatatatatatatatatatatatatatatatatatatatatatttttttttttttttttttttgtagagacagggtttcatcatgttgcccaggctggtcttgaactcctgggctcaagcaacccacctatgtcagcctcccaacatgctgggattacaggcatgagccactgcaaccagccaatccaatcctttagacataccttctctaaagcaccagaaaattctatctcagtcatatcggtttgtccaccagccctgaaaaaaccttggcacctaccttggcatttgctcagagtactacctgcccttatcatccccttaccaaagcagaccacccctatgctcctgatgaaatgtagaccattctatgaagagcccttgagaggagcaaaaagcttgcctgtcttctactggtttcttggtctggcttggatcaagccctttggagcttggactgtgttaatcttatgccgcctatgggcttaactgtcgattaataaattactatgggtatcttttctgctattgactttcaactatatcacatcgaaatcaagacaatgcggtctgaatggcattgatcttagggtatgtattctgactctctctgtggcagagcactctaatccattttaggaaccctcacgtggcttgaaatgaacgtaagctttctaatgactgggctacagtttatatatgtccactgcatgcattttgttaacttaatatctgcgtcatctacaagtatcagacagggacattaaactcccccaccatgactgtgtttctccttgcaattctgatgatttttcctttaaacagttcgaggcttatgttgctaggcgcctacaaacgcagcatcaggatgtcattctggtacattacttcccctttccttaagtactgacctttatcccttatctggctttctgccttcaagtctggtttgtctgagacaaaaatgtaatacccgctttcttttgattagcgtttgccttgtatctttcttcctttcaactttaccatgtcatattttaggtgtgccacttattaatcacttagaactgaacatttaaaaagcaaaacctctttgaagagatgaattccaccatctgacggctgaattatttcactttgattttccatctctcttcccagtgtttattcgttcatgcattctcacttccctcctccatcctatacctctctctctcattagtagttgtccttttagattcactagcatattattattttttgagacaaggtcttgctctgtcacccaggctgcagcacagtggtgcaatcacagctcactgtagccttgacctctcaggctcaagtgatcctcttgcctcagccccctgagtagatgggaccacagatgcacaccatgatgcctagatgattttttttctcttttatagagatggggtctcccatctttatactcagccgagcaataggaactataggtgtgcgccaccacgtccggcgaattttttgtatttttagtagagacgggttttcaccatgttggttgggctggtctcgaactcctgacctcaggtgatccgcccgcctcggcctcccagtgctggaattgcaggtgtgagccactgtgcccggccagccatgcccatttctttacgtattatttagggctaccttggcacttgcacgacagtcagtcaagcagttgtgacagagattatatggcccacaggccatctggaattctaagagaaagtttggcagcttctactctagaatggcagttactttttcttggcactttgaagacagcattcccctgtcttcaattagagctcagaaatcttctgtgagttgaactgtcgtttctgtgtagagaatccgtctctgcctccggtatctccagattctgtcccagtccctggtggatatggtttggatctgtgtctccgcccacatctcatgtggaattgtaatccccaatgttgggggtaggacgtggtgggaggtgatttgatcatgggggcggctttcctccttggtgtcttttgtaaaactattatattattataaatctatccattattaagtattaaaaagtgctttcatttgtgcaaccttatgcagtttttttttttaaataaacctttcattttagattagctttaggtctacagaaaagctcaaagatagtagagagagttcctgtgtaccctgccctcagtttcccctatcgctagcatctcactttggatggaacatttgttacaactaaggaacccatattggtgcattcctttttttgtttgtttgtttgtttgtttgtttgtttgaaatggagacttgctctgttgcccaggctggaatgcaatggcgcgatcttggcacactgcaacctccacctcccaggttcaagagattctcctgcctcagctcctgagtagctgggattacaggtgcccaccatcacgcctggctagttttttgtattttcagtagaggtggggtttcaccatgttggtcaggctggtctcgaactcctgatctcgggtgatccacccaccttggcctcccaaagtggtgagattacaggcccttttcttttctttatttttttcttttcttttcttttttttttttttttttttttttttgagacagagtctcgctctgttgcccaggctggagggcagtggtgagacctcagctcactgtaacctcagcctcccaagtagctgggatcaaaggcacctaccaccacacccggctaatttttgtatttttagtagggatgggagggttttgtaggccaagccggtcttgaattcccgacctcgagggatccgcccgcctcggcctctcaaagtacgggattataggcgtgagccacggcacctggccatgtgcattacttttaactacactatattcagatttcactagtaactacactatattcagtgtattcagatttcactagttcttccctaacgtctctttcctgtacaaagatcccatccagaacagcgcctcgcatttagtctccttcgtcttctctggactgtttcttagacttcccttgttttgggaccatcttggcagttttgaggagggctggtcaggtattttgtccctcggttcgggtctgtctgatgcatttctcctgcagttttgttatttctagttttgtgagtgctatctttcctgcgcagcggcatgtttccctctgtggtttgtctgtattttattttctatttgagtgtaagtgcaaccgtacttaagagtcctcctccttgcccccaggcatctggtgtggctggttagtggaagagttagggctttgtgtaggtaaggactttatgtttgttcctgctagagcctgaaagatttctattatcctaggccagtatttatgctctttatttgaggtttctggtacaagatagagtataaaagtttgtaccatacaccctttgtgtgatgcaggtctagggttttcctatcctgcacatcatttactatgccctataccccatctctctgtccaagatcctggagagaggacaagttgcacacgcaagttcctggaccagtgggtggagttttatagtcccttttacagaaggcaatgcctacaagccctggtctttaggctgggctgtttcagttccctgacatccaagggcaagggcacggctccatccgctccataggcaagaggtccaaccctcaatcctttgaagctctgtgaggatctgaaaccacctaccacggtgtctttgatttttccctttatttctagcatctggcatttctttctccttagtccttggctgtgtagtaaaaaccatgtttactagtttgtttgtttgtggtgggacatccatgtcagctgatctcaccatgttactggaagtactagtgacaaatgttcagcttctaggaagagttttttcatacaaattgtgttttctgcaatgactagcaaaatatgagacatataccactactcactaaagaacgggtgcatgaatgaatgaatgaatgaatgagtggagaccaggactgctcagaagataagctaagcatctgcagcctccgtggaggctggactggctgagtctgggagactccgggcaggcaggggctggtgcacagtccccctgcctggcactctgtgtcacagtggtcctggcctcatgcggccttattcaatgctgaggaccacatgatttcaccaatggctcatccaacagggttgcctgttcactttctactttcatcatcttacagtgtcagtgccttttcttttccctcttgaaagagggaactgagaatgagtgtgggtggatttagtgcaattgatcaagccaaagtctcatcctggattgcaggtggtcatctaaggcaagatactgccttggtgtatgaaccccatagcaggctgtttctgcagggctggcttctctggactctacacacaagcacagatgctggttcgaaagccccagcattatgagataactggaagctgcagcccttgacctccttgtgtcaacaggcacaacactggccccgacctgctatgagttgagcattctacagccttgcagggtggtaggctctgcctgtccaggctacagttcagcacatacctttccctcatggctactcaagtgggaaatcctcactctccactatccttttgtccctatcctcccatgaaatcctatgtgtagtgtgaactaaaggcagagaaagctaacaagtcttggcccaggggctgttctacatcttgccacccaagaagaagatgccagacatttagagaggagggaatcacaaactctacacgtttttcaaagtggggagaatgggctgaagggtctgcttgagggaatgttcttccctcgttccttctctgcagcctgcattgcaggggtcccctggccccagtactctgtggacatagtggcaatggcagcacagctccatcattcctgcccctcaggctgtgacaataatgggtcaggtgtgggggcatatggaccctccagtgatgcttgtatagcagagggtctcgtgaggctgaaaacaccaaggcctgctgccccgactccaccccagttagaggatcctgtcgagggcttttgtaactgagagagaatctgtttggtccggggaagggaggagctgagttggaaatatttttgctccactttcttccaaaatacttataaagactggcagaaagtgcaggtgacagaacagaagaacatcggagttgacatgatgatgtcgcgggggacgtggtgccaccagagagcctggcctgtgagttccatgcctggggcacagctgtcacttgctgggcacagacctctgcagcgtgtgcggtttcctgcgctctgggaggacttggcctttgaatgtttataaggtcacaccctctgggctcttcagccccgtggatactgcttgactctgaagtctcttgtggtctagtggagtcaggatcaaaactgctgtgccaggggcagaagagctacatgcccccaccccaggccccgcgcttagaagagcagtctgcagggtgtgacgagtcatcattagcccttgttttgggtgacatttcttacattctaaaggctctgccctccttgtctaccatctcatgtgattttcaccataagcatcattttaatgaatgacttgggagtctgagaggcaggaacatgaagttgagaataagaaaagtttcgccctggaacattccagcccatgcacatattcggggcttcatggagcaggcacgcttcttaacgtacagccttagaattcagcgaccagcaatgactacatttaacacacaggggctccatttcagctggggaaacagatgcaaggaagcggcctgaacacagtcctcagggcgcataaacaggccccacgcaggcttggtaaccagggaaggatggaaaaggggttatgtgagaaattcgtttctgacagtcacgatcaatgggtgcaggagggagtgctatttccttgggggagtcagggagaatattttgggactgcatcagtctgaagacagtgaatgagctccaagagtgataaaccagtcgcccttgagccactgcactgagttatgttttaaaataactgtgaattcaagtacctttagatagtgcgcgtgctgtttaaagttcgccttattcctcatggttcccagctgtcttcacctgactgtctccacccattttgatgatcttttagtcccctgaagccacttgagtttgctgccctcagatagaaggctccatcctgcagagtgtggcatttatggctttatgggcctgggtggaccatggaaaccacagctgcacgatgtctagagaacagcatgtgatcccaaggctgtgaccttacctatgccctgtttatttccaggcaggtagaagagcaaagaatttacaaggcccagtgcttctgtatggaaggtgagggaaaacgcggcattgagagtgacggcagggttggcttggtcaactgggtacagcggtgacagggaaccctggaggaggggcaggttctacatgacagcagatggagaaatataggaacatattcaggacaaaagactcagctggagcttgacttgggtatcatcagcaaacacatggaaaataaagtcacaaggacggagaagattgcccagaaatggtgtgttcagtgagaaggaaggatgctctggatacaggtccctgggaacatcacctcttaagaacaggccataggatgacaagcccaccaccaaagggcctttccaggagcaggtggaaagagagagggaaacgaagggaccctagcatcaagaaagacaaagggagggcttcaaaaaggaaaggcctgaagagtgtcagcggctgcctttgttttttgtcattagtcttcacacctttgaagtgcttagagtacagcttgcgattctatccatgctttgtttccaaaatgatcatcacccacttaatagctcagttgaaagactcctctcttaggagactcctctctcagggatggccttcaccggaccccatgtggcctccatcagtcttggtcctgtggggctggggtgctgaacaataatgcacagacagcccacccaggtgacacgcacacccagagcacccctgggtgcagaaccatgctctagggtcccaggatgctggcttacctggcactctcaaaggtagcagatgccgtcttttctatagccccaaatccaactccaacagcgagaccctctgaaatagatgtaagaaaagcaagaggggttaggaatatttccccataaggaacatcaccatcactgtcactgcattaagtaggactgcatgaggctgccagtcaaagaaaatcatcgtaacagcagcttaaacccagggaaactaagtcatgggggccaaatggctgctgccttcttctctatggcctgcaacctaggaatgatttttgtattttttaagtaattgaaaaaacaatgactatttcatgatacatgaaaattatgtaaaatttggccaggcacagtggctcatgcctgtaatgccagcactctgggaggccaagacaggcagatcacctgaggtcaggagttcgagaccagcctggccaacatggtgaaatcccatctctactaaaaatacgagagttagcagggcgtgatggtgcacacctgtaatcccagcgactcgagaggctgaggcaggagaatcacttgaacacaggaggcggaggctgcagggagccaagagtgtgccactgcactccagcctgggtgacaaagtgagactctgtctcaaaaaaaaaaaaataaaaataaatttatataaaattcaaatttgagtgtctgtaaatgaagttgtactggcacacagccatgctcattggctgacgaaatgtttatggtgggtttcatagtacatgagcacagttgagtagttgggacagaaactgtatggcctgaaatctaaaatatttactttctggaactttcataacccctggcctaaacacacagggctttatttattagctcatgcaacagaaagtccaaggttgatacagcagcccaaagatgtcactgcagacataggtgtctttagttttcatttttttttccttcattctcaccattaggtcctcatagttgcaaagtgactgtgctacctccaggcatctcaattacatcctaggcaagaagaaagtagaaaggtagaaacctttctttaacaagtctttgtctcattactctggaaggaacatctttcccagcatccctcatacctcttcggccagaacaggagcaaacgcccatccctagatccatcgcagcctcaggccccaaatactgagactccaggaccaattgaggccagtctcaatccctctctggggctgggaaagagtctaccctgcccatgctccctgaaatcaagggagccaccatctgaataaactggggtcttgtcagtagcaaaggaggaggggtggcgtgatcaccaccaccagcatgcatttttatttttatatttttatgttttattgagaacggagtcttgctctgtcacccagactggagtgcagtggcatgatctcagctcactgcaagctccgcctcccgggttcacgccattctcttgcctcagcctcccgagtagctgggactacaggcgcccgctaccacgcccgtctaattttttgtatttttagtagagacgggctttcaccgtgttagccaggatggtctcgatctcccgacctcgtgatccacccatctcagcctcccaaagtgctgggattacaggcatgagccaccgcacctggccaagcaagcatttttatatgactgctctttgaagaacattccagctttcaaaggaaccaccctcatatggtgcagacagatgcggtctacactgatggggtggctggagtcgagtgtgcagcgtggggctagacaagatgggttttcacgtcctttcctgtggtacatgggcttgccaagttcaccacccactcgcctagggatcagatgtgggaggatgatgctggtctgcgtgtatctgatggcgcagcgagggtcatggaaggaaatggacctgatccagtggccacggaccaaaggagtggaagcacagcatcagggcgcttctgacatctgtgaagagggcgatgattcccctcgatccaaacacgaaggagaactactgaattaccaccactgttcaggagcaaggccaagggctttgggggtcaaattcgaactttcttttaagaagagggaagacataaaaatcgactgaatgagaggaactcgttttcttttgattcattgcctcttagtacagcgcatttctttcttgtgtcctgtctgtttgaagtgggtccaggatgctggaattgtgacactgactccaggagacacctggggacaagaaggcagcggagacttatcccatgttcaggtgaaagtgctcacctgtgatgcactccagctcaacaagagtccgcaatggggtctggagcccaaagatcctgctaaggaataaggtgttcttttttttgcctaattttaccttttgtgcttgatctcctgcggggtcctgatgggatagctgtgatcactgtaagctgcaggttgagaatttcggattttttttttttttttgagacacagtctcactctgtcgcccaggctggagtgcagtggtgcgatctcggctcactgcaacccccacctcctgggttcaagtgagtctcctgcctcagcctcccaagtagcaggactacaggcatgcgccaccatgcccagctaatttttgtacttttagtagagacaggattttaccgtgttggccgggctggtcttgaactcctgacctcaagtgacctgtctgcttcagcctcccaaagtgctgggattacaggcatgagccactgcacgcagtgagaatttgggattctgattccctaccaagtatctttccagttataagaatttttataacaaccaatgtcaggacacggagtcctaggacaacagaggtggaggaaactgcagagatcagccactgtgactcctgggccactgtcagattcagaagccaggtagtcagagggaggtctttccaaaaccagacagcagcatcaagccttctgggcccggcctctcagcgtgcacgtgcacaccttagcagcccacagagaaggctccaaaaccctccctttaacagctctgaggctgaaggtggctggctggagtcagcaccaccagagcaaccaggctttaaaatcgatacgcatttttaaaaattattttttatttacagtggacccttgaacaatgcagggattaggggcgccaatcccttgcacagttgaaaacccacatataactttaaactcccccagaaatgttactaatagtctaatattgacgttaccaagaacataaagtcaattgacacatattttgtgtgctatatatattatatacagtattcttacaagaaagtaagctagataacacttcttatatttttacagtaaagcaagctagatagaatttctttccttttcttttttttttttttttttttttttgagatggagtctctctctgtcgcccaggctggagtgcagtggcgccatttcggctcactgcaagctccacctcctgggttcacaccattctcctgcctcagcctcccgagtggctgggactacaggcgcccgccaccacgcctggctaattttttgtattttttagtagagacggggtttcacaccgtgttagccaggatggtcttgatctcctgacctcgtgatctgcccacctcagcctcccaaagtgctgggattacaggcgtaagccaccgcgcccggccagaatttcttaatgttaagaaaatcataaggaagagaaaatacatttacagtgccgtactgtatttatcaagaccgtacgtttatgttgtctgtttataaagaggagttgtgtgtctgaaatggtaggcacccacagctgcagacctcaaactatggtacatatcaagcaagttcattttttcttataacgtcatgacttttttctgcttcttgggagcacttccagcatccttaatggtactttgtgtgggtcccgtgctgttattcaaggtttacgatattgcactaaacatgacgaaaactacgtaagaactgagagagatcactttttacgggactatgcaattcactgcagagatgaactgctcatgaggagatgctcagtgtcacaaggcctttttttatttttattttttatttgtatttgagacggagttttgctattgttgctcaggctggagtgcaatggcgcaatcttggctcaccgcaacctccgcctcccaggttcaagcgattctcctgcctcagcctcccgagtagctgggattacaggcgtgcaccaccatgcccggctaattttgtatttttagtagagacggggtttctccatattgctcaggctggtctcgaactcctgacctcaggtgatctgtccgctttggcctcccaaagtgctgggattacaagcatgagccactgcgccccacccaacaaggccttttaagcagacgcccgcaacacttgagctcactgcaacagcaacaggaggtggctacaaaattgttacagtagtacagtgggctgtagttaattctatgtagttatgacttaatatatcgtttacaaaatgttttaatttttaaaaaagtttttcatagagatggtctcactaagttgtccaggctgatcttgaactcctagcctcaagcgatcctcctgcctcagcctctcaaagtgctgagaatacaggctaacactgcatctttacgtttgcttacatttctcttcactgtgagtggcaccatatatgatctgtgtttgtgggtataatttttgataaattttaactttttataatttgtgtatttttacagtaatcaatgatagactagactagtatcgacacatatatttcactgcaggtataaggcttatagcccagtgtctagcatacaaagggccaccagtcccccatttcccgaggcaaagaatcacagagacgttaggatcttgaagaggaggcctaatttggagcctagaggcctaatgtggagcactagtatttgcattaaaatgactaattcaaatataggtgggaactgtcacctccagtccacagatcagagagggaaggtgatgggagctggtctgagagacacaggtgggttctgagtccgaggcccagggtgttggtccttcattactcaaggaatatatatgatgaaagccataactcaagtatcagaaaggggtgtggatccatgttcaatattttaaggtttgcctgatggatgcaacatcatcaaaaagaggtaagcaagaatgagtacccagccgggcacagtggctcccgcgcctgtaatcccagcactttgggaggccgaggtaggtgaattgcttgagatcaggagctcaagattagcctggccaacatggtgaaacctcgtctctactaaaaatacaaaaaatttgctgggcatggtggctcacatctttaatcccagctactagggaggctgaggctggagaatcgcttgaacccgggaggcagaggttgcagtgagccaagatcgcgccactgcactccagcctgggcgacagtgtgagactccatctcaaaaaaaaagagtatcctacgtgaggtggctgacactggtgagagctgaatttcagggcaggctgcgatgggtatgcctaagggtttctgacatcctttccgttagggaggaggcagcctcgtttttgcagcccgagtcgtgggagctgcccgtgtccatggtcatgagaatatgaacttcgagaacatctgacctgctgccacctggccagtgtcctgcctttgaggagtccaggatttacaagcctgctgttctcaaccttgtttggcactaacacaccggagaccatcagtaacggtgggtctgcaaggcacagatcttcaccagggatccttggggagaaaccaagcaaactatttcctgacactagacaggcgtatccctccctttgagaaaattcactttctaaaaccataaacaacagctggttgactcttttgttaaaaattttccttttttttcctttgtgtacacatttaattttattgtaacagacaactcgtgcacttttaatgtttaaaactgagcatcatctttcctttccagggaaacaaaaagaaaatttaaaaataaacaggaataaaattacaatagagaatgtcaattccaaataagatcctacaggttctgctgattctcccattgagtggcagggctcaagtcatcattaggagagaatttattttaaaagtgtcatcttaaaccgcaaggatatctgtcagatatcacaattaaacatgccaaaggagaagccatgttttcaaaatgtccccaaaattttcttctaattagtcattttaatgcaaataatagtgcagcccagagcactaggacctgtgctaattagcaaaacaatcgcttggagtagcttagctcacagcctgagcttgctgacttgtgacataaatgctcacagcagctttgggagattggggaagggagcacccagtgagcagatgaagaaaagggcctgccctaggtgacccagctgggggggctagagctgggccgtaaaccgcagtctctcattgtttcctgcccccaagtgtcctctgctgcccagtttgcttgcagctttcccccagctacaacatggccccatgggtagtgaacactggcatctgagtctctgtaccctgaagaggtttggagcaaagggaatgcattttccctccggcccatcctgtacctcaggccaggccagtagcaggggacaaaagttcacaaatgagcattctgtgatggtttgcaaaggagcaggtccttcctctcaggtctgcagtggccctggcgggagagaaccacaactccacgctgccttaggaggcatcagcccactttccccctggatttagaaagcgaaacaggaagaagaggtcctgggggaagacaatgtatctgttaccgtgtctgaaaacagaggtgatccccgagagctaagctcatgagaaggcaggacacgttagttatgcatgcagaaggaacaccaaaacgagaattcaggccgacactgaagatcaacagacggtagaaagaactcactggggggaaaaggaaaggaggaaaaatgctgactgatgctcatgcccccagtgtcccacctcgagtgcaaatagaagaaacccaactcatactgtgaataacttcttgcccctttacacagctactgccattagctcagggaaaatgaactgcctggcctgggttagtaagtccgactgaacgcagggtgaggcagagtctggaagacaaacttgaacataagcaccaaagcggaaggagctggctccaacctcctcctggggctggaaggcggctctgcctgcctctctccacctccccattgcccttgcaactccatccctccatggcctcctctgcggaaaacagtaacaaaaagggcatgggctttggttgagataaacccaggctcaaatcttagtatattatttaaggttcttgcaaaaatgaaagggggataacactgctttgcttacaggatggctgtgttcaatgaaatgtacctgacaggcctgttcagggttccccactattgacatttggtagtcggggactatcctggccactctagggtggtttgcagcatccctggcctctactcactagatgccagtagcacctcctgtcccagttgtgacaaagatgtcttcagaggttgccaaatgttacttttcttctctcccaatgagggacacttacagaaaaaaaaaattaaactcttatattaatagaacattcttagagtttaagtcagtgctaggaaagcaaacaataaaaaacaagtgttttctttttcaatggagccataagcagctcttacttttaagggcatggggtggagtttgcagtcttcttgcccagttctggaggctgagaagtctgagatcaaggtggccgcagatttggtgtctggtgagggctagcttcctggttcacagactgggggttccttgctgtgtcctcatatgataggaagggtgagggggcctctctctcgggcttcttttatataggcattaatcccactcatgagggctccaacctcaaagcctaatcacctccccaaagcctcacttcctgataccatcgcattgggggttagcatctcagcatacacatcttttcttttttatttgagatggagtcttgctctgttgcccaggctggagtgcagtggcacaatctcagctcactgcaacctctacctccctggttcaagtgattctcctgcctcaacctcctgagtagctgggattacaggtgcgcaccaccaggcctggctaatttttgtatttctagtagagatggggtttcaccatgttggccaggctggtcttgaactcctgacctcaagcgatctgcctgcctcggcctcccagagtgctgggattaccggcatgagccactgcacctggcctcacatttttgagaaacacaaatgttgagaccacagcacctgacatttatgggcattggtaatgagtggatgggaaagggcacctgtacacggtagcttgagaagtgcaatcaccttggtttggcagagcccgctgctggggcagaaatggcccactcagaggtgctgtggggacattcttctcttcctgccagactatggtccctgggatatgggcccagctgtcagatcatctcagcaatgagaggggcttctaaataggatacagttgtttcagggtggtcagaccaggggtaggaactccagggctgtcattccccttgttctggacttgacccagacctcatggaagctcatgaatgcattcctcttgggtggttttctcacaggggatcccttctgggctcacaggctaactgaaagctcaatctttccctgtatgctgttgtgaagccactattctccgccctgtgcctgtaccattaattctttgtctcttagggcattatatggatgtcactaaatctctctgttccacgccatttgttctccaactgggcctctggtttaagcactcatagtatcagttttagaagttatagccagaagaagtctagaaaatatcaatgcaaaggccatgcagaaaataagcggtgatgctacgacttttcctccttgatttaaaaaagtatttaaattaagataagcagataagaccctgtggaggattaatgaatattaaacacagccactaccaccaccaacaaaccccaaaggtggagaaatgacgagttatgggatggcttattcatttccatctcccctaaagacagagtaagagaaaaatgacttaaattacagttagacggatttaggcaagaggcaaaactatgcttgagagaggagggctttgaaacatatgataaagaaactgaaggaaggtcaagggtgtccttctctgcatgaggagtgttctctgaaggtgggagctactcctcagtcagggatgactgggatggggagagaaggtgggttaggaagaacagggcaggtagcctcataacatccctcaggccagatgacacttcaccaataaatacaggctcagttctaggagcaaggctgaacatccacatgtacattctcaggtcccaaaaggcactcattaaaggacagaaaaataaccacgttgaggggtcaggtgtgatggctgacacctgtaatcccagcaatttgggaggctgaggcaggaagatctcttgggcccagttcaagaccagcctgggcaacatagcaagaccccatctctacaaaaaattaaaaaattggccaggtgcagtggctcacacctataaccccatcactttgggaggccaaggtgggtggatcatgaggtcaggagatcgagaccacagtgaaaccccatctctactaaaaatacaaaaaattagccgggcgtggtggtgggcacctgtagtcccagctactcgggaggctgagacaggataatggtgtgaacccaggaggcggagcttgcagtgagctgagatcacaccactgcactccagcctgggtgacagagcaagactccgtctcaaaataaaataaaataaaataaaaattagctgggtgtgctggtgtgcacctgtagtcccagctactagggaggatgagatgggaggatcacttgaagctaagagtttgagaccagccaggacaacatagtgagaccctgtctctaccacacacaaaaaaattggctgggtatggtggcatgaacctgtggtactagctactcaggaggctgaggaggaaggatcgtttgagcccaagaggtcaaggctgcagtgagctatgatcgcaccactgcacttcagcctgggtgacagagcgagactctggctctaatttaataaacaaaactaaaaacaaaacatgttgaaacatctattgctggagtggacaatgggggctttggggacagggtgtgcccacctccagctgcatcaggagcctctgaggtgctggacaagctcagatttatttaatatttccatttgagacagaatcttgctctgtcacccaagctggagtgcagtggtgcaatctcagttcactgcaacttccacctaccaagtagctgggactacaagtgcacaccactgcacccagctaatttttgtatttttagtagaggcggggtttttgccatgttggccaggctggtcttgaactcctgacctcaggtgatctgcccacctcggcttcccaaagtgctggaattacaggcgtgagccaccgcgcctggccaaggacaagctcggctttgattccttgtctgtcccagcctgtctgggaagtgtcactaaactgggagaggacaacacactagggacgggagcaacgtcacgtaacactgcagcagggatttcctggccacagtctatcaggagagccgactcacaggcttagacacaccatggggcagggctgctgtcttcattctcactctgagccccaaaacttagctgagccttctggggagactagctggctgatgatttgctgataaccctgcatggcgtgtctttggttgcaaaggtctagcaggaagcaaaaccaagaaggcaggaactctgatcatattacacaattattaaaccaaatgttggtagaaccagccaggtattattgccaaggaatccctgtggagtctgttagaggctgtataaaggatggaaacttaccaacttattttcttgaaaaagtagtttgatgcagttttccagtgtggattactaatcctgctatttatattggaaaaagatacatgtggggaaagatgaaaaatagaagtgttctagaaaagttgactttaaatcaaattcttatcaataaggccaggtgcagtggctcacgcctgtaatcccagcactttgggaggccgaggcgggtggatcacctgaggtcaggagttcaagactagcctggccaacatgggaaaaccccgtctctcctaaaaatacaaacattagctgggcgtggtggtgggagcctgtagtcccagctacttgggagggttaggctggagaatcgcttgaacacgggaggtggaggttgcagtgagccgagatcgcgccattgccctccagcctgggcaatagagggagactccatctcaaaaaaaaaaaattcttatcaataaagtcacatcctattgtttattaagaaatattgacaattgaagatactctaacatgaatcccctttgtaactaaaataactacttcctaattaatgttgacaagtgtgcttttttggcatatccgattgtttcacgttgggatccctctgaacagtgacagacccagaaaatgctattctccagtcatggctgccgacttagagttgagcctgactccagcagactgcgaagacacaggcagcgcctcgtttgtatgactgaagacagccacatcttcaaacaacaggtgaaggcatctggttaaacacccacatctcggagtcaatttcaatttgctttagttctcaataaccagacaaagatcagatctctgtgtttcctcagagaaaaagggagagaatgcctatactggcattgaagattccgagctgttccaactaacgagctccgtgtcatgcccagatgcatgcctctagccaactcccctgaccttgcaccatggtcgtccacacctgggtttgccctgaatctgaagaagtatatctgcaggcccaaggacagaccaagtacgggagaggggccagaaagggcaccgcagtctaccctccgggcctctttctgccgagctgagcacacacagttgttggtttttatttatttatttaatgaataattgcttataaccaagggagttgttagttttgaggtcaagggactaagcagaagcaaagaggcaggtgaggtaggttctgactcagtgggggaacctgccgtcagaagagctgccatcttggaagacacaaaaactcaagattccctctgctttgcccagcagggaattatcatgaaatccctgtgccctttgagtggggagggctgctatctgttgctcccaaacactctgttccaccaatgaagccgtggtgtagaaaagcttgcaacccggtagcaaagttccttgactctgaagtcagagcctcatcaatcacctggccactgggcttcctctccctacgtccaaagtccacggcaggcagggaagtgtctggatctgacagattcactgtatgaaagtggacaggcttatgttctggggaaccttgtatattcacaacaaagttgtctgggaggcttagaaagcagggacaacctaagcagctctgtaaatatgaggacacaggacgaaggaagcatgaggcaatgagtagtgtggtcagacgggaattatttttcccaagacaagcctattttgtgataagtgggccctgggcagcagaggtgggcaggctctctggtccccttgggaaaccggggctgcagatggaggctttgctaagtgccaccccaccctagacagtgggagcagtccccagccccacactgcacaccgaaggcaggaggtctctaatcactggtcacagggatctctctgcttgatcctaggaaaatgctgcctctgaggtgggtagaccattccaggaggaagaggggaaagcatggctgaaagcacctctatgactccaggctcagattcgtaaaacactagatggaagtcgtaccaggaattcagccacacatccctcctggctgggaaggcctgcagctgagagcacacgcacaaagagacacaggctccattggcccagcctctcacctggctcatgaaaagatcaatgccaggagttctccacaaagagactggggattcctggggcaaggcacaagccagatgggtcgaggaatcaggtgaacctctgcagcaggtgggtggcgcccattctgtgccccttgggagccaagagagtcaccctgggaattatcccacaagagggtctcacatccccaggaagtggatggccactgatccctgctattcctcccccaagttcacatgaagaggtcgtgcagtctgggtcccaggttggacccgattgccttgtcaaagggaaaggcagcctagggccagatacctcggaaccacaaccacatcgcctgtgattggagcctcaccccatcccacaggccgtacatgggcatcatgaactctagcacacacttgactatggaatacctctggaggtggggtggggggtggggaggacttatttatgtttttgtaatttgcatgttcttgagggcctaaaaaaactggaggaaaggattttttttttttaattcccttggaggactttcgaacaaaattagactctggcagttccttcaggatgatgaataacctaagatacaggttcatttatcactccccacatgtgattcccaccaaagtatttctaaaatccaggcaagaaaaagattctgaagtctcagatcactagtatgttttgctacatggagggcaggcatcataccacaacgtatgtatccaagggagggaggggcattttttcctacaagcagaagtatttcaattgttaatggaggaaaaaaaaaaactgccttccttacacatcccagttcagcaattgtcaggcttcaggtgtcagacggcagcctgtcagcgccctgggataggccccgtgtggtcatggccttgttggtcatgccaagatgatgtctgagaagctggcattatggcttagctcaaagagaaggcaggaggctgtgcatggtggctcacacctataatcccagcactttgggaggccaaggcgggaggatcacctgaggtcaggagttcaagatcagcctggccaacatggcaaaaaccccgcctctactaaaaatacaaaaattagacgagcgtggtggtgggcgcttgtaatcccagctatttgggaggctgaggaatgagaatcacttgagcccagaaggcagaggctgcagtgagccaagatcacaccactgtactccagcctgggcgacagagtgagactccatctcaaaacaaaaaagtgagcgtacaatattggtgtgctaacatatgattatataatcaggttgctatatgaaggtaaggaaaaacaatcctaaagcttcaaactcttcccatttgaagaagacagttctaagaatcgtggcccccatcctctcatcgtctaggttttaattaggttctttccttccttcctccctttcttattaccatttttaattgtgataaaatgtgaatgaataacatgtaattgagcatcttcctcatttttaagtgtacattcattggcattaagtgcaatcacttttgtacagccatcgccaccacccatctccagagctctttggtttttttttgagacagagtcttgctccgtcgcccaggctggagtgcaatggcatgatctcagctcactgcaatcttcgcctcctggattcaagtgattcttgtacctcagtgatcccagtagctgggagtacagccatgcatcactatgcccggctaattttgtaattttggtagagacagggttttgttatgtcagccaggctggtctcgaacccctggcctcgagtgatctgcctgccttggcttcccagagtgctgggattacaggtatgagccactgcacccggctccagagctctttttatcttgcataattgaaactctccacccactgaacccagatccccattcctcctcctccctcccacagcccctggcaaccatccttctacttcctgcctctgtgccactgactcctcaggtgtctcgcagagcaggactcacacagtatctgtgatgccctctttcttatgtcatattatccccttgtgtcccttcttcattttgtcagggggcctccttaacctcctacgggatgtgtgggtgataaacttctgaaccctgacatagaaaagaaaaattttgatttttctctgtgacttaatagcttgacttgaaagtgctgcatcccaagttacctctccttaatatctttttttctgttttttctttcttaagatggagtctcgctctgtcacccgggctggagagcagtggcgtgatcttggcttactgcagcctccgcctcccgggttccagcaattctcctgcctcagcctcccaggtagctgggattacaggcacgcaccaccacgcccagctaactttagtatttttagtagagatggggtttcaccatgttggccaggctggtctcgaactcctgacctcaggtgatctgcctgcctcagcctcccaaaagtgttaggattacaggtgtgagccaccacgcccgggccttagtatcttttttctttttatttatttttaagacagggtctcactgtattgcctcagctggtcgctaactcctgggctcaagtaatcctcctgccttggcctcccaaagtgctgggattacaggcatgagccatggtgcctggcctgctcaatgtcttgagggtattgttccatcatcttccagtatctgatgctgctgctgaaaagtctgatgctaattccattctcatttccttgtatttaagaagacttttctctctggaagctctcaacaatttcatctttgtttctggagtttttgttggtggtggtgttgttttgatttttgagataggtctcactctgtggcccgggctggagtgcaatggtgccatcatggctcactgcagccttgacctcctgggcccaaccaatcttcccacctcagcctcttgagtagctgggaccacagatgcatgccaccatgcccagctaatttatttttagtttttgtagagaccatgtcttcatatgttggccaggctggtctcgaactcctggactcaagtgaccctccaacctcggtctcccaaagtgctgggattacaggcatgagccactgcttgttttcagagttttgagattcatcaagatatgtctgagtggggtattttctccattcccactattcagcattaggtggtcttttaaatctacaaggttgtgctttttttcagctcaggaaaaatttccccacatgcctgcacacataccttacatctttgactttgtgtttgggaactggagaattgtcttctacttaaccttccagataacctgcttggcctttcattcagaatattctaatgaatctatccatttaactttctaaaagaattctggcaattatacgatatgattaattttcaagaactctttcttattctctgattattcatttttatcacagtcagttcttgctttatgagcatgataaatatgctcttgaatctccagctgaacatactgctttgaatttttatgttcttctgtctcctgggctccctgttttctccagagtaggttgtcctacttacttcagtccctttttttcattctttgggtttttctcaggtgtctggggatctgttaccttcagagcacattcagggaggcgggttgacattgacgatagttggaaagggcattctccagggttgtacaagtctgtttccctaacaggcctccctgacaactctgaaatttcacttcaaagtatttccttaaagaactataagtagaactaccactggatccagcaatcccactactggatatctacccataggaaaagtcattatacaaaaaaaaaaaaaaaaaaaaaaacctgcacacacgttcatagcagcacaattcacaactgcaaaaatgtggaaacagcccaaatgcccatcaatcaacaagtggataaagaaactgtgatatgtatatatgtatatatatatatatatatatatatacacatacacacacacacacacacacacacacacacacacacacacacacagtggaatactactcagccataaaaaggaatgaattaatggcatttgcagcaacctggttgcgattggagactattattctaagtgaagtaactcaggaatggaaaaccaaacatcatatgttctcactcataagtgggagctaagctatgaggatgcaaaggcatacgaatgacacaatggacttcggggacttgggaaagggtgggaagggggtgagggataaaagactacaaattgggttcagtgcatactgctcgggtagtgggtgcccaaaaagctcacaaatcacccctaaagaacttactcatgtaaccaaacaccgtcgcttccccaaaaacctatggaatttttttaaaaaattaattgaaagcttaaaaaaaagattatagcttcaacttagcagttggcctacagaggatgaggaaggatgaaagaagagagggaaagagtgtgggaatcataaaggtaggtgctgtgggtatttagattccaccattacagcactggaatgatgggacagtggattccttatgtggctccctcctaagcagaaacaccaggggtgccgggccgcagccggggtgacacatgccaggagcaagtagcaggaagtgcagagccaaccttgggagcagaccaatgctgacacacacaggatgcagtgatgatgcagagaaaaggagtgtgtgcaggtgtggtttcagacacgtacacgaatgcagtgatggtgtgagcaaaagggagtgtgcacatgcaagcatgcccgtgtgagtgtgcatgcacatacacaaattcccacacaagcatgcatagaaagagacttggagatggccttctaaacacacaaaaacaaaagtctaaatcagtctcttaagtcctgaaacactagaccatccttacatgaaacctgcctttttgtatccacaggatagccctaacaattaggcagggccagtgtgtcacggggacactccaggactggtctctgattaggaatgtcaagctcagtgtggcccatgaacagggatggtgagggaagagagagaactgctaagaggtggtttgaacccggctttcaaacagctgctgggatcacagatgtgaaatgaggaaaggtctgtgaatttgtctggaaatgaaggaaacctttgcaagtaaagtgctagtgaagacatggatcaaagtcagattgcaaaggagtgaataagggcaacgaaatcaggaggcgaaggccatatagcaatggagggactgggcagagaaggtggagcaagttagggctacgcctgtcaggagtgagcaacagtgtctttaaaacccacatacaaaagcaggaaatgccaatgccaggggagttgggaggatgaccatgggtctccatagacaccggcaacaggtcaataacagccgacaatcaaggtaccatccagcaagggtgcaggcaagataatctcataaatcactgcaaaacacttggtaaatttaaagtcaggcataaatgccaaatataaataaaatatgcaactcaggcagcaaggtgctctaagcctagaggccttcttttaattaatgtcagatttgatccaagacattctcaggctagatgggcaggcaggtgctcagagaatcccgccctgtgggactggcctcctccctgacaagcttcaccaccaggccccaaaattcaggacacagggtgcttctctcctcagctgccaccacgtggaatctgctctccccactggtagatgcaaccctgtgatttctgggagggagatgccaaactgaactagggtagctctggagagccgggagctaatagttggctgacagtggaggggaatgagccaaaggttgacgctgttccaatcccaatatgggtaacgtttgaaaatggaggttagcacctcacacccattaggatgtctactctcgagaaaacaaaaacataacagtgttggcaaggatgtggagacactggaacccttgagcactgttggtaggaatgaaaaatggcacagccagtgtggaaaacagtttggtggctcctcaaaaaattaaaaatagaattaccatatggtgatagcagttgtgacgttcctgaggttccgttttctgtctctgccaaatatttctgttatgggaagtcctgattcacaaggaggtggcaattctacttctggatacatccgtcaaagcactgaaagcagggtctcaaagagatacttgcctacctacatttacagcagcactattcacagcagctcaaacctggaagcaacccaagtgtttatggatggatcaacagataagcaaaatgtggtatatccacacaatggaatagtatactgccttaaaaaggaaggaaatgctgacacatgctataacatggctgcaccttgagaatattatgctgagtgaaataagccaatcacaaaaagacgaatactatatgattccacttacgtgaagtacttagtcaaatgcttaaagacagagagtagaatggtggtggccagaagctgggggaagtgggcatgtggatactgcttaataggtatagagtttccattttacaagatagaaagaattctggaggtggatggaggtgatggttgcacaacattataaatgtatttaataatccaaaaccacagccttacaaatagttaattaagatggtaattttgttatgagtattttaccacaattaaaatatttggggagaaaaaaaactaaaatgaaggctaaggtttaaaagtggtgcaatggccgggtgcaatggctcatgcctgtaatctcagcactttgggagaccgaggcaggtggatcacgaggtcaggagtttgagaccagcttggccaacatggtgaaacccagtctctgctagggaaaaaaaaaaaaaaaccaacacaaaaattagccaggcgtggtagcgggtgcctgtaatcccagctactaaggaggctgaggcaggagaatcgcttgaaaccagaaggcggaggttgcagtgagccgagatcacgccactgcactccaccctgggagacaaagcaaaactccgtctcaataaataaataataaataaaataaaataaaataaaaagaaaaaagtggttcaaggttcaaggcctgaagtgggagctcgcactaaactcttaggggtaagaacaggtaagacccgattcaagtaaagacaggaatcccatgagccaggacatgaatttgactcaatgaccctgaagatggtggccccctaggatgctgtgatgactcaattgagtttctccttcagagctgctcccagttatttcctggtggtgggaaaggtgggcgctgagtctctcccatgctctcctagagcatcactgctgagtaaggatggtccaggggttggggctgcctatggtcgagaggacagtttcggttgtgggacggctttttgtctcccagggcaatgaaacctgccttatgccaccattagtggcaggcactcccaccatggggcctttgcccatgccatcactctattctctgtctggcacatttttttttttttttatcccttcctgcctacttttcttcccctggtcactggctcctcatgcgtcatttctcagtctggaagtcctctcctccaggcagccatcgctggctccctagtctgggttaggatttctgttaaatattctcaccttattgtgtgtttgctgagtgtatccaccgtggtgtcccctggatctagaccaggcctggggacctaggaggtgctcagttagtattttgtttgtttttgtttttgttttgagatagagtctcactctgtctcccaggctggagtgcagtggcgtgatctcggcctactgcaacctccacctcctgggttcaagtgattctcctgcctcagcctccccggtagctggtacaacagttttgtgccaccatgcctggctaatttttatatttttagtagagacggggtttcaccatgttggccaggctggtttggaactcctgacctcaggtgatccactcgcctccgcctcccaaagtgctgggattataaatgtgagccactgctcccagtctttagttagtatttattgaataagtaaagttaatcatggattggatcaattagtcagtcaaagataatgattataagaaaggtctggaagacacagtcaagaaggagtttaataaaaatgtgacaataagacaatacttggttactttaattgcaatctctagctacatgtggcatgctctggcagttcccctattcaatcaacattccctctttacccgttttaacagaattctcattttgttcggtattgaaatgtgcctggataaaaatattcagtttccccatctttcttgtggcaggaggtagcccattgtcatagttcaggccagtgataccgcagttaagggtttcctggaaagtctttccttccctaatatagactccaacccatcctgaagaaaggttaaaaaagggagatccttttccttttcttgcctggaacacgggtgggatgcttggaaccatgaactactgggaaggtcaggagataaacaatggcaaaggcttctgcacttggtcacttgagcagcccagaactgacagccacccggacttcacactgtgtgagacacagaaatccccacctgtggaagccacagctgcccagatcggttgatacttgcagccagagtgttcctaacttgtatacgccaaccggaacattctacacaggactgagatgacccatggatgacagcaattataaataatcttggcgacagcctggctaacatggcaaaaccctgtctctactaaaaccacaaaaattagccgggtgtggtggatgcctataatcccagctacccaggaggctgaggcaggagaatctcttgaacccgggaggcggaggttgcagtgagccgagatcgtgccattgcactccagcctgggcaacagagtgagatttcatctaaaaataataacaataataataataataataaataatcttggaaaacaattacagaaaataatacagataccagatagcagaaaatggctggattttcaatatgcagaaaagatgatagactatataaaccaaataaatgtttttttgtggagccaaaaaaaaatcaaggagaggtcattaaaagtctggctcatgaatttctaaaacagacaaatgagcaaaggaacggaagtggtgatcaagagaaaccagggtggattcattaataataactcacttcacacaaactacaaaattcttttgattgaattttaactagtagagcaggagaatacaaaggattcttaaaaatcacgtgtctggatttccttaaagcttttgattgtcatgacagcatgtgaaaaagctttttaaaagcagtaacatcatggttcagttaactgaattcataactggttgagtggctactcagtgggtataaattaatgaatttatgcaatcttaggaggagataagccacatgtttggccattgctattgtccattccatcttaacatcaacaactctagaggagacataaaaaattcatgagaaaagcacaaagctgaaaacaaaggtaatatacttgatataaacaagacatagaattctcatgggtggaaaatgagctaaaacatttagctcagatctagtattcaagaaaaatataagattcttaatgtaggtataaagaactaaccaagagaagacaggtgagcagctctgggctccaaacaaggaagcgctgtcttgtaattagttacctgtgcggggccccctgccttgtgatacccagagaagtattgggtatgcagatgtccaaatgtcttaggtcatggaatcttgtttgttttttttcttcacaggtcacatataggttttgtgaagcatattttatttttttgacacagggtctcactctgtcaccaaagctggagtgcagtggtgcaatctcggctcactgcaacctttgccttgcaggttcaagtgattctcgtgcctcagcctcccgagtagctgggattacaggcacgtgccaccatgcctggctaatttttgtattttttactagagaagtggtttcaccatgttggtcaggctagtcttgaactcctggcttcaggcaatccacccgccttggcctcccaaagtgctgggactacaggcgtgagccactgtgcccagccattgtggagcatattttagcataggctatttagaaaagacatccaagaaaaccatctgcttcctgtagagagccagtatgatccatctgagccttttgctccctcctattgatgaggctggaccctgggctctgaaacagagaggtggcgttggtttccgtgtgggacactgaacaatcccacggccactgagccaagccaatctccaacccacaccacctacacaccccatctcctaccctgaggagtgctgagaacatgtgggtgactcagcacagacctcccccaacactgggaaaccatttaaaggacaccttggtgtatcaacggggttgacatggtaaacacagaaggcatccttttcatttttattaagaacagatattcacgaccaaggaagtcagccatccccacagacatctcagaaccagctcggcaggcaactcaaatcactgctctccatggaaggctgtgtactcatgccacctccgatgtcacttactgtctgatctgccttccagccaccccactgggcaacgcctggagggaaatcctctggccaaggcagctgctcaacttcctacttgcctgttccttctgctagaatcccctttgtgggcactactgcccctttaaccacatagccatccaaccaacagccatctcatcacctgttccccaggactctgaccgcatctatggaacaaggtaaacagcagagtgcacgccccagctaaatttagcaaaataaagcatgttcatcaaattccaccccaggccttccaatttttgttttgttttgttttgagatggagttcgctctgctgcccagactggagtgcagtggcatgatctcggttcactgcaacctccgcctcttgggttcaagcgattctcctgcttcagcctcttgagtagctgggattacaggcacccgccaccacgcctggctaatttttgtatatttagtagagatggattttcaccatgttggcaaagctggtctcgaactcctgacctcaggtgatccgcccccctcggcctcccaaagtgctgggattacagatgtgagccatgcacccagcccaggcctcccaatttttaagttctattaaagcatttcagtgcaagagctcaaacataatgccaaacgtcagcagtaatgaaaggggagggtgatgtcttttgagaacttgctattttttagccattttatttcacattttcaaacataatccttctagccaccatggggtggagatacaatcaatgtctgcatttgaaagataagaaagcttgatccctgagaggctaagcaacctgggtcatacaacgttttgaaccgtgtctgtcaagcccaaactttttcttttttcacttgtctaagatcaagtgtgggtttggcccaggagtcccatcactgtacattcccagggaaagagatttctatttatgggccaattgcaatgtcctaatgagcaacatgcaatgctcagatcaacaggcatcaaagagcaaagagaaagtgagagaaaggcatgcagggtcatgctattcccataaagaggaggaaagaatacagggaatctactgctgatcagggaccagagccccattctggggtcagttatgagcagagagggacagcaagtatagacagagttttaggcgagtctagagtacacgagagataatgagttggcgaagcctgaccttctgataaggacccaggagtctggatgtgctgctgtcagcgtcagaggcgttggaacaagagcaactccatcttgaataggggctgcgtaaaatgaggatgagacctactgggctgcattcccaggaggttaaggcattctaagtcacaggatgagataggaggttggcacaagttacaggtcgtaaaggccttgctgacaaaacaggttgcagtaaagaaggcagccaaaaccctccaaaaccaagatggtgacgagagtgacctttggtcgtcctcactgcttattatatgctaattataatgcattagcatgctaagagacactcccaatagcaccatgacagtttacaaatgccatggcaacaccaggaagttaccctatatggtctaaaaagcagaggaaccctcagttctgggaattgcccacccctctcctggaaaattcatgaataatccaccccttgtttagcatataatcaagaagtaaccataaaaatgggcaaccagcagcccttggggcagctctgcctatggagaagccattcttttattcctttactttcttattacatttgctttcacttgactctgtgactcgccctgaattctttcttgcacaagatccaagaaccctctcttggggtctggatcaggacccctttccagtaacatcagggttccctcatgggattattgcgtacctccttaaccttgtttcctcagacccatggcagaccttcccattcgattcctactcaaacagaactctttctcagctccaggcagacaagcagaatgcccaggcggttccactctcacccatgtctgtgctcattcatgttcattactgcttgctgtgactcttcttttgagacccacgtagaccatttgggatgaggaaataggccttgatgtccagcatgtgagcattggtcctttttggagttctccctctaaactgtggtttccaattggctgccatggggtggaggcagagagaactagacctgaatcttcaaggagttaatttcctaaagaccacctgaccacaaccttaaagcacatcagactctcctgggacaggagaagctcccaacaggatttagattctcatccacgaaccctccaccttcctccccttctccctcattgcctcccaaatgaaaccaatgttctagagatcaaaattgagctccatggaacatcagtaacatttaaaagagttccacagttaaatattaggttaaaccatacaaaattgctgctatttaacaatgtttaaaaaactacaaaacaggaatttcctatggtccaacctaatgagttttagaaatcttaaatactcttcaagacccagaaccgacatcacattttataggcttgaagaattccctgcagcaaagacacctgtataattttgttttcctaatgtatttgacaacggaacccttttattagataacacctgttaacatcttacagaacctgtattttgtattttaggaaatactgcctgaaagaattcaaaataattaagagctgttcacaaactcatcctccaccatctcttgactgtatctgaataaaataaaattcacccatccatgtaggttacccatttattccatccataagtacttatcgagcacctcctctgtaccaggaatttgcttagaattggggacatactgaaacccaagtgttctgacaaaggaaacagggccctttaagatggagcgaccagcttcacttgaaggagccagaaagggcttcatggaaaaactgagttttgacttggagcttaaagaaattttccagcacatgaagctaacggtcagtgcccactccatccagatgaacccagctcacctgcttatatccggttccattttcagcacctacctcccaggatctttgcatctatggcttccacggtctctgcttgacttgtcttctcctgagtacccgaataaagctcggtttatccaattgcttttggatctagtgcctgatttcctgtgggctgctattttgccaggcactctgaagttagagtccagtgggaaggcccagggtcactaaccacaggcctctttcatgcaactcttcccagcctgtctcttcccgggcctcactcagtatctggctcaggaagttccctgtggcggagggaggagccatcttaatggctgacctttggggaggtgggagacagcctgggggctcagggagctgtgtgctgctctgtcccttggatttcaaatcctgggccttcctagcggttcagctgtggtggggacaaggcaaagctcttctgtgcttggcaaggacacaggggtatttatatagcttgatgtctccccacccctaatttcccttggttcatcagaataataactgaagtggctccccatggtgggtaactgtaggattggttaggggcactgggtccttagggggatgacagttttcctcctacagttccaggccttgtgtaccccttcagtgaccctctttctgactcatgcaataagaaaaacctacacggcatggtcagtgagacagcccaccgatggctgtggctgcacccggtgagggctggggcagactgaaactcagacacaccacaggccatgttatcgaagtcctgtgctcccagctcaggaggttgggtgattctataccttatggaagctatatgacacatctgcaattttgcagcccagcaataggagagaaaaatgagtatcagtgctggtggggagttcaggcacgtttccaaaaaccaaccacaaaaagtcatccatccagtgatggtggaggtagaccaatctgaaaccacctttgcaaaaaattataacagtgagaaaatcatggcagtgatctcaccaacctccatctctcctacaacctccaaactgcccttagtcattcttgggcttgggccaaggtaactttgggagctagtttatagtttaaataatagctcttcccccaaactaaactacctttgtaaagctagtgaaggatcatcaaattaggaggatgataggagcctgaatcctgccaagtgtagacataaatgactaccagctatctttccagaggtcaaaagatatgcgacttccccagtttctcctgcaaataaactaagactggccttttgaggtgtcttttctggttttgacatttcttccctggacccttgactcttgactcaatcggttctgaagctcccacctagcagcagactcagcatgcaaggaccattttccacaccccaatgattgcattcacaacaaatcagcagcacccattcccttgcctgtcaaactatccttgaaaaatcctagcctccaaattattggaaaggctgaattaaggaataataaaactttagcctcccattccaccggctctgcatgaattaaactctttctcgattgaattaatttcctcatcttgataaattggctttatctgggcagcaggcaaaatgaacccattagttcatctatggctataaatctgcctgggggtactctccttcagcatgcagagaactggtccaggaaggtccagggagctgggctggacagtgctgggcactttcctttcaaaggaaaacactagctatattccctcgcagccacaacttattaaaatcaggtcaatggcgaggtggctatttttcaagctggtaacaacatgttttgtcagtttcatctttgtgttctaatgtggccccaaagagagattcttttcccctattcagaaaggaccgtctgacttataacttggcccaatgctggctgcaagataatgggaaagttttcaacaacctcaagggcccagacagctctcagcatggccaggctcctccaggggccagctgagtaatgatctacagtcggcggatagagctggggcaggaatcgctgagctgctagcagctcctgttggcaaaagtggccgcaagagcttatggtggaacgtgggatgtgaatttcagagtgagaatgatgccaagcatcattcatcagctgaatgttcgtccctctgtgaatcacttattgctgcagggtcccagctctagaccagggagggtgagaatgacacctaccccacaaggtggaggtgaggatggagtgagatggttacaagggagaggcttccccaatcacacagcactgtgtgatgctggctgtcactgtcatcccttgttaagttgcgctatgggtggaaagacaattagtctggaagaaaccatcgcccaaaggggtatatacttagaagaagaattgctgggtcaacaggaccttttaaaaacatagatctcagcacctctcatctctgcttaaaaccttccagtggttttcctatacacaggagaaagttagtgttcacaccacctcaaggccttgtaccatctggccatgcctatccttctcctggcttgtagccacctggactttccaaatagtccttctccctccagccttggggccctacttatcactgcttcttctgctagtggctctttctctctcctttctgcctgagtagctaacatctacttgtctctcagatcgcagttttcaatataacttactcagagaaacctttcctggcctctaaactgggtcagatactctgcttgttatttgctctcccaccctcttttactagtgacaaagcaggagcattgccatcttggacaagcactgtcattttttaaagttcactgtgaccaaaagctgcctaaatccaaagggcatcagcctaatggctaaggttggcatgaccataaaccacaaataacatctctgaccagaaacattccaaacacctccctgaccagagacatgccagccccaagataacctcccctccagctggagagatgtcaccctcaagataacctcccctccgaccagagacattccaaccccacttctcccccaacttctccccgacacagaaacattccaagcctgtgataagctctctcaccaataaatattctttgtccataagagagagagctcctgaccaaaatcggccagaagcccctctcaggtttattctccaaaataaacctttgactgttgagctgctttttgtgtttctttcctcattctttaactcttacaactagtccttcattactgttggaactgcacgtttattgtagtattttgttttgctgattttctcagtatttactcagcacctacagggggccagagatcattctaggtactagagagacagccttcagagaaatggtcccagaagttccagggagctgggctggacagtgctgggcaccttcctttcaaaggaaaaggtgagggctgcacagggtgagggctggggcagactgcaataagcaaagcagtgcctgccctttgggagcccattttcttgtaggggagacagagcagacaaaatcaatggagacagaatttcatgtcaggtggtactaagtgccatgaagaaaaatactgcagagctggaagacagctccacggagagcaaccttccatgagttggtcagcagagcttcacacaggaggtgactgggtggagcatctgtcatgcccactagactgtgagctgtggttaaggaatgcctgtgtacgttcccttcattaccttacaaatctccagcaccaaagtgaatgcttagcacacaacaggataaatgggcagatgaaacgacattgccctcaaggatcctggtgaccatgctgtaaccacccaggggttacaaagaaagacctgctgtacaaagaaagaccaaagcattggagtaagaaagagtttaatagacacgaggctggccataccacttgggagacagagttagtactcaaatcaatcgcatccaaagctcctaggttatgcgtttttttcaaaggcagtttgggtgaaggggtgggggtggctaggcttgctgctcattggttggggcagagatgaaatcatagagagtcaaggctgtcctcttaagctgagttgctccctggtgggggccacaggagctatcaggtccaggtggagctatgggtttcagacatgcaaaaaacctgaaaagatatctcaaagggccaatctgcaatagtggtgttatctgcaggaatggctggcaacctatgtatacactttagcagaattcagattcttcttctccagcctgacggcctttcaatagcctcacaaggcagttgagtttcggagaagggctattatcatttaaactataacctaaatgtcttctgaagttagctcagcccaaaagcccaggagtagttaaggaaaaggcaagatagtgaggtggattagatcagatctctttcactgccataatcttctcattgttgtcatttttgcaaaggcagtttcaatggcacagggcaccaggcagactggaagagccccagaggcagagggtagcctcccagaagctgacccaagcaaccatcccatgaggggctgtgtgtacatatgaggcaggaaccgaggcttgctttctccacctctcctaacactggacctggcaactccaccctctgggccccacattatctcatatgtgactggcatatggcacagtccttgctgtggtcgaatctagccaagtctccaagagataaccaggtgcaaatgagcaaggttacttcttggtttttatttatttattttgattattattattattattattttttgagatggagtcttgctctgtcacccaggctggagtgcagtggtgtgatctcggctcactgcaacctccacctcctaggttccagtgattctcctgcctcagcctcccgagtagctgggactataggcgcccgccaccacgctcggctaattttctgtatttttagtagagatggggtttcaccgtgttagccaggatggtctcaatctcctgacctcatgatccacccacttcggcctcccaaagtgctaggattataggcgtgagccactgcgcccagccaacttcttggcttttagatcacatttaacaaacgacttcccccaggccacccttctctgctcaccaccctctcacaatggcctggagttcactctcttagccagtggctctgtctgactcaagaaaatgccttaatcctacctggggtgaccccagagtccatgacagttaacagccctttacccttccacggcactcatctttctttccaacgtgtcactcatatacagtgttgtcactcatctaccaagtggaggttaatgacctttaaaaacccgtgcattacatacaatagaacattattcaaccttaaaaaggaaggaaattctgaaacatgctacaacatggatgaaccttgtgaaaggaaacggatcttgggcccccaaatcgttaaggaaaactcaagctggaaactgcttaagacaaacccgcctcccattctattcaaagtgacccctctgctcactgagatagatgcatcttttttttttttcttctttttttgagatggagtttcgctctgttgccaggccagagtggagtggcccgatctcggctcactgcaacctccccctcctgggttcaagtgattctcctgtctcagcctcccgattagctgcgactacaggtgcgtgccaccacacccagctaatttttgtatttttagtagagacagggtttcaccatgttggccaggatggtctcaatcttttgaccttgtgatctgcctgcctcggcctcccaaagtgctgggattacaccgagcctggccattagaggcatatctgattgcctcctttggaaaggccaatcagaaactcagaaaaatgcaactgtttgtatctcacctatctgtgacctggaagctccccctggcttccagtctccctgcctttgcttcaagttgtcctgcctttccagactgaaccaatatacctcctacatctattgattggcgtctcatgtccccctaaaatgtataaaaccaaactgtgccctgaccaccttgggcacatgtcatcaggacttcctgaggctgtgtcacgggctcgtcctcaaccttggcaaaataaactttctaaattaactgagatctgtctcagattttctgggttcacaaccttgaggacattatgctaagtgaaatgagccagacacaaaagaacaaatactgtctgatccacttatgtgaggctcctagagtagtcaattcatagaggcagaaagtagaatgctggtttccagggggctgggaaggtgaaaatgaagttggtgtctcatggaggtagagtttcagtttgggaagataaaaaagttcgggagccagatagtgctgatggttgtaggcccattccagtgggatgtggcactccttttagaggacacttttggctcatgggcctcccttcagcctgacctaatgttcttagaaatctgctgtgattggcggctcttcttcccaggcctccttccttccccctctcctttcacgggtgtcagacctgcacggcagtctgccagctcctgctccctccccttggtccttctcaggtctttctcccagtcaatctcatctcatgcaggtctaatcccttcttggaatctgcttctcagaggacctgggctgataacatcaccacataggccaaaagagcaacatgcccaataaatgcactgcaaggcaacaagcacatttagaaccagcactatgcattcggaagcacagcaacaaacaccttcgaatttgtcagggcttacagttgacagcccatgttagtcattcaatacatgtgtaataagctcctgctgatggtgaacacatgcacagcttgcacttctgaggcaggcaggcaggccttctcatccacattctgcacacgagtaaaccgtaggaggttattctaggacacactttggttataatgaatcttaatgatgttaaaaagtaataggcaacatcatttagcatttacgacatgccaggtaccatttctatacttttttttttttttatgtgcgtgttgcttatttaaaaaaaatcctggccaggtgcagcggctcacgcctctaatactagcactttgagaggctgaggcaggcagatcacttgaggtcaggagctcaagaccagcctgggcaacatggcaagaccccgtgtctactaaaaataccaaattagctgggagtggcggcgatgcctgtaatcccagctacttgggtggctgaggttgcagtgagccgagatcgtgccgctgcactccagcctgagctgggcaacagagcgagaccctatctaaaaaaaaaaaaaaaatccttaaacagccccatattttagggaatgacgaggagccatgagcagaggtgtgcactgagagtcacttcgtgcctcgtgttctataggagctgacccagaggaggaaatgggggggttacagcatacctggccctccaggctcaccttgcaggaggagagcctgcagctgagaagctccatggtaggatggattacctttaaagtttcctggggccatctctagttacacagcagggacaagacaggacaatgggtgataaagtgcacaggctcagattcctaataaaaaaaagactgtgcggtaatgtgctcatcagccacgctgaggccaactgcaattgaggatttataagaaaaaacgatgtgtgatttacaaagaaatgatttttatcttttacatgtcaaacgatcaaggaaaatgcaacgtctcacatcatgctgatttcaaaaataatgcaacaaaccagtgatcggcaaaagaaatggagatggtgttaaagacttggggtggggaaggaagggcaaggcacagaggctgccctccctcttctctccaagaggggagcctctttccaccaccaaccctccttttcctgcagagggtgtggctttcttccaactcaacctgtcacttctgctgcctcccttccatcattgaaacaagaaatccagacactcctcattcttctaacctggtgatatccctggggctctccctccttcccagagtcctttccaggcctggacaacaggagaggctggcccaacaatcctctgctacaggactaatcttcaggagggctgagcaatgccctccaccccaggaagggcagtctttggggttcccatcttcacgctacaattgtgccttcctcttcatacctgagcactctgtgccactgctggcacgtccaacctgttcaaggcctttgagactgtccagcccaccagtgactccaagtttagcacagtggcgcacatctgcaccctttatttatctcgatgttttatatgcataactccacttcctctaccaagtcactaaactactgggggttggggcccatgggcctgccttgggcatcttctatctctccgttaatccggaagccacatagtgagtgctcaggcccatgagcagaataactgaccctgcttaagaaaatgctgtctgtctcccacctggcaggaaggagtcagccaaggagagtgacagaaagagaaggtaagtgtggaggaggtataggcttcctgtaggcgtgttcctgttgcatcgctgcacacctgctacccagctgagggcctggctcaaacacagcagatgtgtgataaataagtgctgaacaaataaagaaatgaatgagtgaaatgaatagaaaggaggatccaaagattagagaagggagagaggaaagagagaaatgcacaggctgggcgcagtggctcacgcctgtaatcccagcactttgggaggccaaggtggatggatcacctgaggtcaggagttcaagaccagcctggccaacatggtgaaaccctgtctctactaaaaaaatacaaaaattagctgggcatggtggcgagtgcctgtaatcccagctactcgggaggctaaggcaggagaatcacttgaacttgggaggtggaggttgcagtgagccgagatcatgccactgcactctatcttgggcgacaagagtgaaactccgtctcaaaaaagaaaaaagaaagaaagaaagaaaaagaaatgcacagatattctttgatctggaagagttggttagacaggctatgccttgacacaaatgaattgtcctgaaattgacttccagagaggcatggtttagccacagcctggttcaccactctgaaatgtatcttctatagacaggggtgacatggtttggctgtgtccccacccaaatctcatcttgaattgtagttcccataattcccatgtgttgtgggagcgacctggtggaagataattgagtcatgggggtggcttcccccatccagttctcatggtagtgaataagtatcatgagagctgatggttttataaggggaaacccctttttcttggttctcattcttctccttactgtcaccctgtaagaagtgcctttcaccttctgccatgattgtgaggcctccccagccacatggaattgtgagtccattaaaccactttttctttatgaattacccagtctcaggtatgtctttatcagcagcttgaaaacagactaatacaggggagaccatcttacacacacacacacacacacacacacacacacacccagtatataaaggatatcagtgtcattgcagtgcttccaaaagcataggttggtatcaggctgactatagctcttgaccatttctatgaccattaaaatacaacataaataacttgatcttcactgacctgtagacctagaaaaaaatattcaggcttagccacagacaaggaggaacaggggctgaagcgcgaaacaccaaccatctgcagagttcctgaactggtgggagcagcctgtcccacagatgagcctggactgggaagcatctatgtttcctcttacaccaaagagcaagacatggcattaacgaagccagacgtgctaatgggggcaactttgaagcctaaagctgcttgggcttccaattaactgccctgggcctccgtgtctctctgtttgcaaaatggcactgaatcactcctgatttctccagataagtagctgtgcttacactggtgatgtggtccatggaaatgtacgtgaataatggtgtgctggtataatggacagctggaaccagaagcagggaggaaggcacggagcagacaggctcatggcccttgcagggactcaaggtgtgtctaatgggacagtgaccaccaaactctctatcttctggctgcactgatttatgtcttgctcctgagaaattaatggcttgggagggtttgtggcagctcaccttgcctccctagaagggtttggtgacaactttgggaagtaaatgcactagtttccaagcaaccaaataacaggtcttcagttacaaacccgcgcttcattttacaaaacagtagctccagagcagcatgtaattaaactggcgaaggcttcacctccctggaataacctgagcccaacaggaccctgctaacaccactgttcaccaaataaaggtaaacagactcgtctgaagtcatgcctggagggggactctgatcttgcattaattgggcatgtcagttggccttaagaattcaatcagccgggcagtgacccaatctactgctgacaaatgggccccatttgctattcaaaaaattaaaaaacttatttgaagaggaaatagtggcttctagttagagcacctctcatctgccgggatctagctacatacatttgccatttaggctagattgctttactcttctttctaagtcaaggtcaaggatacatcccctttagtctaggatgacttggagcgcagagaataccagctccttattcccttctccttggcttcatcttctgattcatgcctgtctaactttcaggcacccattgtcaagggagtaatggtgtctggctacaaagaaaaaaaaaaaataagctcgtggcacccacttcaccagcagaaactctctgatttggagggctggctaatattgtgagcacccattcccccaacacctggcccttttctttgttttgctcgctttcagcagccccatttctggccccaagacctcccactgtgacactcagctaacgtatcaccttcttctctataacagcgtctgtggtcccaagcctagagcaccactgaggacccccttgcagcccagtttccaggctgctgaggtgccccactggccactgtcctggggtccaaccttcaggctggcagctgcatcagcatcatctgtgaccctcctcgaaacacacacctggattcagagaaacacaatagggacagggatgttgtattatttataacaagtagggcgggttgattctagcactgcctcctggaggcactggggagtcaggtgcagggcacaactagacaaggtgactgggctgcaaggtagagagtagaaagccgagctaacaaatggtgcaactcagtgagaagatctacatgctctcctaaaggactgcatgctgcgagacaatcttgggggcaacgtagcaatcagattattcaggagcagctgcagaaagccaggctacaaggcactagctaatttccatgggtgactctcaagcttcaagacacaagaatcacccagggctatgctcaaggccagcctctgccataaggcatgtttcctgctctacctggaaggaccaagcagattcccttctctggggtccagcgattgaagaacctaccacagagctgggctggaaattagggataagattttagctcttactcttctgctgctgagaacttggccccggccggcttcgtatctgcacgtatttctgaactattgcagatactcacacagaactcctccactggctcttgttcaggtccctctacagctctgagttatttctgaaaatctcttttccaaacagatcccatagagcctgccacatgttccctctccctggatcaggctggtccaggaagaattggggaatacagatgggcagaccccctgcttgggggagatgcaattacaaacagcaggcctgagactctgctttcaagtgccagatggcggattggaggcgccaccccagaagtctgctctgtgcccactccagacagatgtttagattctgcagggactcacaggtcgttgcctccattctttccccatcccatgacggcactcaatgcttcccaagtgtaaaccatccaggatcatgcagggcaagcactgaacaaaaccagaagacagcatttaaagttcttacaaacaatttgttactctcctaataaattgttttgccaaatattctatacactttccagtattggccttgaattttttgcaatgcttgactttatattattatacttatctgtgttattttagttttgcttttactgaaatctgtatcaaaatgttgaaatacaaattattctctatatcaaaataattaatttgtcttttaaaattgctttcgtttcatattgactattttgtttttaattatgtttgtttataaataaaatactttgcatggaaaaaaaaaaaaaaaaaaacagaagacaggctgttggtaatccagctgctagacagaggaagagagagactagcgcttactgggacatttctagcggcattatatatatacccgtggtctggtctgatttcatcctcacaacagcattccaaggatcttatccactccactttacaggtagaaaaatagtggtttggacagctgaagtcacctgccaaaagtagcagctggtccacagtaaatcgaatccccacccctcaccaagtcccctcctgccttaaccggagcagtcactgggggccctagctttgaagctgactttcgcagttcatggctaaatgacctctctcaacttcacttttttcatctcataagagggggccatatgatctgcctaccttcctggggggccgtgaggattggctgaggtcaagggtgggcctgcttcgtaaactgcactgttatcattgggatctgggacggagcctgaataaacgtattcacactcgggctttagtgtttaataagacttaaaacaacaataacaaatccctatcgaactatgtgcattttaagaggggacaaagctctaaaccaaaaaaagggcattatgatcatagcttcaggtctcatttagcctgccaggtcaaaggggactggggcaggaagggagttacctatttaataggaactcttctcagaaaattgtaaatcatgccagggaatagtatactgggttgaccagtatccccccaaaatccatgtctactcaaacctcagaacatgaccttatttggaaataaggtctttacagatgtaaacagtcaagatgaggtcatactggattagggtgggtccccaatccaatgacgagtgtccctataaaaaacgaaaaccgaaacccagagacatacagatacagaggggagaagtacatgtgaagatggaggtggcatgggaacgatgcatctacaagctaagttacaccaagaattattggtaactctaggaaactaggagaggccaagaaaggtcttctctagagccttcaggagaagcatggccctgtggacaccctgacttcaggcttctagattattccagaactgtgagagaatacatttctgttgtgtttaagtcactgagtttgtggtactttgttatggcagccccaggaaatgaataaacatagtaatggaagattctgagacaggcactatgctttacgtacactgtgtgtatgtatgtatgtatgtatatatgtatgtatgtatgtatgtatgtatgtacgtacatacttacttacttatttgagacagagccttgctctgtcatccgggctggagtgcagtggtgcgatgtcggctcactgcaacctccacctcccaggctcaagtgattcttctgcctcagcctcctgaatagctgggattacaggtgcctgccaccaagcctggttaatttttgtatttttagtggagatggggtttcaccatgttggccacactggtcttgaactcctgacctcaggtaatccacccgcttcagcctcccaaagtgctgggattacaggcatgagccaccaggcctggcccattgtctcatttatcccatgggggaagcagtattagaaccatcatttcacagagaagaccacagaggctcagctccgcagaggcagcagcaggattcatgctctgatcaggaggccccggtctcagcccctggaccacactgccacgcaggactgcctctgccctctcctgttcggccggcacaatcaggggagccagctagtctaattcgtgtggctttttcctacagtgaagggttcacccttaagcactgatattttccttcattttcaaagaagttgttttcaaaggcaatactcattttcctgcttccttaatttaatttctgtattgatgactcagaagcatttcagaaacattaattactgtgtgacaacacaaaatgatgatggcctgagacatcttgagctaggaggggatgtcagggctttcattagagccaccaccagctgctctgtccacggtagtggcgtctctatggatgacatatggtcattgattttatgtctgattcactgtcatcacggcgtctgctttgctatctcttagttgtccctacgctgagcaagaccttttcccttccacattacatttggtttttctcccctaatctaataaaggttggggaagtagataaccaaatttcttagaattcggcagagactcagaataaacagtattctggactgttaaggagttcttttatggatccagtccatgtgctatagggcattgagttttctggtttctcttctcccctacatccctgtcagcccagctgcattcacaacacaagagcttttaccatcctgccctgatcctgccgaactgaagaacacccactttttggggcaaggaatacgttggatgaggctccagcacaagaaaaagattttcacttagtgtccacctgtgttttctccagttggcaggatggcctcattaagggcatttggggctggatgcggtggctcacgcctgtaatcccagtactttgggaagcggaagccagcagatcacttgaggtcaggagttcgagaccagcctggccaacatggtgaaaccccgtctctactaaaaatacaaaaacgagctggatgtggtggctgcttgggaggctgaggaaggagaatcacttgaacctgggaggcggaggttgcagtgagccgagattggaccattgcactgcagcccgggtgacagagtgagagtcagtctcaaaaaaataaaaataaaataaaataaaaaaataaagagcatttggagggggctggctttaggggacctcccagacatcctgggacatgagaggtgtaggataaatcctttcctggcttctgcttccccagcacaagcgctgttcacctgaccgtgctaacccatcgctctctttgttacagctgctagggcaagggaatgctaccaaaaacctccaccttcacccattcaacattttcatggcagcatctcaagttgaaggggaaattcacaccttctggtctctattctcacttagctcgcttctgctgcaacttgtgatccccggacttctcagctgcacctacatctgtggagaggaacatctgaatccacaactgcctttagactggggccaccaggcttgctcttagccctgcccttataagggcccctttcttggtctcttctggcaactcccttttcaatagggcaaggagtctgtggcacccatgaggaacccctatctgtaatccacacccccttctactctcaaagtcttggcaccagggattctttccccagtgactggaggcccacatataaggcctgcagggaactcataattgtgttggtcaagcattgaccatccccttggtcagtgtactcaaggatcaccaagtagccaacgcaaagatgaactaagcccttctttttctatttcaactcaggcagtctgtggactaagcatgctgggaagagctgattaagagttccaagtgggccagcactgcccagagaaagcagtgaggagaaactgagctagctgaagggcaagagctggatcaacaaggccttctctgaaaacacttcccaagggagagctggtgtaaacaccctggcctctcttcttggtttgggggctgattttcatgtctctgggctgatcataactacatggaggggaaatacatctttcctgaggggcccagaagcactcgtcaatgtcaatgttgatttcagagctgatagtcgggatgaaagaggcagtagtcaatgtgagggtattaattccacgtctactacgtgcaccgcacagtgctaagggccctgaagatggggggcgggtgggggcacaactgtgtgtctgctttgttatcttgaacttgctctgtgtcagagcaattccgggacttgacaagttcatcattccatgtagaccataactgctctttcgctttgctctccactctctattaggtcagcattcattttcttttctttaaaatatttcccaaatcatgccgggcgtggtggctcatgcctgttaatcccagcactttgggaggccagggcaggcagaacacctgaggtcaggagtttgagaccagcctgaccaacatggagaaaccccgtgtctactaaaaatacaaaattagctgggcgtggtggcaaacgtctgtaatcccagctacttgggcggctgaagcaggagaattgcttgaacccaggaggcggaggttgtggtgagctcagatcgcgccattgcattgcagcctgggcaacacgagtgtaattccatctcaaaaaaagaaataaataagtaattcccaaatcagcttatttctttacagtccacactcatcatctcagcctgagctctaatccccaaactgtctggcaccttcggtctctctcctctttcctgggcttcacttattttaccatcactaaagtgaacattttaaaataaagtcatatttataagttccatgagaaaacctgggaaactcaacaggtgtctctcagggtcacggtgccccatgaatccacgatcctctcaaactctcctcttctgctccattccttgcacgtcaagaaaaccagcttcagagaactcctcccagaactttcaggagagaatttattttactgaaacctgtccttcacttccacctctttggaaatgctttgacatttccatcattttgtcttattttgtttcttttggttttttttttttcttttttcttttttttgagacggagtctcgctctatcgcccaggctggagtgcaatggcgcgatctcggctcactgcaacctccacctcctgggttcacaccattctcctgcctcagcctcccgagtggctgggattacaggcacccgccaccatgcccagctaattttttgtatttttaatagagacgggatttcactgtgttaaccacgtcttggtctcctgacctcatgttctgctcaccttggtttcccaaagtgttgggattacaggcgtgagccactgtacccggtccttattttgtttctaatacaagctcgtgttggggtgaggaagggcagaggaatggctattactaacattcttgaaaaagagcagatgcaagacgctttaatttttaaataacagactctcggtacatttcatcctgagaaaatacttcactttccatccatcaccatccaaaaaaaaaaaaaaattctatttataaaaggactcctctgcactgtagtgggttgaactgtacctccctgcttcctgcctctctctatatatacatatacatacatatattcaagtcccaatcccctgtacctgtgaatatgaccttgtttggaaaagggcgcctggcagatataattaaggtaaggatcttgaggtgagatcatcctgcatcaggatggaccttaaatccaatgataagtccttctaagaggaaaagaaggggaagcagacatagagacacccagaggagaagacaatctcaggacagaggcagagactggagtgatgcagctatgagccaagaacaccaagacttgctgcacccccagaagctgggagggggcatggaaaggattctccctccactgagagtctccagaaggaaccaaccctgcaggcagcttgctccggggtctttcacctccagaactgtgagacaatgcatctctgttgttttaagccacccagtttgcagtactgtgttacaggagctgcgggaaactgattcactagccaagtcccttggcacacactttctagggacagactctgaagtttgagatcagcctggctaacagggcaaaatcctgtctctactgaaaatacaaaaattagccaggtgtggtggcgtacagttataatcccggttacttgggaggctgaggctggagaactgtttgaactgggagatggaggttgtaatgagctgaggttgcatcacttcactccagcctgggcgacacagcaagaccccatctcaaaaaaaaaaaaaaaaaaaaaaaaaaaagcaggcccagcacagtggcttatgcctgtaatctcagcactttgggaggccaaggcgggtggatcacctgaggtcaggagtttgagaccagcctggcgaacatggcaaaaaccccttctctactaaacatacaaaaattagccagacggggtggtgcccacttgcaatgctagctactcgggaggctgaggcaagagactcacttgaacccgggaggcggagattgcggtgagctgagatcatgccactgcactccagcctggatgacagcgcaagactctgtctcaacaaaaaaaaaaaaaaaaaagaaaaaagaaaagaaaagaaagcagattttcaccagaaagcagacgattctcaccagaaagcagatgattctcaccagaaagcagattctcaccagaaagcagatgattctcaccagaaagcagattctcaccagaaagcagatgattctcaccagaaagcagattctcaccagacactgaatctgaatctgctggcaccttgaccttggagtttccagcctctagaactgtgagaaataaatgtctattgtctagagccacccagtgtatggcactttgttatagaagctgtaacagactgagacaaccaggcagggagcagagtcagggctgtgctggaaaaggcctcccatggctgtgatcacacacgccccttcctatcaccagccaggacctcccttctgagccctaaggccttcatactcatggaaattgagattacagcaaataatgcaggttcaaagtctgaacatgctgagtttggagcctgtagaacattcagatgaatctacctcagccagatggctggagggcagcaaacgaaatgacccagaacagaggagagaagcttgaatcacagctattgatctggaagttatcagcgtatggatggtgtgaagccgtgggggcagggaagaatgcccaggatgagaaaacaagtccagaggaaaaccatagatcagatctacatcagcttctaaacgcaggcaggagtctgacttgcaaaggtgagggaacgggaatagtcagagttaacaggcgcccacgtcacaatggatggattgaagaattaagaggaactgagaaagctgacacttccaaggagctggggggtctccatgccccctagcacaccctcagccaggaattttcaggagccagggcagccagcccccacccagggcatggctgtcccatggtcacagggtagggtgaaaagtagaagcagatgggaaagggaactggaggatgtgggggtaactgtgggtaggggtacaagcaaagaaagtatgaatgaagccttgaaaggacttggaaaggcctggtgtggtgcctcacgcctgtaatcccagcactttgggaggccgagacaggaagatcacttgaggtcaggagttcgagaccagcctggccaacacggtgaaaccctgtctctactaaaaatacaaaaattagctgggcatggtggcgcatgcctgtaatcccagttactccagagcctgaagcaggagtcttgcttgaacccgggaggcataggttgccgtgagcagagatggcaccacgatacgccagcctgggcaagagagagagactctgtctctaaaacaaaacaaaacaaaaaggttggggggtgcgtggggctggaagataacacagagcaaagatgtctaagaagacagggggtttgacaccagaatgtcaacgtagtgcagcattactgcagagagcattttctagggcctcaaactgctttggaaaactttggtgatatagttcggatatttgaccctgctcaaatatcatgttgaattgtaatgaccgatgctggaggtggggcctggcgggaggtgtctggatcctgggggtggatccctaatgggttggtgctgtggtgacagtgagttctcacgagagctggttgtttaaaagtgtgtagaacctcccctcccctctttctcgctcttgcttttgccatgtgatatgcctgctcccccttcaccttctgccatgattataagcttcctgagaccccccagaagctgagcagatatcagcaccatgcttcctgtaaagcctgcagaactgtgggccaattaaacctcttttttctttcttcttttttttttttttttttagatggaatctcgctctgtcgcccaggctggagtgcagtggtgcaatcttggctcactgcaacctccacctcccaggttcaagcgattctcctgcctcagtctcccaagtagctgggattacaggtacgcaggcatgcgcccccatgcttggctaatttttgtatttttagtagagatggagtttcaccatattggtcaggctggtcttgaactcctgacctcatgatccgcccacctcagcctcccaaagtgctgggattacaggcctaaacctcttttattcataaattacccagtctcaggtatttctttatagcaatgcaagaacagcctgatacatttggagatgaaaagaagcaaggatataggatgagggcttagaagggaaattaccatcaaggaggttttctctcctctctcatttcttcctcttccttctctcccaatctctctctcctccatggctagatgtttgtaggctgaagggaagaacccagagaaagagtcgggagaatttcaaagagaaagagagagagggaagaagatattgaggaaaggtggtgagggagctcaggagcacgtgaagacattagtcctgcagtatttggctcctccatctccgaaggggagagagggctgaaagatggttcatgatgtcacttgagctcaaaggtagagggcggagagtggagatgcttccaccagatgccctcaaagctttcagagaagccagggcacaattatcagagaggacgtaggaagggaaggtggaagggctttagtggtggcttcaaatggccaccaccgggagggtggaaaagagctaaggagaaacaattacagaaatgctggatacatcgttttctttattccatgtgtttttctcatcctgcccattggatttgcagagcttgaagagtaagttaagtatgtatctcaatcctcctggtctttcttgtcactcagagatgctaaatgcatttcacatacaggtatgcaaaaatacctcagaccaggaaaatatgttagcttggctagaaatgatcgtttatgcttaaaaaaaattaaatttgattggccaagcccacccttcaggctgctgagtattcattttcttcaccttgacagatgagattccctccccgacatctctggatcacaatgggccaaattatcagaaaccgacagggaggctagtgacacctttatagggtagcaagcatatgctaaggccttatggcataaccttgggttttagcaattgactgcatgggaaaccaggagtcagggcctgggcacccagctggaatctgatggaaacatcacccttcccatccacaaacatatggaaaacttctgtgaagaatttaagtgtgccagaatagttgatggaaagttctattcttagttaatactgtaactacagatatcttcgatgctggcacttccagacaattaacccacagcctatgccaacaaaattttacacttatcttcctgtcttactgtaaacaacccaatttcaaaggcaaatgtgctatataccctcccacatacatgtcttattttatacaccccatcttgcctttccatcaagataggaaagtagtcctagataccaaaataaaccccccttgccatgcccccaaatgttcagcttgttacaaaagcagaagatatctggatggctgatggatcccggggtgtttttcaggactgaaggacactcaggctattcctcaatgacagggagttcacacagcagcttctagctctgtcttagacttcttgcttctgtatgggcaggaagtgggacgcacatctagatgggtaatgagattaagggattcttgtactgtcctgggggcagtgatatgtgagagatgctgaggactggggtcctagaggcagactctaggcagagaggcaatcccatatctatttttcttgttttttttgagatggagtttcactttttcacccgggctgaagtgcaatggcgcaatcttggctcattgcaaactctgcctcctgggttcaagtgattctcctgcctcagcctcccaggtagctgggattacaggcacccgctgccacgcccagctaatttttgtatttttagtagagacggggtttcaccatgttggtcaggctggtcttgaactcctgatctcaggtgatctgccctcctcagcctcccaaagtgctggcattacaggtgtgagccaccaagcctggccgcaatcccttatctttaagatgcagtgcagcagacctggtatcagcttatgcggatgaatgcatcttaagaggctctgaaatagtatgccaccagtctttaccatttgtcactttgactgctataacccatggcttttttttttttttttttttttgaggcagagtctcgctctgatgcctaggctggatggcagtggcgcaatctcggctcactgcaagctccacctcccgggttcacgccattctcctgcctcagcctcccgagtagctgggactacaggcgcctgccaccacgcccggctaatttttcgtatttttagtaaagacagggtttcaccgtgttagccaagattgtctcgatctcctgacctcatgatccgcctgccttggcctcccaaagtgctgggattacaggcgtgagccacccgcccggccaacccatggctttcaagggaattttactctcttaaattactggggttctacagttgttcctctctctcttcaactttttctttctaactattcagtctatcatatactcagccaacaaatgtctgtggaatcttggaggtaaacatcatttttaaagtagcaaaaaccaagtacacagaaaatctgacattgtctagctaaactcacctttgtagccacatttctgctgaccccaaagcctcattctgatacattctgtttcctcctgggatgcacattcaccccagctgactctccccctccttccctgggctcccttactgggcgcatccagttattttgagctctcatagcaccgtggccctctctgttgtaggtagatatatcagggttgaagatttgcatttatttgtacaattctttcatgaatgtccttctcctccctggactgtaaatccccaagaaggcagggtcaacatgttttattaaccactgaatcctcaacacctcaagtaggcacagttcaagtaaacttttatttattaatcattgcttcccagcatttaataagtcaggtagcctctaatttcatcccctgggtcctaggccaatcctttccccactggttaggcccaggtatttactccatacatcctggacccctcgaccagaaatttcttcatctggcctctctgctatgcatccatgctggatccagctctcctaacagccttctgacactgcctgtcccagctgggttcaacatttccccttgtttccatgcattattagttttctctgatgatctttctcatatgagaatgacatgacattagcatctagagggtccctgaagattaagctgtgtttaaccatttcttagagaagagggcaacaaaggtcaaggaagtcgaccaatgtcacacgaccaggcagcagtcccaggctgtactttccttcaattttccaactgtctttgctgtactgcttcctcaaaacccaccttttggttaggcatgatcaagaacttgtctccagaaaagggagtataagaataatacacacataattttgggaggcaggagggcccctcgttacaatggccaaacaccggggctccacccaaaaactgatggagatgacatgagccaatggtatacatttaagaggtgatgctctcccaactaaacctaagtcctggacaatactagaggcaggggccccaaccccaaaggctgggatcagatgctgtgtattaagactggtcagtggagagtatgaggcatggatggagtaaaaggaggtgactgtcagaaaccatgcaactgaagcgtgaccacaggtgacatgtactgtggcaaggccagtgatttcattatagcatgttttcttttgtctgcatgaatgttatgttatgaccctcatttgagcatcagattcttagaggccttcatttttctcccagttaccagagaggacaaaggctttttttttttttgagatggagtctcattccatcgccagattggaatgcagtggcgcaatctcagctcactgcaacctctgcctcccgggtccaagcgattctcctgcgtcagcctccagagcagctgagactacacgcgcacgccaccatgtccggctaatttctgtgtttttagcagaggcggggtttcaacacgttggccaggctggtctcaaactcctgacctcgtgatccgcccgcctaggcctcccaaaggctttgactgcagtgtaatatttaccctgtggccaaacaatctcgatatatttgttaacttagcacatgcactgtgacgtgctatcatggagaagaacaatggaggccacctcaaaattcaagtcaaagaagtacttgttagggcaaagggcacacgaaatgaagaatggttttgtaattggctgtgaaagcaggtaaactgtcgcccaggtaagaaccatccctgggaacaggcctataactcggaagataatagccacagctctgattccacccttcagttcacttcagcaaacacttattggtcacccactgtgcagggcaggctgatatttggaaacatagaacaacaacctgattaaaggccacacttcctctgaagcctctgaattagttataagaaagaaccttttcattatgagggttctttattatatagaacctcgttccctggggcggatgaaatccaggcatcaatatccaggccgagagtcaggccttactgaagataggagaaagatctgtgggtacgtatgggtgtcctgccatctgaatgaataattcaggaacatggcccaatttcaccttccatgtctggtctggcaaacgtggagatgcttgggcagggaatttaactgggtttttctgacttctcgtggagtgccaaagattgagctgagggaaatcagggatgccagaatgctatgaaagctcaaatccactcaatcctgcaggattcaaagacatgaagtagcagcactgtatgcaagggaggctacttatctgctgccacattataggggagctgaggataacaagccgggtgggcagattatccatttatttttgtctttcgaaagactagcatagggggcatcatttagtgttcaatttcctgtgtcctcaggagagcacactggtacacacccccagccaggctggggggtcatcccagggggtttctggttgtgagaaagaatccatcctggttgcccacaaacaaacatgtgaaatacaaaccatgtgacctggataaacagaacatggtgaggaagtaggcagtgctcatctgaacaacaaaaccgcacccttctggaatacaaagacaccagatggtggttttctctggccaggatattcttcacaccatggacagacctgaagcgctgcttctccaaggaatgagaagataagagaatccatctttcaaagaaaacaatgaatttctctctctctctctcttttttttttttgagacagagccttgctttgtcgcccaggctggagtgcagtggtacgatcatggctcactgcaacctctgcctcctgggttcaagcgattctcctgcctcagcctcctgagtagctgggattacaggcatgtgccaccacacccagctaatttttgtattttttagtagagatggggtctcaccacgttggccaggctggtctcaaactcttgacctcaagtgatccgcctgcctcggcctcccaaagtgctgggattacaggtgtaagccaccacacccagccaaaaacaatgaatttcttgaatttgcatcacatttacatgtacagttagtgggaccctgagcagaaggaagaaggaaagcttcaaggcaaatggtgaggccaatccatgtagcaacttagccacgttgaagacaaatccccagctccctcacctgcagatatttacacgaatccagtggttctcaaagtggaggcctcagatcagcagcatcggcattgcctagagacttagaaatactaattctcaggtcccatttcagacctactaaattagacattctcagggtgggacacagcaaagttctccaggtgattctgatgcatgttaagtttgagaaccggctgggcacagtggctcatgcctggattcccaacacttcgggaggccgaggtgggcagattgcttgaggttgggagtttgagaccagcctggccaacatggtaaaaccctgtctctacaaaaatacaaaaattagccgagcgtggtggtgcacaccatgtcccagctactcaggaggctgaggcaggagaatcgcttgaacctgggaggcagagattgcagtgagctgagatagtgtcactgcactccagactgggtgacagaaagaaactctgtctcaaaacaaacaaacaaaggaaaaagtttgacagccactgcactaagacaaaaatagcaaattgcaatcacaaatacttccacagtgcttcctgtgtgtaggcactgttttaagtctttatagacattatttcattcaatgctcatggcaaacctgtgataaaggtactgatatagtgtggctctgtgtccccacccaaatctcatcttgaattgtaatccccatgtgttgggggagggagctcgtgagaggtgattagatcatggagacagtccccccatgctgttctcatgatagcaagtgagttctcacaagatctgatggttttataaggggcttttcgcccttttgctcggcacttctctctcctgctgccatgcgaagaaggacatgttggcttccccttccaccatgattgtaagtttcctgaggcctccccaaccctgcagatctgtgagtcagttaaacctctttcctttataaattacccagtctcgggcagttctttatagtggcatgagaatggattaacacatgtagtatgataacttctcatttctcagagaagaaaatcgaggcacagagggttaggtcattttcacaagttgttctgaccccctttagtcactgcagtggtgagggagacatccctcaccttaaatagtatgaaaatagtgtgagacagctgaacatatgacaagcaatgctgcacagactagtgacataactcagaagaggagaacatcgcaggccatgtggggccactcaaaggttgcacacagtgaaccagaaggggctgtgcaaggcaggttctgtagtgacaagagggtgaggtgacccttagttcccgcaggaggatgtggctggcttgtttgaagaattctgctggcaggcagtgaggtagaacccagaaagttgaggactgggctgggtgcagttggtctggttgatgtggaactacctaggtggggagcctttcctactgggtgggaagaaatctagccagagccagggaactcgcagctaagtctttgaggttttgtgaggctccaaggtgtcaaggaagcacatgaaatttcaggccttagaaagtatgagagaggaggtgatagagctagcatttgaacccaagctcctgtgctccagagtccacgctctagttttaaatcacagttctatcctgtctcccactgtctttaatcaaggcacactgcacacctctgtaagaactgccatgatccctcctgggtcaatatgcaggccaggtcgcggaggctgtgggaggttaaggtcaggggtcttcccccactgacttaaatgctcctttatatgggggttgcatctccttcaccagctcctccacacaccccactggaaattaataaggacataaacactgcccattgtgcgcagcatgcacaaacacattcattcactagcatatggcactgactctttttgcagagactatgttaggaccagacacacaaagataacatcaaaacaaggctcaggatgctccctactgccggcggggtgggggcgagggacaaaaatacaaacagagcatttcgggcaaattacaaaaggctttatattcattcccaaggtgtttggactgcatcctggaggctctggtcagtcaacagaggcctgtaagtcagggagtgaggagcagatttgccattttaggaagataattctgggggatggtgtgggaaaagctagaatgaggatgggcttatggcaaagcaccagacaaaggctattgtacaccctgagacagagaagcaggatgatcaaagaagagaggcagggtcacagattcccagggtgccatgcaacaagggtgacagacaggttttggctggcacatcttaagtcctagagctgagaaagcattctccagttagccacagaccccacccctccctactgtcttttattagctgacttgctgtgtttacatgaattgcctggtaccctaaggtgtttatgtttgaaagggagagattttctttctttcatacaatgtataacatgtgatggcagattggattgcgtggaatagagaaatagacagggaggaaaaggactaagggtaccagatttctagcttttaagagggaaatgcttctttttttaatttttttttaaaaacacagagatggggtctcgctatgttacccaggctggtctcaaactcctggcctcaagcaatattcctgcctcagcctcccaaagtgttgggattacaggcgtgagctgccacacccagtctggaaaatgcctcttgatgtgcacatcgttctatctgaattaatggaatacagtgcccagaaaggaaatgaataacaatgatcaacaaattctgcttctctaagattaaggctaggggagtgtaccttggcagttgcagaacctgactcctgtatcctttctcccccttcacagcaaggctgggttacaaatgacacagctgataccacaccggccagtatacagagaagaacaaagagtcttcaggttgaaagaaagcttgagggacccatagtcctgcctctaactgtaataacagccttcaaaatctaggccattgttagcatcaggctctgcctgaggtttgtggcattctcctgagagaagctttacccatcctgagaaaatgagattttgcaccttggagctgatgggaacgcctgggaacagtcactgtacacagctcacaatgggtcccagcacctgctctcacctagaaaggaaattcagaagctcctgctcatcaccatcacacagtccatgagtacaaatcacccatcataagaaaggagcttgctggagaaaaggcagcaaagccttggagaatacagcagaggcaaccagcccccaccaagccagcgagcgcggtgaggactcacactgactccacaatccttctgttgggtcccagccaatcatttttctaattgagtgagaaaatctgataatattgttcccctgactgaagccttcgtttcttctcatcactctaaagatgaagtgcaaagtgcttatcatggtccccaaggccccggtgtcctgtcctctgcctatatccccagctgtgtccaagccactccctgctccctccttctctacactcaaactgtccagtcctcccttcttttcctgcatctcattagcaccttacttgtgcagggctttgtgtgtgctatgcccttagcctgggacactcgcctccctcttcccatctcttcacctggccaatttattctcttccttcaagtcccagggtgactttcatttcctccagcaagtgcctcctctctgcccctctgaattaattatcttttgctgtataacaaggtacccaacatttagcagctcaaaacaacacacattgactatctcacactgtttctgtgggtcagggatggggaaagaaaggcacaagacctgtcaacatccacgacattagcatccacactggatatgagggatgaatgccaccagaattctgagggcagaggacctccgactgtgaaagaagattctatccacagtcaagttatcagcccaaagtgaagttatgataacattttcaggtacgcagagtatcaaataatttatctccctcatgccctgtattaacaatctactgctgtataacatcttccctgcaaatttggtggctcataccaataatcctgtatggtctcagtctctgagactcagaatccaggaggggcttagctggatggccctggctcggggtctgtcatgaggcttcagtcatgacagtagcctgggctgttgtcatcagaaggcttgagtggggctgaaggatccacttccaagctcacctgtgcagctgctggcttggagtttcagtcccttggcatcataggtttgccttaaagacacagggctgctgataacatggcagctggcttcccacagagcaagacatgacagagaaagagagagagagagtgcaagagagcaagacagtgatagcacaacagagcaaccaagatggaagccacagagacttcacttgacctcaactctaaggtcgcacaccatcacttttgctttttcctatttgttagaagtgaaccactgagaagtctagcacacactggagaaggagaattaggctctattgctctatttcttgaagggatgatattaacagatttctggacatattattaaaaccacccatcctcccaacagaagagttcaaaattccctgtgaggtggctcagtggtcatagcacaccatgcctcggcttcttactacttgtcacagaggcaattaaccaattatgtgtgtaatctgcagggtactatcagtctctctttctaaatccaaggcttcaggaagacaaggactattataagctatatccctggtgaatagcacaccatttggtatgtaacaggggctcaagagatatttattggatgaataagcaaatgagcaaataacaaatgaaagagggaagaatactggggggagaagaaatagtatatagaaaatgactacaacaaagaggtcaaaattgcaagaatttttatacagtgcaatgctaagataatgaaatacaaattcagagcagcaggccaaccagcctccatttgctaggactgcagctcacatactctgagttatgaggatgaagccctgggctgagcctcaggcagcaggaaactccttagactggctcagcaggctgctggtaaaacagaaaacctattttccaacacacgagacagaagagccgggaagtcacatctcctttatcaagcgaggcttctctcatcgtcctcttggtagcgacaggcttcaaatccacacactcccatcaacagcacccagggaagccagccagtaggtttttcctggcttctgctggtggggtcactctatatgcatgagaaggagggctttttgctgcgctcctattcccaagaccactgctacagattcttggaaatacaccctccccgtggagctgggcttccaggatcaaccacacagcagtctgagcttggcccctgcaggcacagcccagggcatgccaggtgaggggaagggcgagtggcaaaggagaacagaggggaaagggaagacagaatcatgagcagaaagcacgtttcaacaggcagctgaaaaaacgagacctaggccctggagggggcacgctgtgcccagagcaaaccacacacacacaaatccagcagcatcaccacctcaaattcgatgctgacttagcactgactaagtgcaattctcccacctcagcctcctgagtagctgggattacaggcacccaccaccacgcaggggtttcactgacatgctcgatactgtgaagtgctaagtatgcaagaagatgtgacaacccagccctgattttcaaagttacctgtgggcataacacacagacgaaatgatgaccgagaatgcaatacaaggtggcaagtgccaaagaagtgatgtgtacagcatgtgtcagaagggagctgtccctaggatggggccgtccctgaactttcctgagggagtcagagcttgaacttcgtgattcctgcaacagtgttgtagcttgaaagtgcctgtgtgtgaggagcgtgtatctcacacattgttccatgttcaatgtgcctaatacaaaacaagaatctacctacaaggggtttaccatcttgctgaggatgtaagacttgtgcacaaatacccgccatccaaagcagctcaagaggctatgctagtgttaataataataaataatagtagccatgtccctgaggaatgccaacccatctattctactgctggaggcaatacggagcctctgcagggctcagtgtccacatctgtgaaatggggttgtaggaacactgactaagataaggaatagagtaactactggcaggtaaaggcacttgagtgtctctccttcctcctccttccatcttccatgaagatgatcaggcaagaagaaggtagcattagatgagggctaatttaaaagatggggtactggcaaggaaaggctctatttgcttgggggaataatggaagacagggccaagtaaagggttgaggagggcgaattgactgtggtgcacacattctaataccagcagcctcatctaccaagccaggcacttgacatgcactacctcgtctaataccccactaactcacgggatgcacaccatcgtggcccggctctgcagaggatggagctgaagtttagggatatcaagtgtccaatctaagctcgcaggtggcacagccagaacctggacccagatcctttattccaatgtgctcataaccacttcctaatgctgcctctgggggatgcttcgtgctggggggcactgacccatgaggctgaaggggaagtctagaagaaggagtttgcatctagcatctggcagcctaggagtacatttcctatcacccagggaggctatgtcttgctcttggtttctctctcatgcactcatgggagtgacgagaaaaggagaaaggacagacgtgaccacagacttagtgagtgcagatgttggaaggagagggctggaatcatgctgagccttcccgtttgggcacgtggagatgggtgtatcactaggagaagtagggttactggtggggaggagaggaggcaacttcaggttatgtgtgttgagtgtgaaatgccccagtatattgaaatgtgtcttagtctgctcacgctgttataacaaagtaccacagacggaggggcttaaatgacagaaatgtgtagagcggttctggaggctggaagtctgagctcagtgtgccagcatggtcatgttcttggtgagtaatcttcaggcttgcaaagagccaccttccactgtgtcctcacatggtgaacagagagagagactgagctctggtctcttccacttctttctttctttttttttttttgagatggagcctcactctgttgcccagtctgaagtgcaatggcacgatctcagctctctgcaacctctgccttccaggttcatgcaattctccgacctcagcctcccgagtagctgggattacaggcacccaccaccatgcaggggtttcaccacgttggtcaggctggtctcgaaattctgacctcaggtgatccacccaccttggtctcccaaagtgctgggattacaggcatgaaccaccacacccagcctgtcccacttcttataagaacactaatctcaccaagggggccccaccctcctcacctcatctaaacctaatcacctcccaaaggccccttctccaaataccatcacactgggggctaaggcttcacaatatgaatgggtgagggacacaagcattcagtccagagcaaactgtcagcatctagctgggggaggaaaatcatgagtggcatctttgggaaggaaggcaggcccagatgtagagaattgagaagagagctgaaaatctgagagggcacaagaaggccaaagatagggagaagaagaggaccatgggttggtggaggaggggagaggagctggcaaggttttgacttgtgcacttggacgtgagtgtgtgtgtctgtgagtgtgcacatgtatggttgcatgcatgtctgttgcaggaagtcagggaccccaaacggagggaccagctggagctgtggcagaggaacataaattgtgaagatttcatgggcatttatcagttcccaaataatacttttataatttcttatgcctgtcttgtctttaatctcttaatcctgttatctttgtaagctgaggatgtatgtcacctcgggaccactgtgataattgtgttaactgtacaaattgattgtaaaacatgtctgtttgaacaatatgaaatcagggcaccttgaaaaagaacagaataacagcgatttttagggaacaagggaagacaaccataaggtctgactgcctgtggggtcgggcaaaaaaagccatatttttcttcttgcagagagcctataaacagacgtgcaagtagggaagatattgctaaattcttttcctagcaaggaatattaatattaataccctgggaaaggaatgcattcctggggggagatctataaatggccactctgggagtgtctgtcttatgcagttgagataaggactgagatacgccctggtctcctgcagtaccctcaggcttactagggtggggaaaaactgccctggtaaatttgtggtcagaccggttctctgctctcgaaccctgttttctgttgtttaagatgtttatcaagacaatatgtgcaccgctgaacacagacccttctcggtggttctgtttttgccctttgccctgtgatctttgttggacccttatcagtggttctgctttttgtcctttgaagcatgtgatctttgtacctactctctgttcttacaccccctccccttttgaaacccttaataaaaacttgccggtctgagactcaggcgggcatcacggtcctactgatatgtgatgtcacccccagcagcccagctgtaaaattcctctctttgtactgtctctctttgtttctcagccggccgacacttatggaaaatagaaagaacatatgttgaaatattaggggcaggttcccccaatacatgtctatgtgagagacagcacagacacatgcaagaggcaggagtgagaggacctccatccctgaggcaggaggaataccaaggatacttcaaagtggaagccataggtggagagagctccagaaatgcaaagaaggtccaaactacataaaatgctccacaaggaccaggaaacctacaataatttttttttttttttttttttttttgagatggagtcttgccctgtcgcccaggctggagtgcagtggtgcaatctcagctcactgcaacctctgcctcccaggttcaagcgattctcctgcctcagcttcctgagtagctgggattacaggcacacaccaccacgcccagctaatttttgtatttttagtagagacggggtttcgccacgttggccaggctggtcttgaactcctgacctcaggtgacccacccacctcagcctcccaaagtgctagattacagtcatgagccattgtgcctggctgacttagaagaattttaaagcagccaagagacttggcggctgggggtcactggacaccttcagtaaaaccattttctttaaatggcaggggactagaggttgtgggtaaactaaggagagaggcagagagcgatggctcaaaaggaagcagggtgttcgcaaatagagaattgagagggagaaaacagagtttggggaagggaagatgctccaagtcagttctattaatgaaatggactgcttagaatttagacagaatgaaaaaggtagaaaagtgaggtaccataattattagtatatttctatcatgtcattcaaatatgcttaaaactaatgtgccatgcaatggaatattaattggcaacaaaaagggatgaagtactgatacatgctacaacacaggtacgtcttgctaacactgggctaatttaaagaagccagacacaaaagcccacagacgacatgattttatttatacgaaatgtccagaagaggcagatctagagaaacagaaagtagattagtggctgcctagggcttgagagggaatggggttgggggatgctggctaaggggtgcaggatttgttttggaggcaatgaaatatgctttttccttttcttttgtttgagacggagtctcattctgtcatccatgctggagtgcagggccacaatcttggctcactgcaacctctgcctcctgggttcaagcaactctcctgcctcagcctcctgagtatctgggactataggcatgtgccatgacacctggctaacttttgtattttttgttttagtagagacagggtttcaccaggttggccaggctggtcttgaattcctgacctcaagtgatcctcccgcctcagcctcccaaatcgctgggatttcaggcatgagccactgcgcccagccgggcaatgaaatattcttaaattgactgtagtgatggctgcacaattttgaatatactaaaagccatggaattgcacattgtaaatggttgaactgtatggtatgtgaattaaatcaacaaagctgtctaaaaatttactatgtatattgtcttcaggatggcattttaaaaaagaaaaatttactatgtatatctatgagtaacaagggatcttttagggtgataaaagttctataattggattatggaaatatctgcacaactctataaatttactaaaaatcataaaatcgtacataaaaactggtagattttatggtatgtcagttatgcctcaataaagttgtttaaaacaataaaaaaactttaaaactttatgacacagacaaaacactctataatagggttgcagtacatttagactaaaacaactcaaaaatataccgagtcatctgtcaaacgagaataacagttccgtagaatcactgtgaagatggcacaaggtaagacattccctggcctacagaaggttcgatgcagcgcagctctgattaaggggattaagggaatgaatcccaccatctctgaatctggcttccctgtgtgatatctccggggtacggcaaagcctgggtaggatgtgcacccagacacgtttcttggcaatgaaatatcccacagcccaggaaggaggtgagggcagattgattccacttcttgtggcccaagagaaggcctgcaggtcccagggatgaactttgtcttgaaaatcatatgggtggccagacacggtagtacatgcctgtaatcctaacactttgggaggctgaggcaggtggatcccctgaggtcaggagtttgagaccagcctgaccagcgtggtgaaaacccgtctctactaaaaacacaaaaattagctgggcacggtggcgggcgcctgtaatcccagctacttgggaggctgaggcaggagaattccttgaatctaggaggcagaggttgcaatgagctgagatcacaccatcacattccagcctggaccacaagagtgaaactccatctcaaaaaaaaaaaaaaagaaaagaaaagaaaagaaaatcacatgggttaatttgagtggggaagggaagggagggaacgcaatactaagggaggcatgtgtatggggcgtggtggggaataggggctggaaaagccatttgtagttgctggacagtagagagccactcactgtaaaccagtaggtctttgtaggtgccctcgaggaagccaggagacaaaaagaggctgcccctatctgtcagctggttttatttccagagcccagggaatgtgtcaaaactatggaaagtccccatcgcacacgactgggagccaccttcaggctggaaacgtccatggagtccctctgcctgctggggacaagccagctagcctgtcctattggaccttcaagggcaagcatgcagccttgtgattcttggccctgttaaacccaccgtcctttctatcaaacaaaaacggaacgtcctgctttcttgtttgtagaatacaaagacgggatttggtttcccaaatagaagattaaatctcaatcctcagtgcgctgctttaaaccccatggatgcgcgcctctgaggcaactgggccccctcgcctcctgcccttgttgtgaatctccagtgcagccccatccctctggcgctgccaggaaatgcttactgactgctgggcccgtggtgctgccatagggccacacacttcatccagcctgtagccagccaggggcttggtaaatgaccccaaaggcagactctgccggctgtgtccctgtctctacataaaacaacgcacaaacccatacctttcccagaatctgcacgtggttcaaaggcatgaaatgccacacgcaggaggtacaaaggacctgcctgaggcccaaacaggttactctagggaaagtgggggaaggctgtgtggaccattgagctctatgtagttatagcatgcctcttccctcatggcgtgaaggatttaaagcccccaaagagaggctccttccagggttctcctttcaagcacttcaaaatagtcccactgagagatgactccgctccagccaggttctcagctcctggagggcaggtcacatttgctttctctgacttgcatctcacatgtggcacagagcagacccccttgatcagtattcggcagaataagggactagtctcccttcatcccctaggcctaattctccctggatggccttgaagagaagcaggtacatccaggtgagggcagaattcaggtattcttgcttccgggtcagatgctttcctattagccctcatccgtcatatcccactcttaccaactttccacacaagacaaactcttacacatgaataccctatgtttatgccagagctgttaaacctgtttctacgtttctttgtaaacactatcttttttgggtgggggcggggttggagtctagctctgtcgctcaggctggagtgcactggcgtgatctccgctcactgcaagctccgcctcctgggttcacgccattctcctgcctcagcctcccgagtagctgggactacaggcgcccgccaccacgtctggttaatttttttgtatttttagtagagacggggtttcaccatgttagccaggatgtaaacactatcttgatgcatttttattccaagtccccatttgaatgcaaagtcctaggaatctggaaccactgttatctccctggcatcccatagggagttctgcccagtggtcaatgtcctagaaagctcaggtagcacacagccagaggaggatagaaacccttgctgggagcacacatccctcttccctcccactccccacccaagtagagagtatgtggataatttagaatctaaagtcgagggttggatatgatctattacaaagatacctaagcaatttaactgtgcctgtaagattataaaaggaaaggttaaccatgcaagaagaccatgtgctttcaagcaacatacaagcatttgttgatgagtaaggcagagtggtatagtaagcggggcctcaaactgcagtcaagaaatccgtttctggtcctgtctctgccatgacctagctgtggcacctcagaccagtcatccagtttcttgatctgtaaagtgggcacattggggtaaactaaataatctcccggccacgcagtggctcacacctgtaatcccagtgctctgggaggccgaggcagcggatcacgaggtcaggggatcaagaccatcctggccaacatggtgaaaccccgtctctactaaaaatacaaaaatcagccaggcgtggtggcgtgcacctttaatcccattcgggaggctgaggcaggagaatcacttgaacccgggaggcgaaggttgcagtgagccgagatcatgccactgcactccagcctggtgacagagcaagactccatctcacaaataataataataataatctcccaagtccccttccatcactgaacatgactattctatgacacatggatgaaaaattgtaaggataaataaataccaggtctgttcttataccgccctcctgtgtgtgtaaatattttggtactatttaaagaggcatgtgggttggtgggggctctggatctctaccttcttttggtgacagcatcctgcttttccttgagaaaccccctacttccatcctatgtaatcctgatggaattgttgaacaagcctccagcctcccacctccaggcagaaggaatagtagctcaagcttgcctactctcgacaactgcccctgcttggaatgcatcccagggctctcgggaggctaagcatgagggagattgatgggtgaacttgggctgcaggagacaccacttgttcaatcagcagactttgcacttagcatgtggaactggccacctacagtgcccgatcttctgtggccagatgtgctgtcaaggcagatttatactcaggagtgcgggaggcctggtggcgctccttcccgccctggatcagtgagacacagcctccagtttctgcttccttccgtccatgggcttggatttgtatcttacctgatcaattcttgtcaggaatgtcagaccagctgtgaggtcctcctgagtgcaaacagtgacagccaggagatgtggctcagagttaatttttttttctttttctttttcttttttttttttctgagatggagtcttgctctgttacccaggctggagtgtagtggggcgatcctggctcactgcaacctccgcctcctgggttcaagcaattctcctgcctcagtctcctaagtatctgggactacaggcacctgccaccatgcccagctaatttttttttgtattatagtagagacaggattttgccaggttggccaggctggtcttgaactcctgacctcatgctatccacctgccttggcctcctaaaattactgggattacacgtgtgagccaccgcacctggtggcttacagttaatttgcaaccaacctgactttaaagctgggaaacgaagagagacctgttccagttataattagagatccttttggactagtgaaggcagaagggtgtttacaggatcttgttatcttctttcttggtttatcctggccgccccctcagccgttacttttcctagccaatcttcaactgcttcctaaggaagggtacaagtctgaaaacatctttattctatgaatcatcattgagtgaatgtgagtatagaaaattctaggtttaatattatttttcctcagaactttgaaagcttgaagcttgggaaattaaaagccttgtttattgctggggagacctttgaagcacttctgccaaactatttccccctttctggaagctctaacgatagcattctacaatttcatgctgatgtatcttggcaacggtcccttttttatatagtgggctggcacttagggggccttcccactcttgaaaattcaggtacttcagtttgggaaagtttttattgtatcacttttgcacttttttttgagactgagtccctctttgtcgcccagactggagtagagtggtgcgatcttggctcactgcaacctccgcctcccaagttcaagtgattctcccgcctcagcctcctgagtagctgggattacaggcgcccgtcaccatgccgggctaatttctgtatttttagtagagacggggttgtgccatgttggccaggctggactcgaactcctgacctcaggtgatctgcctgccttggcctcccaaagtgctgggattacaggcgtgagccaccgtgctcagcctcacttttgtgctttttaagctccattttctctttctttctggaatgctgacgagtcaccagtagatcctactggattcatattctcatttccttaccttcttttctcacattttgcatctacatgtcttttattctatttttaagagatttcctcaacttcatcttttcatccttctactgttttattctagctatcttgtttttgatttccaagagctccttcttaatctaattgtgccttttcattattgatagcatcctcttcttctccctctgaggatattcatcattttcattgttgcttttgttttatgtttccttgtgacctctgcattgtttctgttatctccaaattaatttttctgtctttatctttcataccgaaggcatgcctcaaaagtctaaggaattagagctatccagttgtggtataatacaaaacatattttgtctttgtgtctggtggcacagagcttcccaaactcctggaattaactaaggaataggagtgtctttgtttattcataatgagccccttttgttaacacccgagtttatgctaataaggtgactaacttgaggtaggcccctagatagtctcagggtgggctggtcacggtcaccagaaagaccaagtgattagaaggctagaattatcaaccccacccactgacctcctagaggggattcgaaggaggctggatattaagccgtctaaaaactcaacaagaagatatgatgagtttccaggttggtgaacacacggaggtgcttggaagggcagtgggcctggagaggaaatggaagctccatgcctctttccctataactgcccaatgcatctcttccatctggctgttcctgagttgtatccttttaggataaagtggtaattttgcaagtagatggttttcttgagttctgtgagccattctaggaaataactgaacccgacgagggggtcgtgggaacccctgatctacagccagatggtgagaagcccagctgacaacctagattggtgtttagcatctgaagtaagggatctgagcccttagcctgtgggatctgacacgatctccaggtggatactgtcagaattgagttaaattgtaaggcaccaaattggtgctctcagaaaactagagaattggttgttacaggaaaaaaaaaaaatacccacatctttgctggccataagttctgtgtgtgagtgttgggaaaacaggagtttctcttatcactggtcatatttaattgcaaagcattaagaaatggaccagaggctcatatgcatagaaggggcctgttgggtggggaactaccatctagggggattgggcctccagtcatctttttggtaggtggacctccaaatatcaatgttttgaaactgcctttgcaaagaatatgacaggaagagaagcttgacatggcagactccatcttggcttctagccctgcaggtgggctgccctcgctcattcttaggtgcaggcaaggaatttagtttatggtttaactttaaagcaaggatgataatagtccctccctaaaactgatccccttcctgttcagggactgaaactggctttgtaagactaagtgcagactacaagattaggattacgggaggggcctgaattctgctaaaatgtaggtatagctaaatgacagccagcaaatgtccactagcttgtttttctataatcccttgctgctcaggagtcgtgtggccagaggtcacaagatttgtgatttctgcaattgctcctatagataacactatacatcactattgtagaacctaagattggtcttttgagatgtttttcagacttttgcattctggcacctgactgaccccacctggatctgtgattcctaagcaatcctgtcctgtggctcccacccagagtcggactcagcacatgaggactcttccacacctctatgatttcatccccaaccaatcagcagcatgcattcccaagccccctgcccaacaaattatccataaaaatcctagcctttaacttctgagggaggcagatttgagtaataaactgtcttctctttccacttggctgtccttatgttaattaaactctttctctactgaaacaacattatctcagtggattggatttatctgtgctgtgggcaagaagaacatgttgggtggttacagtttggagattatttctctaagatcctgcagcagagtccagcagtcttttcctctcttccccggaggatataatcttggtttcactattcccaatttcggcttagatcatcttctttcttttctttctctctctctctctctctctctctctctttctttctgccctctcaggcccaccttctcctgggattcactttctccagatacctctcttggttcatttatctggataacaaatttttctcctgccgtggtacaggagcggcaattgttctgttatttggtgtgggatgagctctaaggattcctgatacagatcacaaccaaccatcctgtttgcgatcccatctctactccaagtttggagcctcaggatctcgacacttcctagggtttatgcaggacatttcagcttgcttcttcgtggcttcccttttgcaatcacctggactccatctttctctactctttgtccatttctgcatccatggttcaaatatctgaggacctctcatcactcatcacatcttggagtaacagtatggcattaaaaaggtatgtccaaaagagagagactcttactttcattttaacggtattttaggaagcagcagaaatgcatgtgttaaaatctgccacatttaaacaaggtctgcttaactatcccaagcctcagattttgtttgtttgtttgtttaattgaaaacgaagagtttgggcgtggtggctcacacctgtaatcccagcactttaggaggctgaggtgggcagatcacttgaggtcaggagtttgagaccagcctggccaacatgaagaaacctcgtctctactaaaaatacaaaaactagccaggcgtgggcacctataatcccagctacttgggaggctgaggcaggagaattgcttgaacccaggaggcagaagttgcaataagctgagattatgccactgcactccagcctgggtgaaagaatgagactctgtctcaaaaacaaaaacaaaaacaacaaaaaaaaaaaaaaagaaaagaaaatgaagaaaactctagtaataataatacttgaatactctcttaagaaaatatctttccccaattctcaaatagtacttactggtttacctattaaagcttaacacatgcttatgctatgacccaacaattctacccctaggtacatatacaagaaaaatgagtgtgtgttcatcaaaacacaaatacaaaacactcattgtggtttttctcctaatagcccaaactggaaacacccaagcatccattcacagaagaatggacaaatagtagcatataaatacaatagaatactgcatagtaaaaaacatgtaatcaactattgcaatgcacacagacgaacctcagagatgtcacattaagcaaaagaagctggctacagaacagaatgtgcagtatgattccatttaaatgatattccagagcaggtggaacctatctatggtaaaaagaattagaatactaattatctcttagaggaaattactgcttaggaagagctatcaggaatgcttctgagttgctagggtattttgtatcatgatctcaatagtggttatatgggatatacatatgtaaaaattcttttttttttttaagacaaagtctcactctgttgcccaggctggagtgcagtggcatgatcttggctcactacaatctccacctcccagtttcaagcgattctcctgcctcagcctcttgagtagctgggattataggtgcacaccactacatccggctaatttttgtatttttagtagaaaaagagtttcaccatgttggctgggctggtctcaaaccagcctggtcttgacctcaggtgatctgcctgccttggcctcccaaaatgctgggattacaggcgtgagccaccatgcctggcccgtaaaaattctttaagttgtatatttaagatttgttttactgtatatatgttaaaacttgatttgaataaaagcaaaaaaaaaaaaacattgtttagactgctataacaaaatacctgagcagcttacaaacaacaattgtttgtttctcacagttcttgaggctgggaagtccaaattcatggcaccagcagattcattgtctgggagggtgcattttctgagtgtcagactgccaacttcttcctgtatcctcacatggtagaaagggtcaggcaactctatggggcctctcttttaagggcactaatccagtctctagggccccaccattatgacctaattacctcctgacagccccacctcctaaccatcacattggaaactgggtattttgggggtacaaacattcaggccatggcaatcactgtttataattttaaagctttgtggaaaaatagttttccagggtaaaagttctacctaatcagaaatccacctggatctcagaagggagaggctgggcatctttgcctgtcagagatgcagtaactgagatgctgtatctaaaatgcatagcttagtctttcttctccctgttctactatcagtggtgtgctctttgaggagtcacactttctgtgagcttcaatttcctcttacaacaaagaggtgaactatattatctttcaggttcatccaaattctaaaattctttgtccacttgggaaaagtttgttggttttgttttttatttaacaaaaatattctctttcctccctttcaaccagacacatgatttctctgctcttaatcctcctactactgaccagatgataagggaaccacatcaccaatgtcttttatactcaactagcttagtgcaatgaatataacacatgctattagatgagaatgtaactttgccataaaaatagtgaatctaaagcaaagccttatatttataaagtgatgaaattgcatccacaataaaaaatcctatcagcaaagctgtgtaacaatacaaggctttggagagagttatttctaccaatgaacttagtgaatcactaaataaactgtctttttgtctcccccacaaaaacttggccttagtataaatgatattatattttctctggccagaaaaataagaaaaaataagatactattatgcttggagagaaagctgctccccaaggtcatgttagtgtaaccagagatcctttcggagggaagacaagcatctgggcagtcaacctgatgggctggcaaactttatccgttagtagattttctcccagggtcagctttaagaatcatcactgctgtatcctagacattttggtttctatttgaaatcagagcaacaataaaaattaaggtacatttgaatgatttagaatctagagtctagggttggatacaatgtataacaaagatgtctaggcaatttaattgcatcattcagattgcaaaagaaatggttagccacacaagaagataatgtgcctttaagcaacttaaaagtaattcttgatgagcaaggcagaatggaatagcaacggggcctcatatcacagtcaaaacatctgcttctggtcccacctctgctattacccagccttggacaagacatccagtttcttgatttgaaaagtgcacatactagggtaaactgaataatttccaaagtcgtctttttacggtgaactttaacattctatgatatatggatgaaaactacaatgacaaataaatagcaagttcgttcttgtaactccctcttgtgtataaatatctcgatgtcatttaagaaggcattgtgcttgggggggtttagttttcataagctcagcatccttactgcttcttttggtgatagcatcccgcttttctttgagaaattccctgcctccatcctacacagtccgatgaacaagctcctccccgccccttagtgttggcctctacaacctgacctggattctcccaatccgattttctcttccagaattgaaagttgagctgaatgacacaggggcagaaaatggttgttcgtgagtcattctgacgtcagctctttgaagagactgcccatagctcccgtctattattgcaggttttgggatgccttgctattggtcttccaaagactagcttttccttagattctctgagttactccttatacttttgaaaaacttcttcatatgctttagctggccagagatgacatctgttgctcacaaccaacaaaccctaacggatggagaactcttttctggtccccattgtcagattttaatttgtattttgaagtaataaaaccgaatttgtttaaagtgctctaaaaatttcgatatttttgtctaattaagacacccattttctctaattagaataagcagagctactgcacattctaaagcataatattaattttctgctaccttagactgtacttgattaacctggtaaaataccatggttctttatgaagctgagcctgaactaagggcaaatacattcatggatcagaccctgggactagttctatcctcctctataatcatggatgtcatcatcagaatgctgtggaactcttggcagcatccaatctaccaagtgttctccggagagaaaagcagaagttgatcactctgcctctcagccaaaagcccatcatagcactgccaggggcacttctgccaggaaagcaatgagctttttagcaggtggtacaaaagtacgccaggagctaagacttcaaatattaccctcaaaagagtaaaacgcctttagttaaggcaggatggggcagagggaggcggcagagaaggacctgcatattccactaatgaaggctagagtctacctccgtaagagtgcttttgtgaagcaacatttaaaacgtgacactgacagcgctactcactgatgggttaggaggccatgagaaccgctttcttgagagagctgagcaagatatataatgggacttatccggtctcagaactgttgctgagaaaaactgttgacattaccctctcattctacattctagaacaacacggcatgtctaatacagtagccacatgcggctttttacacttaaattaattaaacaagattacacaccatttcctcagtcatagcagccacctttcaagtactcaaaagccccaggggattcatggctaccatactggaccgtgcagatactgagtatttctatcactgcagaaagttctacaggacagtgttactctactgagaagtacctgaccctcttgcagaactggagaaggagtagttcctcccaaatggtgccctcggcccccagtggtcccatggaaggcggagagacaagaacgaccataccaagaacggccttggagagttgtcagagctcaccctgaggatggaggagttcctctatactcaggccaaatgagggccactgcaagagacatgcttgcagagtttggcatgctcctctggagaactgggctctgaacacattgtggaatagtcccgaggtgagaaggtgcctgagagaactccagtagccatcagaggagagggggatgccctggaagcagcctgcatttccagaggcaaagggccaaggtgacattttagaaggtgactaggtacaaacaagctataaaggttaacccgagagatcagcctgcaaggacaaactgattctaatagcatctgtgcagagaggatcacctggggctggggggaccccaagaggtcatccacaatgcatcctgcccatccctgtgtatatttccatgaagaggctctgaagagccctcacaattaggaccccatgagaacaatggtccacacttgagaatctgctacttcaaggacaccaacactaaattataactgtaacctttagggaaggccttttgtcactcaccacccaaacacaatccttcacttctttcttccttcaatcctaaggaattggcaaggcaagcagggtagggggtaaaaaactaaggaaggggcaaaccacccacatcttgtccactgcaggctgccaaggctaaagcaacccaggagttattggtggaaggaaagaatgctctactcaaggagatgctgaagttctattaagactggtccatcgggattgcatatgacaatgaatctgctcatcaatacctaaaacttacaggaaaatgtagctgtctatggaatcacccaggggaagggaagggagagccaacagaacaggttaggaagacattgatatgagaaaatcaagctgttatgatttcaccctacagactcggaaagctccagaaagaatgcaggagaggctgggcgtggtggctcatgcctgtaatcccagcactttgggaggccaaggcaggtggatcacgaggtcaggagttagagaccggcatgaccaatatggagaaaccctgtctctactaaaaatacaaaattagcaggtcatggtggcaggtgcctgtaatcccagctacttgggaggctgagacaggagaatcacttgaacccaggaggtggaggttgcagtgagccgagatcacaccactgcactccagcctgggcaacaagagcgaaactctgtctcaaaaaaaagatttatgtcctagggccaggtgtggtggctcacacctataatcccagcactttgggaggccaaggcaggcagatcacttgagatcaggagtttgagaccagtctggccaacatggcgaaaccctgcctctactaaaaatacaaaaattagccagatgtggtagtggccacctgcagttccagctacttgggagatgaggcaggagaatcgcttgaacctgggaggtggaggctgcagtgagccgagattgggccattgcactccagcctgagcaacagagtaaaactgtgtctcaaaaagtctgatgtccctaaaagtgttttgttgttgttgtacctgtgctggaatgcctgtctctagctttcctttatatgagaaaagataacattgtttcagatattctatacatgcagccaatcccttatcctaactcagaagccagaatccattgcggagagttgaacttggttttcaaagtcctatgtgcttcattctaaatcatctgtccttatttctgtaggctgaggaaagttcctgaaggtggttgcccagttgtagagtgtcctttcagctccatgactatattcttcagatgggacttgaacttaggaatccctacatgttggggagaacaggatgctgtaacagcaatgaacttccagacacagctttgatcattggtgaatcagagagttctgttgttgttgtttttctaatctctttgctgtttcttttgctctttcttcccaccctcattctcctgccagggaaaaaaaaaacatagccaggcaagagcacatccaattccctttcttaattagaagcgaaacatttaaaagctgtggcacaactgcttgacgaacatttgcaagttatctccaagcacaaagccaacacattaaggaaagcaacagggtcatagaacacgtcccaggctaacagagagggtgatccagatttgcagaggtgtctgtcaaccacggctggaggctcctaatcccctcactcagagctggtcatgcacagagaaaggctcatatgaaacacaacaaacccaagctctcccaggtgtccgtagcccagctacgaaatctgtcatcccaaactaacactccagagcacttaatgggttttaggggagcgttcaaataaataatcatttcctggtattggagattggatttcatacaccatagcccaggcccaagcttaatgggagagagataaagaacagagttctttttccaaaagtaaaatttacttctgatccattaatatgtatgcaaatagtttcttccagactctgtggtctgggaaataaaatagccagcttgatcataattattttcttacttccagggtgcttgatattagatgcagtaatggtttgctatggcaaatcctagggcctctttccctagaaagtgttaaataagaacaggttgtgtctcagtccatttgtgttgatataaaggaatacataccccaggctgagtaacttataaagaaaagagatttatttggccaatggttctgaagcctgtacaagaagcatggtgtcaacatgtgcttctgatgagggcctcgggaagcttccactcatggtggaaggcaaaggggaactggcatgtgcagaggtcaatggcaagagaggaagcatgagagacggaaggaaggaaggaagaaaagaagggagggagggagggaaggaaaagaagggggagggggaggaggaggaggaggaggtggtggtgtaaggtcttttcaacaaccaattcttgctggaactaagagtgagaacttgctcccaggagaatggcaccaaggcattcatgagggatccaccctcatgacccaagcacctcccaccaggccccatctccaacaatgaaacttcagtgagatttggcagagccaaaaaacccacatccaaaccacagcaggtacacccatgggaagcgctcaatggatgatggctatgacaacatcactaactcccaagacgaacaaagtatttcatctttacacagttctaattgtgaaaaatgtattccttagactgtgttagcatctatttccctttaccttccactcctgggtcctatttccagcctgggagtaaacataggataaacccaaactcttgtccccatggtggtctgtattattccattctcacgcagctaataaagacatatccaagactggctaatttatttaaaaaagaggtttaattgactcacagtttcacacagctggggaggcctcaggaaacttacaatcatggcagaaggtgaagcaaacacgtccttcttcatatggtgacaggagagagacatgccaagcaaagagggaaaagccccttataaaactatcagatatcatgagaactcacacactattatgagaacagcagcatgagggtaatcgcccccatgattcaattgtctcccaccaagtccttcccacgacacatgaggattatgggaactacaattcaagatgagatttgggtggggatacagccaaaccatatcaggggtcctttcaagacataaagcagtttatatcacctgtgtcttcttttgtccagcctgaaaggtccaatcatcttgacccgaaaggtcaagccactgctcccgtggcttagtttccagtccagcctgctgaggttcttgtctgaaagccccaggctgtggcagtctcttctatcttgtagctccttggacacctggagaggtatctggagggtgcattcctccaggtgtggacaagcacctgcagatgaagtagcttgttccgagaggaatgacttcacaaggatggcttagactcgcaggctacctcgcaccttgcaggtaggaggtaagcagtgactatttcttgaatcaatatatgactgaatgaaagattaagcctattgatttaaaacctatgttctttttcccacttctgaatatacttttatcatttctttggggggcctcatttctggactctacttaggtccctgtgtctactcatttcaccttgtttaagctaataggaattctagtctgttgagatcctttgatttagtgactcagtcatcccagaaattacctgtccctcccaggctcatgtcaactacagattgtcatctcaccagtatactcatctgagcaattaattagattatatttggcttataatcatattacaagtttttttaatgtcagttgtagaatgatccatcctttttatttgtacagtgtgaacagaaagctactacattctacatgactttaggacatttacaaaaagttatcttcactttgagaagaaactggataaaaatgaatgtctgccctattataaggttttttttaaaaaaaagcaggtaaaatatcctctgcctagtcttccctggatggaggggtgtcataaattgaactgtctctcccccaaattaatatgtgaacgtcccaactcgcaataactcagaatgtgaacttatttggaaattgtgtggtttgcagatataattagttaagttagaatgagatcataatggagtagggtgggcccttaatccaatattaaaagtgtcctcataaaaaggggaaatttgagcacagaatcggacatacataaagagaagatgacgtcaagagacagagggagaagaagccatctgcaaaccaaggagacagccctggaacagatccttccctcagagccctcagaaggaagcagccctgtggccaccttgatttcagatgcctggcctccagaactgtgtgagaatcaacttctgttcttcaggccacccagtttgtggccatttgttccataagccctaagaaactaatatgaaaggaaagggggcagatggccaatcccacctctctgctcagcagggaaccatgcaaagtccttctctacttcaggcaggaacaaaagtaacactaagagcgagtgaaggtgagccactctctgcaaagcccctctgggattttgaacttctagaagcccaaaaaacagcctatgacaataacaatcacatgaacaattcaacagtacactgaatgcattttaggcttttccaacagcctcttggtggatcccaaaccattttgggaagtaggtggcacagaagttattatttccattttgcagaagacaaattattctcaaatcagaaactggctcaaggaaatgaagctagacagtggtcaactccaaaggagagcccagagacaatgactccctctctgtgttaagaagctcacaccacctgtgctcctctgtgctgtccccaaactcaatcctgtcaattcatgctaggccctgtgttccctctgggcctctacacattcttaaggggacaggactctagggaaggcaggtgagacatcagcacaggcacaaaggcttccttccgattgacaacgagcacgccaaagccagaaaacaagtgacttctgtgacttccgtcagtttacactaagagggaaggtcactgactatggtcttgggtgatgtgacctatggacaattgtaataaaagtggtaccattgcctgctggaaaaggtaggtatgggagaaactgcctgtgggaaaatgatctttgactattttcccctctggatgttgaaactgtcttccaaataactgaattttgttgtgcccccagggtcacatggagccctggtttaagttcttgcgatgtcccatcctcatgaatacatttgtagctgtcttaagcaaagtgaaacaagagcatctttaaggccttcccagtccctccctaattttccttgtgcctctcctctctcctttgctgagcctttgcagctcagagcaccctcacaacctcccttcaacaggagcaccctctctctcctgccaccgcggatctattacatggcacatcctacactgggattgcagagctcagcaagactctgtccccaaagagcccatgctcttgtcaggaaaaagtcattatggaacagggttgggggcacagtgttgggggagccagagtgctggggacacaaggaaaggcaaacgatggacgctatgcaggcatggggtgagatgagagatgtttcccgtaaagatgccctggagctgggtgctaacgggcgggcagaagccggccaggtgaaaagaatggggcagaaactgggggacagaggaggaaagggaggagaaacatgtggatgggggtacagctgcctcccagcaagtcagagcacagggtccccccagcacttcctgggttactagggtgatggcaggtgaatacagaatagcagggccttggaatgtctgccgtattataaggttttttgtttttgtttttgtttttgtttgcaggtaaaatatcctctgcctagtcttcccaggatggagggtgttgcagattgaatggtctctcctccagattaatatgtagatgtcccaactcgcaataactcagaatgtgaggtttttggaaactgggtggttcgcaggtataattaattacgttagaatgagatcatcatgcagtagggtgggcttctagtccattattaccaaggtccttataaaaaggggaaatctgggccaggcacagtggctcaggcctgtaatctcagcactttgggaggctgaggagggtggatcacctgaggtcggaaattggagacctgcttggccaacatggtaaaactccgtctctattaaaaatacaaaaaaaaatagctgggcatggtgatgcacacctgtagtcccagctactcaggaggcggaggcacaagaaccgattgaactcaggaggcggaggttgtggtgagccaagattgtaccactgcactccagcctgggcaacagagtgagactctgtcacgaaaaaaaaaaaaaaaaaaaaaaaaaagttgggggtggggaatttgaacagattttttgtggaaaaaaaaatctgaaaagacatacacacagcacagtgttagaggtcaaaacaatataatgtatagggatatccacattttagctaagtacaactcaaaggaatgaatttaaaagatcaagttcaactcaagaaagacagtcctggtgatgttttcatctgagaaactcagtatctccctcagactgaggcaaaagggactccgaggccaggcctcacagacgggccccttctcatgaggcaaggatcacaggtcatgggatgtgaccacactctggatacccagccctctggaattctccatccaaagtagtggaatccccactccactgacagggcctgcatagtcctcttccctgggtccattcccctgtgggagaccaagccattggtgtacactgagggtccaaacaggtccaccttctggcaagcaggtctcctgatgtgcaagctgcagctggagacaggaagagaatgggactggctggggccatttctccctgggcggccacatccaacaaaactccagggaggctgaaaatttgaacctggtttcccaggtccctatgaagatgtctttgtcagagtaggagacaatatgaaaaagagtactcatatatgtactacacattatatgcacatatactatatatatactatatacatactatacacacatactatatatatatagagagagagaatatatatagagagagattatatatataatatatatagagagatataatatatatatagagagagagagagaaagaatatatatatagagagagagagggagagagatctatctaaatgcaatctgttaatttgactcatgacttaaaattttctagacatatgacatataagactccatttgtacttttgctcccagctctgcaaatattaggggcgggtctggagggcctatgccctcagcttcacgtggccagtgcacaacaactgagagaaacaggtgtcaattttcagagtaacttgtttcctggaaactgttgctcaccacactctatgcccctggtcaggcgttctcaccagggagagaagggtgatttgaggttgaaacagggaaagaggacaggagacaaaggaaataagtggcaaacacttccaaccctaaactttttttctttctttcttttctttctttttttttgctctgtcacccaggctggagtgcagtggcacgatcatagctcactgcagcttcaacctcctgggctcaagcaatcctctcatctcagcctcccaagtagctgggaccacaggcacacaccaccatacccagctaatttttttattttttgttgaggcaaggtcttgccctgtttttgtagaggtgaggtcagttgccctggctggtctcaaactcctgagctcaagcaatcctcttacctcagcctcccaaagtgccgggattataggcatgagccactgtgcctggtcctaaactttcaaatgcctgaaacacatataaaggaaaagctgggacaaggcaggaagaggtgagtccaaaagcgttcaactcagtgcctgccccaagacaaaatggaagaaaaatcaacaaataccgtgagaactctctctgtggatgaaaactactttcattgcaatcagggttaaagagaagtccttctaggtcacccaactttgaccttgaggcatgagtcttcttactcccatctctcttacccagagtgccaggagccagattttagggtaaatatccaagtagcaggttctgaagtaaactgtctcagtagcctgtatcttccatctccttcagtgggctttccagacattggttccgtgcatcaatctctctaaactcatctggcaacagcagccaggcacaaaccctgcagtctttaaagtggcacaaattcacagactgagagatgttcccacgctgcatatgttcctaaaacaaccccgtccaagccatccatccacttgcctccctccaagccacaaagtagtttcatgagctccatttcagttctgagatcaccaacacctgatatcattactcagagtcactggctggagaacagacatcatttctttcccgttaaacattgctcaataatcccaaatagggggcactgcagagctgaagcttagaggtgaatggtaaattctaataagaaagtgcagaaacatccaggatcattaatgctgcattagctccacttcttgccacactggtgctatgttttgtctttctggactggccacagaattttctagtgctttgaaaaatacagtgctgtttcttgcagctaaatggaaacctgtagagagcaaacaagcgtagatccttgaacttggtaatgaatagatgggattctaggtgagaaagaacgaagaagagaaaaacaccaagtctccatattcagaaaaattttttcaatgccaaagttgtattcaatttaaaataaaagcacaaaaaaacataaaattcccttttatacataaaccagtgatatggtttggatttgggttcccacccaaatctcatatcaaactgtaatacccaatgttggaggaggggcccggtgggaggtgactggatcatagggtggacttcccccttgctgttgtcatgatagtgaatatgttctcatgaaatctcattgtttaaaagtgtgtagcaccttccccttcactctctctctctcctgctccaccatgtgaagacatgcctgcttacccttttgccttctgccatgactgaaggtttcctgaggcctccccagccatgctacctgtacagcctgcagaactgtgagccaattaaatctcttttctttataattacccagtctcaggtagttctttatagcaatgcgagaatggactaatatagtaaattggtaccgggagtggggacattactataaagatacctgaaaatgtggacgtgactttggaactgggtaaaaggcagaggttggaacagtttgaagggcttaaaggaagacaggaagatgagggaaagttgggaacttcctagagactttttaaatttttgtgaccaaaatgctgatagtgatacggacaatgaagtccaggctgaagtggtcttagatggaggaactttttgggaactgaagtaaaggtcacttgctatgcctgagcaaagagactgctgacattgggcccctgctctcgtgacctgtggatctgtgaatttgagagtgataaattagggtatctagcagaagaaatttctaagcagcaaggcattaaagatgtggcctggctgcttccaacagcatatggtcatatgtgtgagcaaaacgatgatctgaaacttgaacttatatttaaaagggaagcagagcaaaaagtttagaaactttgcagcctgaccatgcagtagaaaagagaaacccattttctagggaaaagttcaagccagctgcagaaatatacataagtaaagaggggccgaatgttaatagccaagacaacagggaaaatgcctcaaaggcatttcagagacctttgtggaagccccttccatcataggcctggaggcctaggagggaagaatggttttgcagaccagactcagggccctgttgccctgcacaacattgggacactgctccctgcatcccagccactccagttccaggtatggctaaaagggccccagatacatctcaggccactgttccagagggtgcaagccataaaccttggtggcttccacgtggtggtaagcttttgggtgttcagaaggcaagagctgaagcttgggagcctcaacctagatttcagaggatgtatggaaatgcctggatatacaggcagaagtgtgctgcaggggtggagccctcatggagaacctcaactagggcagtgcagaggagagtgtggcatttgaacccccatacagagttcccactagggcactgcctagtagagctgtgagaagaggtcactgttcttccaatcccagaatggtagatccactgacaagttccaccatgtgcctggaaaagccataggcactcaacatgagcctggaaaagcagccaagaggctgtaccgcgcagagccaaaggggcggagatgtccaaggccctgggattccaccccttgcatcagtgtggactggatgtgagacatggagttagagattattttggagctttaagatttaatgactgccctgctgggttttggatttgcccctttgttttggctgatttctgccttttggaatggggagtatttagccaatgcctgtaccatcactgtatcttagaagtaactgactgggtttgattttacaggctcataggtggaagtcacttgccttgtctcagatgagaatttgtactgtggacttttgagttaaagctggaatgagttaagactttggggactgttgggaaggcataattgtattttaaaatgtgagaaggacatgagatttgggaggggccagggatggaatgatatggtttggatttgtgtccccacccaaatcccatatcaaactgtaatccccagtgttggaggaaaggcctggtgagaggtgactggatcacgagggtggacttcccccttgctgttatcatgatagtgaatatgttctcatgagacctggttgtttaaaagtgtgtagcacctcccccttcactctcttcctctttctctggccatgtaagatgtgcctccttcctcttcaccttccaccatgattttaagttttctgaggcttcctcagccatgattcctgtacagcctgtggaactgtgagccaattaaacctcttttccttataaattacccggtctcaggtagttctttacagcaatgtgagaatggactaatacagctggatttcctttagggaagggcttattaaaacctgattttttctaagctaattggaactatactttctttcagaacaagggagagaccctttagaaaagggttaaaatcaggagtctgtagatccaggctgtttataaacttcctgacattttatataatatatcataattatgcatatcacaggaagttagagaaagattccttaagcttgattggatatacatggcgatcgtaacccccaaagtaagaactactattgtggacacttaacttacaacaaggtatgataaacacgtgaagaatgctcactgctattagtcatcagggaaatgcaaatcaaaaccacaaagaactaccacttacaaccactaggatggctataataaaaaaaagcagataataacaagtgttggtgaagatgtagagaaacggaaccctcctatattgctgataggaatgaaaaatggtgcatcactttggaaaacagtcttacattttcctcaaaagggcaaatatggagttaccaaatgacccagcaattccactactaagtttagacccaagagaaatgaaaatgccgttatacaaaaacttgtacatgaaagtacagagcagcactattcataatagtccaacagtagatataacccaaatgcttattaactgatgaatggatgaacaaaatgtggtatagacatataatggaatattatttgacaacaaaaggaaatgaaatactgatacatggatgaattttaaaaacactgtgctaattaaaagcagtcagatacaacaggccacatactatatgatttcatttatatgaaatgttcagaatagccaaattcatagagacaaaagtagatgagtggttgcctagggtttgtgggggaggagctggagggaaatggaggataattgctaatgggtaggggtttcttctggggtaatgaaaatgttctaaaatttatagtggtggttgcacaattttgtgaatattctaaaaatcattaaactgtacacttcaaatgggtgaattgtaggctgtgtgagttacattttgataaagctgttattaaaagaaaaaagaaaagaatatgtgagcctattctccatctaagtggcccactcctctaccccaggtggggagacaccaggaaggctttgggaagggaccaacaggggtgcatggaaaacatgagtttgatatgaaggaaaaatgctattgccttcagccatctcattctcacccttggatacagatccctcaaccagggaaggaataactgtctttaaatgcactgaagaggaggttcccatggagactggggaagttagcataagactatcttccatgatgatgaggaaagactgaatacactgtagcacaggcactcgcagacagacccctggccaggttactgtgggacaggtgcccaagtccatagaagagagaactgtaataaagcaagagggaaatacagtttctttcccaatcaggcagatccacggcaatgctgctttgaggcttcacgtgggcaaggaagacacactgggcagtgatacatggatttctgctagctgctaaagtggtcccatccactcaggtctctgatagtggtcctctggccacaactgtgccaaaataaaataatacatgctatggtaggaaattaatgacctcctaaaatgtctatgtcctaatctcgagaatctgaatatgccgtgtggcatggcagggaaaactggggctgcagaaggcactaaggtggctaaccagctgaccctgagaggagttatcctggattatctggaggatcccactgtaatcataagggtccttaaaatgaaaaggaaggtaggagagttagcaatagagtaatgcaatgcaagaaagattcaactgggcattgcaggggaaaaggggaccatgagccaggaaaggcaggcagccatgggaagtcggaaaaggcgaagaaattgattctctcctagagcttccagaaagcatggccacagtaggagtgaaatggaggcacagagaggggtatttgtctcaagcacacagctattaagtggaggggccactgggatttgaacttagatcaatagaccccagagcctgtgtgcttaactaaggaccctaaaagactattccagcctggtgagctgagttcctgtttgagaggagtctccgcagcctgagtctggggggttttcgcacctgtgggccatgggtgcccccggggaggtggacacgctgcaaggtggaggttgtgtgccacgtttccaggacaccatatggccccaccctggtccaggtgctgctggagcaggacctgtgctgtcactgctctctgacaccgctccactgtctcctccaaaggctcccaccctggtgggctctgcacccacagatttgatgaaactcacaggagtcaagcatcggagagtagtgactgggggttgtgtgtggggagattaaagacatttatatttttctttctcacgtaagatgaagactggcgtgaaagcacatttctattttcaaaagttaggtttggtaacacagtgcagagcagatggatgaggagaaaacgaagcaacaaaaaaaatgggcctcagccaggtgcggcggctcacacctgtaatcccagcactttgagaggccgaggtgggaggatcacttgagcacaagagtttgacaccagcctgggcaacatggcaaaaccctgtctccacacaacaaatgaatgaaatggtttgctgggcacacctgtggtcccagctactcaggaagctgaggcagcaggaggatcacttgggcccaggaggtggaggttgcagtgagccatgattgcctcactgcagtccagctgggagacagagcgagcctctgtctcaaaaaaaaaaaaaggccccctcacaaagcagtggggctggaaaagggagatgggaactagaggtgggggagatgggagccggtgatcagtgggatttggtgaccaactagctatggagaatgagggacagggaagagctaagacaactatgggccttccagctcaagggcagctgggcagaagttcaggactttaacttagaggcagagggaaagggaggatgctgagaagaaaacaaacatgccgaattagggcagacatgctcaaagggccaaccaaagtacatgtctgggattccggacagatccgggtccctcctctcttccccctttccatctgttaaaatcccttgtctcttctactgtataaaccaccctggtgtccccatcctcatgggcccccatggcactcacacccctacccagttaatgtcccctcctgtctgctcctgatgcagttttctccacgtcactagtgtagccaccttgttcccctcaaaggtgtgttttgagccccccactcagctgaaatgcccccggactcagtaaaggaacagaactgagtgtgttcaggaagttgacctaggggaggaggggatcggtgcagagtcagggaatggggaagagaaacaggtcagagggcttcagaaaacctgtgatgctactcatgatgaatatgcaggaaggaaggagagaggagaggagacagactcacagaaggtatgaggccatgaggaaatgcagacatgcacacatgcatacacatgtgattcctcaagctcccagcaggcttccagcatcaggagctaaaattgctaccactgataaatgaaaaatttaaactccccactgggaaggagcatttcaagtaccattcctggatatcgccccctccaattcttctgtccactgatacgctagcatagagcagatgtgatcatttgaagcttcaacaaagaatcccttgaagatgactgtgtatttttttttttcctaaatcaggaacaccagaattaagaggaaggtagccatgcaaaactcaacactgtttgtcaacgtgggtactaactcggctgtgtcttggataacacatcaacttggtaaaaacacacacagaaaagaaaacactttcttccaactgtcagagcaaaaatcctttactcttctgtccagcaacctgaacaaaaacaagggaatttgtggcttggtttcctttacaaccttatcttcactccaggcaccatcccctgtctctaagcaacagggcacactttggaactaccaggaggcaaaacccagtgcttatcctgagtcttttaggactaaacaaatcagggcagagcaattggtccctcgcaaggtagagcccaaggagcccatgggaaggtacgtggccccaaatatcttcatcaaaccccatgcataccctggcactcctctgagttccttagtgcctgaaattccacctctccacactcaacccattggcttattcccctgtcggctccatgggggcactgactcagtctatcaggtgacttctcccacatccccactcccaacaggaaagcccaacatggctctagtgtgaagaggaggctgacccttgagaacagggcacagagaaggaaatctagaacgtcactgagacttagtgatttttgtagaaaaatgaggagcctggaggaaagtgtttgattaaaagagaatgagggaaaatgcctgtattgctatgttgacatttaagaagactgtttgcacctgcaaacaggattcagagatttttttttttctcccatcagcatgccccaacctcttccctaacatctctgagacagaaagaatttctgagaatatagagaagagaaataaatgaacaaactctctgggaatgacagctctgaactttaataagagggagagaagagagctgatgagtacaaggctctgcagcagaaaggaaatggaatttggaagtggaaggagctgacaaacagtgctcataactgctgcatccaatagtcaggataactgctatttatctggtacctttatttctcaagcaggctcgtgtccatgaccttattttatcctcaaatcacctgtgaagcagagggtggagctggaattatttatctcctggtgaagccagtgatatcacaacttggagaagtcattcttacaatcacctacttggtgattttcaaaataagacaggaattatagattctgactcccaatgcttacttaccattgattctggaaaatgtggatggtctaaattgctatcgtaaaaatgcaatttcccaactttatttcatccatgagctttgagttcatttctaattaaattttttcagtagcccatcaacaaaacagatcagtttgagattcttctccttgttcattctctcttaaagagaattattaagaagaagcatccgaattcatttttgagccctcatttgatttccatttaccatctctgtgttgctgaagctgtggaagcaacagtctccatggctgagagtagagcttaagttacgcagatgggctgcaaagattaattgccattcttaaagacgccgatagaactatgaaaaataagtagtaatagtagtagtaggaagaagaggaggagaaggaggttggagaataggggaagttaccatgctctagtaaactgcaagatgttggcatatgacaaaccttggtacaagatataagacaaaatgaaatgggatcgagcgtataatccctgtggctactaactactgcattagtagacaaagcaacaattaggatgagccgtgaatgaggatgtggtgctgtcccttagggcaggtaatacccaaaacatgcagccatacacttgtctattctccaaagagctgaaccactgaagaaatggtggtctgaaatggcttggaagtctaggtgttattgggagcttggattcgtcacgagccccctaggggcttcacacacatactgattttgcagacttctaccccctcgaatattctgtggagaacaacctatttttttctatcctctcccaaaccgccatgctgagctcatcgcctctgaatttatctccgtgtcaaggagaagatgacagccaaaagtaatacattttgtttaagtcaagtcatgacacatctatgccaaatggagaactcagctggcaattaccacactgaaaagtgggacaaacaacagagcaaggaatagacctagaagtacatttaggtgtcatttcacccactgtatttaaccagagaaagaaaaagaaaatggaattttgatttcagaatccaaccttggttaatggttatttgcagaaaactagaaacattttaattattttcaactccacaccataacagctatcaagggaatggagacaaaacaaacagggacttattaaatacataattaatgtgcactaaaattcgcatatatgaatatgagtaagctgggaccattataaggtatgcaactgaaacgtgatcaattaattaaacctgttatttgctggggctttgggaaaaatggggccacctcaacagaggagggagactcatcagcagatgagatggctccttggtggtccatcctgcttgcaaagtagccaggtatttcaagaaacaaaaatcttagaaaagctacaattttctttacagtgaagcaaaaataaatcaagcccttgtcaatcaagaccttaatcaagaccattgtcaagctacaaatagattactttattccctcttgcctggtctccagtctccattataatcaaataaaaatacttttcaggcactgcatctggtttagaaatatagtctgtggccaggaaacaaaatgaagaaaactggcaacacaggaatgaaatcacttgtagcgattattaataaccgtcctcttttgaaatggattaaagtgcagtacaacaataggttataacatggaagaagaattcagatattcagatattcagaccttaagaatgcactttatccttatcacaaagcagcaaatgaagtgctgtgcttcctagcagccaaagaataaaaaaaggtctacacgatcaatgtctgtcattcccacagggaggcaaagcttttccaggcagtgtattctaaaagttttatctagaggcattgggggatgaacaggacaatggctctagcagaaagctgacaataaagactccagtgattttcatctgacggttaacatcctttctttcaaacctgagttaagtcacaggaggctgttctgtgagaggggctaagctgacatagaccaatgatgttggcttgggctggggtgaggagaggttgtctactggcagataacacataacaccagaggacaagatgatgagctactatttcagcccttgtgcagctccttccatcccccgacatcagacatcatgatgctctcgagcctgctacacaagtcccggcacaactcgcaacccacttcagtccccaactcaggaaataagaaaaaaactcagaaccaacaggagcaagagaatggtatcacaggatgactctgcagcatcctgaatttatcagaaacaatgtgaaaaggctgacatttaaattattttattcacaatatatgtaggacataccccatgactgagaacagctctcttacactgtcttccagaaatggaactcctcccaaggcaagcttgggtaggcactacacaacaaacaatttgtgaagttacttttttttgctaagggtctagtgcagtgtcatccagtagaacttcctgtgatcatggaagcgttctacatcttgtgttgtccaacacagtagccactagatacaagtatttgatgtgtggctaagtcatgctaaggagctaaagtttgcattttattccagtttaactcatgtaaatttagagaactacaggtggccagggactatggaattggacacagcaagtctaaaagatcttactaggctgggcacggtggctcacgcctataatcccagcactttgggaagctgaggcgggtggatcacctgaggtcatgagtttgagaccagcctggccaatatggtgaaaccccatctctacctaaaatacaaaaattacctgcgcatggtgacacacgcctgtaattccagctattgaggaagctaaggcaggagaataggttgaacctgggaggcggaggttgcagtgagctgagattgcgccactgcactccagcctgggccacagagtgagactccaactccataaacaaaacaataaaataaaataaaataaaataaaataaaagattgtattaaaccatgttctagccaatacctggccatgggagaaagacaactggaagttattggaaactttgcttcctaatacaaaaatgtattcaaattctcttgctttagttttctctttaatttacataataggtaggaggatggcataatacaatcgacgtggaaatgagtcttgattttaaccccaatcctagcgcagcattagactttcactctggctgtagcttccttgatctgaaggccagaaagtagggctcaggcatctgcgcgtctgtcgcctgtgcaggagatgacagaatgtctaaaagtttccctgccacttttatttgggatcacggaggattcccagagttgtgattttgccctctgggcgttggtgccaactctcatgctcaaatccaacagcgtcatttagaagtgtgctaccggcttctgcctcagtgcacaccaggaacatgatatgttgagcaaaatgtcatcccatgtaggagcctgtgctaattataatgtcaggcttcccactgagatactgataattaaaggagaatattacaatgttttcaaactcctgcagtaaatgagaagcatcttcaaatgtaacctgttggagatgaaaattaaagccatctgtgacgtccccatttaagacctccacaaccagaaccagacaatttttgaggatcaaagcaagttgaaggcaaaagtaggtgggtggtagagtttgggggaagaggaggaggtggaggggaattaatgttttccaggtcctgctgtgttctaggaaccacaatactctttatttttttattgagacaggtcttgctctgtcacccaggctggagtgcagtggcacaagcacggctcactgcagcctctacctcctgggctcaagtgattctcctgcctcagcctcctgagtagttgggactataggcatgtgccaccacgcccagctaatttttgtattttttgtagagacggggttctgccacgttgcccaggctggtcttgaactcctgagttcaagtgatctgcatgcctcggcctcccaacgatacactctgaatagcagataacacagtgggtggccctgcttgttgctactgctgtcgtctcaataatgaactgccaagtagctattatctgcattttacagctgggaaagctaagactctcatgatctcacctaaggttacctacctagtaaagcatttggtggctccaggatccaagtcttggcctttctgctctaaaggttgtgcttgtcctatgcctgtgggcgaccacctgcttgggtcctggagcatcagtggtggtgataggtgtgcaggggcctcacaggcattcattttacacatctcctagagcacccacagtggtgggccctgtgtacggtgaggcttcctgcccaggtttccctgcccaagtctccttgctgaactgagcccgatgcatctggagtgagaactacgccaacgtggtgctgcagacattaacatttaatgtggcaagcttaagaaaagcaagaagcatttcctgaacttctctgtaactctctctgaaaaacagtgtgatccacgggaagaaaagaaacacagagctcaccagtgagacacaacacacggagacagagtgtgagttaagctgtacccatcattgcttgtgtggcctcgggcttttttttttttgagacagggtctcgctctgttacccaggctggagtgcagcggcacgatctcagttttctgcagcctccacatcccaggctcaagcgattctcctgcctcagcctcccgagtagctgtgactgcaatcacgcgccaccataccccactaatttttgtattttttgtagagatggggtttccccacgttgcccaggctggtcttgaactcccaggttcaagcgattcacctgcttcggcctcctaaagtgctgaaattacaggtgtgagccaccgtgcctggtcttgggcttgatctttaaactttctaggtctcagtttctaaaatgtaaaacagggacgcaaatatctaaatcatgtatgtggtgcactttatacagcgtctggaaccttgaaaggcccccgtaagtggcagcctttagcattattggtatattttattatggtcaatgatgcatgcctttgtgtggtgttctgcttcctcattaactgagcctgagtcgccggctactgagaaggcccctccagtttctggaagcagagcaatgtgaagcagaagctgttgcatcacggtttctcctggaaaggtctgtacctaacagtagaattttctgctcagtctttaccccaggaaaatgaaaaatcaacatgttctttctcatggctagtagctcctttcttgcaagtcggggccctggtctcgcactgctgcccctccaaagccaccctttgcagcacggggagactgcacaagggcaagctgaaggtccaggctcacatcaccaatgtcagcagcagcagcctccctggccacctgcagctgtccgcagacttttcagcattccaacagatcctccatattccacacaaaatcaaaatccacagcaactgccacctcgttggaaagcagggctcaaaaaacaactttatttttctcctgtctattgacttggaggaaaattcactagattttttaaaaatgtactataaaaatgtatattgctcaaaaaaaaaaaaaaaaaaaaaagcaggactcatagacaccccaagcaagtgccatggtaggtgggacagagattatccctttgtgtcaaaggactctgctggatggaatgaatgggaaggaacttaacaaaaagaactggcttcaaagagttcaaaggtttccatatgacccagcaattctactccaaggtatgtacccaagagaacacaggtccatacaaagacataaacacacatagcagcattacttacaacacccaaaaaagtaaaaacaatccaaatgtccatcaagtgatgaaacagtaaacaaaacacggtgtatccatagaatagagtattatctggccagaaaaagaaagacttactgatacatgctacaacatcaacgaaacttggaagcatcatgccaagtgaaagaaaccagacacaaaaacatacatattacatgataccgtttaaatgaaagtcagtcccggttagggaaactgtagagacaaagtagattagtgcaggggctggagggagggaggaatggggagtgactgctaataagcatgcagtttctttttttcctcagaggtactgctcaaagagtgtggggtttctttacagggtgatgagagtattcaggaatagtggtaggttgggtacagtggcttacacctataatctcagcactatgggaggctgaagcaggaggttctcttgaggccagcagttcgaggccaccctggccaacacagcaacacccttgtctctactggaagaaaaaaattaaaattaaaaattaaaaagatagtgatggtggttgcacaacctttcagatatactaaaaccactgaattgtgaaatttatttttctttccttttctttttttttttttttgagacaaggtcttgctctgtcaccttggctggagtgcagtggcacaaccacggctcactgcagccttgacctccagggttcaagcaatcctcccaccctagccttccaagtagctgggaccacaagcgtgcaccaccacacctggctagttttttaatttttcgtagagatgggggtctcgtcatgttgcccaggatggtctccaacttctgggctcaagcgatccacccacctcagtctcccaaaatgctgggattacaggcatgagccactgtgcctggccttgaattgtgaactttaaaagggtgaattttatggtatgtgaatcatatcacattcttttaaaaaagttaacagggactctttcctcagtgtggaagtgtaattgacagacctcctaactaccagtgagcgtggggatgagaaaatgccacacaataaagttgcttgagaaagagagagattgagcgacagatcatgtgtgagatggagtagggtcagtaaccatttaaatatgccactgaccttgagaaaaagaatgtcagctataatcacaagccacaaacgtctgtcactgtgaattggctcatcacgaagaactgagggataacatggagttatgatagcagtggaggcaggcaggggaaaagggcccatgagatatggatggcagcactctcccccattccctgccatccccactgcacatgtataagctaagtaaatattacgtcgtcttttactaacaccccaaaactctcacttgatgaaggaccaggggagtaagttgctgaatgggctcattaagacttaggaattctttagaggctcaaacacagaaagccagtgatgggaaataaggatgacacagctgatagcccatgggagtcccagggtgagactaagactccataagagccaggcttagacttataaaggaatgctggctgctgaagacatttcagaactcaagctaagaatctctggcctgcattcagaagatacctttggtctctgtggttggccaaatgatggctccaaatatatccaggtcctcattcctgaaacctgtgaatgttacctttcatgacaaaggagatttttcagatatgattatcctggataatctgggtggtccctcaatgcaaccacaagaatctttataaaaaggcagagggagatttggcacagaagagaaagcagtgatcctggaggtactgattggagtgatgtggccacaagccaaggaatgcctgcagcctgcagaagctggaagaggccaggaatggattatcccctagagcccccggcaagaacacggcccttccaaccccttgactttatcacagtgaaactgatgtcagacttctggcctccagaactgcaggagaataaatctggattgttttaagccactaagtttgtgataattggttacaccagccaaagaaaaccaaggcagtccttcattctgcttctaacttgtctaaatattaaaacatccccagtaagatgatctctagcataaaggaataacatctctctacttctgtgcataagttgagggttgaggtgttgaagtggttaggtgatggtaactccttgatgaactgagtctgatgcagctggagtgagaaccacgccaacgtggtgctgcagacattaacgtttaatgtggcaagcttaaaaaaggcaagaatttcacctttccaaaaaagcatttttatctgatcgcaagtcataaatatttactacaggaaagcttagttataaatctcacaaaaacaggaagaaaataaaagtcatctgcaatcctatcacccaggaataaccaaccactgtgaacattttcatgtctaaatttgggttcctgttccctgaaacaaaaaatcactttggattaaaatcccaagcatttctttgaaagccattatcaggagctggcaatgaggacaggccacatgaccaaaaccaactgttgtgtggttctagcaacacaaacagtggtccccaggcctctatgtcatagcaacaaccagcaaaacaaacttggctcttgatactattgagaggaaaataaaaagcatggaattcacctaccctcttctctggacctttaaaataatttcaaacacaaaaggcagcaagagtctgccaatgtatcatcaggacccacatgagtcaatgtcctcccttggcccacctggacaatgtagaaagaaaattaggcggctgggagtggtggctcacacctgtaatcccagcactctgggaagccaaggtgggcggatcacctgaggtcaggagtttgagaccagcctggccaacatggcaaaaccccgcctctactaaaagtacaaaaattagatgggcgtggtggtgggtgcctgtaatcccagctactcaggaggctgaggcaggagaagcttgaacctaggaggcggaggttgcagtgagctgagatcgcgccactgcactctaccctgggtgacaagagcgagactccatctcaaaaagaaagaaaattggctgggtgcagtggctcatgcccgtaatcctagcactctgggaggccgaggcaggcagatcacaaggtcaggagatcaggaccatcctggctaacacggtgaaaccccgtctctactaaaaatacaaaaaattagccaggcgtggtggggggcgcctgtagtcccagctactggcgaggctgaggcaggagaatggtgtgaacctgggagacggagcttgcagtgagctgagatggcgccactgcactccagcctgagtgacagagcaagactccgtctcaaaaaataaaaaataaaaaattaggacacctaactctcaaacagcccctcctctcttagaatggagggcaggtacccaatgcaccagttcttctaggtgctcaagtatataatacatattgaatacatcaaagcttcagtatgtgttataacattgggccccccaaaaagaacgcagtatagaacttcttgcaagaagctccatctatcaggggcaaataaacatgtttaaatacaggtaattgcatccatcaagagttgaatgaataaagaaaatatggtacatacacacaatggcgtattattcagccacataaatgaatgagatccggtcatttgcaacaacatggatggaactggaggttattatgtgaagtgaactaagccaggcatggaaagacaaacttctcatgttctcacttatttgtgggagctaaaaattaaaacaattgaactcatggagatagagaggagaaggatgtttaccagaggctgggaagggcagtcggggagtcgggggaaagtagtgatggttaataggtacaaaaaaaaatagatgagtcagacctagtagttgacagcacaacagggtggctatagtcaataatataataattgtacattttaaaataactacaagtataactggattgttggtaacacagaggataaatgcttaagttgatgggttatgcattacatacctgtatcaaaatatttcatgcaggccaggcgaggtggctcacacctgtaatcctagcactttgggaggctaaggcgggagaatctattgagcccaggagttcgagactagcctaggcaacatggcaaaaccctgtctctacaaaaaatacaaaaaaaaaaagaaattagctgggtgtggtggtatgcacctgtagtcccagctactcaggaggctgaggtgggaggatcaactgagcccaaggttgaggccgcagtgagccatgatcacaccactgcactccagcctgagtgacagagagagatcttgtctcaaaaaactatgtgtgtgtgtgtgtgtgtgtgtgcacgcacgcgcatatgtatttcatggccccataaatatacatacctatgttactgacaaaaattaaaaataaataaataaataaaacacacaaacaggtaattgtaagtcagagtgataattatggtaacagaagataaaggatacagcaagacagcacaaaggaaggagtgattaactttgttaaataaatgaaattaataataaatatttctatgattcttcacagttatcatccaatgctaaggctagaaggagccataacaataatttaccacaatcccctaaattttcaaatgaatgaatgtttgaatgagataacccctagaatctctttaagcttccaatttaactttctcccatacaaagcaatggtgcagttcactgttgagaccataaggtactcatgataagtgattagtaggaactcaattgctaggtgatttttaatgccattcaaaaacagaagggccaggaatctttggaaggctcagagcccttcaatctgtatgatactgcatggacagcacttcaagagacagtatgctcaaaaggctgcagtctcgggttggttttctaaaaaaccatgttgtttcctcagggtgtccttctgcagcagacacaaacaccctagaccacccccacagatgcacccaggcaggcgccacggaagtagcttagaaggaggcgggtggtgtctgcactctgtttctggagtctgccttttagtgctctttttactgcgcctgcctgcatctgctggtctgcatcagtcattaccatttcttcctaagacatttcaattgcacaactatacttttctttgtcctctaaaggggagggttttttgcttatttgtttttttctgagatggagtcttgctctgcctccaggctggagtgccatggtgcgatctcggctcactgcaacctctgcctcctgggttcaagtgatcctcctgcctcagcctcccaagtagctgggattacaggcacgtgccaccacgcccagctaatttttatatttttagtagagacggggtgtcatcatgttggccaggatggtttctatctcctgacctcgtgatctgcctgcctcagcctcccgaagtgctgggattacaggccgtgagccaccgcgcccggcctggggaggggttctttcctgttctagggttgtggatagactccataaagtctaaacacccagaattgtctgcaaaatattgtgtgtggctgtggtctcaaggtttatgtctccccagaattcatatttggaaacctaatccccaatggtattgttattaggatggtggggacttagggaatgaatggtattaggaggtggggacttggggaagtgattaggtcgtgagatggagctcttatgaatgggattaacaacctcatgaaatgagactccagagagtgccctctttccaccatgtgaggatacaacgagaagacagtcacctgcaacccggagaaggaccctcaccagaacctgaccacgaccatgctggcagcccgatctcaggcttccagcttccagaactgcgagaaataaatttctgttgtttctaagctacccattgtatggcattttgtaatggcagcctgaacagactaagacatgtgtacaacatcctcttgtgagatggtgtatagctcttatcagattcacaggacaactgtgaaccacagaagcttaagaactatttgaccttgcacatgtgtattaaatattaacccaagagccccagacgtgtgcatatgccttcgggtgtggcctcacactctggatacctccgggagataggctactattaacaagccttccattttccttctactccaaaaaaaaattttttttagcaaaatgtcatcctcaggacatactaaactgaaatagcaaagacaaaaaacttcaaaaaaaaaaatcgattctccatttagtcattgtgaaaagtctgtcttaaaaacccagagtctcagggaatgtcaaagctctagttaaatttttaatacactataaaggatagtgttaaagaagagaccttttcaaaggtaagttggctccaaacaggctcttaaaatggtcctcatcaaagacatgaagctgcttgacagtgatggtgagggagttcacttctctttagacaggattaggagctgaagacttgaggaatgagccacagtgggtctttggagacacatctatttgtagttagacccttggtggcttcatccagtgtcaggggtttaagtaacattcatgtgccaagggaccaggcgcagtggctcacgcctgtaatcccagcactttgggaggccaaggcaggtggatcagttgagtccaggagttcaagaccagcctgaccaatatggcaaaatcttgcctcaaccaaaaatacaaaaagtagccaggtgtcgtggcatgcgcctgtagtcccaaccacttgagaggccgaggcaggagaacctcttgaacccaggaggtggaggttgcagtgagccaaaattgcgccactgcactccagcctgggcatcagggcagactctgtctcaaaaacaaaaaacaaaaaaacaaaaaacattcatgggccaatgattcagaaatctataactctagctagactttgcaagccaactccaaactcatgtatccagctgtctagtcagtatctccatttgaatgtctaatggcaatcaaacctcacaatcaaaaaacaaattcctgatagtccccctaaagcccctggagctgcagccttcctcgtctcagttgatggcaattccatccctgcagctgggcagccctgaaacctccgggtccctcctggctcctcgctttctctcatatcccacatccaatccatcggcaaatcccattggctccaccttcaatcgggacccaggaagggatcccttctcaccacatccagcacgaccaccttggtctgcaccactatcatctttgatctggattctgcagtggcctctacataggcctccctgcttccatccttacctctcctaagtcccatctcaattcagtatctaaagagaaacaaactttcaaagctcaagtcaagtcatacacaccctcttcaaaactctgcaatggctcatcacacacagagcaaaaacaaacattcttatgcctccaagttccatctaaaggaggggctgacatccctgccctcaccttgtacttctctccctgctgctcaccctgctgtggccacagtggactcttggctactccttgtgggggccagacatgctcctgcctcagggcctttgcactggctgttccctctgcctaaaacactcactgtttcccagagatctgcatgactgactcaaattcaaggacatctcaaggagcccctccctacctactctatttaaaatggcaatttcttcctctaacactctaccgtctcctctgccctgttgaactttttctttttttaaatcactaaccaccttctaacacaatataaaattcatttattatgatgatgttcatcgactatctcaccttgctataatattggttatagaaggccagagatcttggtctgttttagtactgatataacccaagtacatggaatacaatactcaaatataataaataaaagacaagactgggaaagaaatgtcccttcaaacctctccatccagtcaagccagctgtcctccagtttactgaaaccagtgactattaccaccatgcttctggtgaaatctaactcaattgagattcctggaaggcactcaatcctcatttcaatttattttttattttactattatttttgagacggagtctcgctgtgtcacccaggatggagtgtggagataagagaatccatctttcaaaccaatgaatctctctctctctctctctttttttttttttttttttttttttttttgagacagagccttgctttgtcgcccaggctgcagtgcagtagcatgatcttggctcactgcaacctctgcctcctgggttcaagtgattctcctgcctcagcctcccaagtagctgggattacaggcatgtgccaccactcccagctaatttttgtatttttagtagagacggggtttcgccatgttggccaggctggtctcaaactcctgacctcaagtgatccgcccaccttggcttcccaaagtgctgggattacaggcatgagccactgcacctggcctcaatccttatttgaaaaaatacttttgcatcaccatagaagtgacaaaggctgaacttagacttggaaactccaaagacacagaatagggtctcctgtcagggaagaagtaagattttaatttatgctcatttaagatcatcaaatattgctgtcattccacacatcttcctcctgtttctggctttattccaagttgtcactggagtcaacaaacatttgagaaagtaaactctgaaccatcctggccttccattgggatgagccaggaaataattccagctgagcataatgaatcacccaagtacagtggcaggtgtggtatataaaagggtccattagaggaaagttggatactcattccattgctataaagtctggaccttagaccacatttttgttcttcagagaaatagttgccgtaatacacctcagtgtagttaccttatttaacactaaacccactgggcagatctttactcttcctcaattggctaaagaaggggtcataaatggcagaaagacagctactattatgaatgaaaaacaagtaacctctcttctctaactattagcacttaacaggctacaagttgctgtcagggctcctaagtagtcctctgcaggggaccaaggggtctttcaatgacctctttaagatacggggtgggcacgagcagggtcttccaccaaggctaacccactttggccatctttgtgcagtgaggtccatataagaccccatctttatctcaagacatactgaataccaagatctagaaaaccaacagggtcagatgctgtggctcatgcccgtaatcccagcactttgagaggctgaggtgggctaatcacttgaggccgggagtttaagaccagcctggccaacatggtgaaaccccgtctcttcgaaaaatacaaaaattagctgggcatgatggcacacatctttaatcccagctactcgggaggccgagacaggagaattgcttgaaccgggaagtggagattgaagtgagctgagactgcaccactgcactccagcctgggcgacagagcgagactctgtctcataaaaaaaaaaaaaaaaaaaattggaaaaccaactaaaaaaagcttattcataactcaaagaaaagggtcaagaggggaatgagggagacacataaactgatgaaaatgttgggaaaactggcctacctatgatcgtatgatagacattcctaagattaggatagaaataacagaggaatgtgcttcttatctagagaaatatctgagcttaaaaagtaattaaacacatagtgctttcggcagatttaatatatactagaatatataatatgtattagaattttcacactttaaagacgacaaaaaaaagtcttcattgtgcaagcaaaacaatatcaagttatacagaggaacagactcactttggccatgctttttgcttccacaatactaaagccagaagacaagggatcaacatctgcagaagctttgtagagaaaaatgtcatgactagaaagctttgcccagccaagttcttgctcctgtattagagtaacagattggcaccatgaactctgcaaggactcagaaaatgtatcacccaaggatgctccctggggaagattattgctcaaactcgaattcccaaacaacaaaaggtgggtcagcatgtttaagatctcaagatcgaggaaatcatggctgaaaaggcagcaggagtatcatcgatgccaacaatgcgctcgtaagtcccaagcactgtactgaaagctgtatgtatatttagcatctcatttaattctctaagtaagccacttgtggcattatccccatttcttagatgagaaaaccaaggttcagggagttcaagcaattcgtcaagataacctccttaggaagtgagagagttggaatttcaaaatgcatcccaaattgctcaggttccctcagtttatttatttttaaaaatatctttatcatttcctatgcttaatcatgttttctagttgctctaaaagaaacattcattgtttttgaaataaggcattaatatgtccttttttccaattaaaatacatctaaagacataaaacaggccagcgtggtagctcacgcctgtagtcccaacactttgaggggccgaggcaggtggatgacctgaggtcaggagttcaagaccagcctggccaacatggtgaaaccccatctctactaaaaatacaaaaaattagcaaggcatggtggtgcacacctgtaatcccagctactcaagaggctgtggcaggagaatcacttgaacccaggaggcagaggctgcagtaagccaagatcgctccactgcactccagcctgggggacagagcaagactctgtcttaaaaaaaaaaaaagacataaaagaaattactctaaaatgctaaataggaaaggattggtaagaacatttcagaaagatgcccacataaagaaggcaggtaaggcaattatcagtgccaaattatactgaactcaatagacttgaccctcgaacaatgcagacgttaggaatgctggttccctgcgcagtagaaaatctgcagagagtttttggcttccccaaaacttaactatgaataacctgctgttgaccagaagtcttaccaataacatagtcaattagtacatatagtgtatgttatatgtattataaactgtattcttacaatatagcaatctcaagaaaaaatgttattaaggaattcataagataacatatatttactattcattaagtggaagtgagtcatcataaaggtctcatcctcatcctcttcacattgagtcagctgaggaagaggaggggttggtcttgctctctcagggggcagaggcggaagaaaatctgagtgtaagtgaactcacgtagttcagatctgtgttgttcaagggtcaactatgttttcaaatagcattaagcagaaccagagatacccagtatttataaaagataccctccacagcaatcatgtaacagttatgaatttatgctccaaataacttggtaacaaatatgtaaacaaaaaggaagtagaagttgtttaaactaaccggaatgggaagttttcacatatgatgatctatctatgacgatcaaaaaataaagccaagaaagatttgtactgccaccttcactcctctccaaaaaggacccacgtcacaattgccccttccccttttccagccagacaactgtgctgacaaatgactttaccttcaggcagtggctgtcacgctcacgggcaagacctcacctggaacgttgtgtatagtgatggccaagatgagcagtgcgatcctcctccagctgctgccgccgggctgtgccagattccctcgagaaggcacagggacagcaggaccctctggaaggccagtggctgccgccttctttctctgatatgcctcaccattctcactcttgtctgagcaaaaaaaaaaaaaaagagagatggggaaagacagcgctttgaacatgtgcacgttaactctccagcaagctacagcaggaagaagcttctttttcttttttgagacagggtcttactctgtcacccagcctggagggcaatggtgtgatcacaactcactgcagccccaacttcccgggctcaagccatcctcccatctcagcctcccaagtagctgggactgccatcttcactcctctccaaaaaggacccacgtcacaattgcccattccaaacttcctgtagactatgcatgcttctgtgtgttctctcattcactcaggcatccattcattcagcgaacaattcattgactaggctgagcatggtcactcacgcctgaaatcccaacacttcgggaggctgaggcaggcagatggcttgagcccaggagttcgagaccagcctgggcaacatggcacaatcccatctctacaaaaaataaaaataaagaattagctaggcgtggtggtatgcacctgcagtcccagctacttgggaggctgagatgggaggatggcttgagcccgggaagttgaggctgcagtgagttgtgatcacaccattggcctccagcctgggtgacagagtaagaccctgtctcaaaaaagaaaaagaaaaaaaaaatcactgaacaggcattcagtgcccaatgcataggtaccaagaaggataaaaaagatgaagatgtggtatcctagcaatgcctgtttaagacaagcaatgttgagtcatgattagagacacagatgccagaaccatgctgcctgcttcccttcctgactcagccactggccagctgtgtagtgccaaataagttgtttcacctctctgtgcagtggttttctgattcgtaaaactagaataatagcattacctatgtcacaagcgttttgtgaggattaaatgcaacaatgtctgaaagtacttagaatgtactaagtgctgattgtattgatggttattgttagtatcatgttccctctcccatagccgtacagaattacataatatgtgaccctgctctcctggtcacactgatttatgggaaccaattcagacgcctggctcagccaatcagaatccctctccagggagaattggccactccaacgtgcaagctaaatctgaaaaatcacgtgatgcgcgagcagctctgccacaatggaacgagggaagcggctggacagacaatcagaaggaatcagatatacatcaacaagcagagatgggaaaccatgcagctagacaggagagagaagggcagaactgcagcccacgtgccacagacattcatgggccatccgtagcacccagcccttgggttttctgagcaaaccttccttttaaaaatgcctttacaaattggcttatattggaagaatgtcattcttagaaccttattctaaatatccatggtcccctgggctatttgtttattcataatggagccaaattgtgtggatttgaaattgggaggacaagagtgggagagagcatccagctttcagttcacagcatgggatggatttgtggggaaggctttctagaggagataggtcttgagtgaatcttaaacacgtgatggcacagacagaatgaagggtccctttattgggagagaaaacccagcaagcataactcaggtgtctgttaaattaaataagcaaaaggccattggtctgaggctgtactttgagttgcttcgcagtgaactacaacctaacttagtatgtatacaaatgaaaatctcattaggagtatatattttttgtaataggatagctagatctcagtcaatcacaagcggctgagcttcaaccaatcacaggcagccaagcttcagccaaccagaggcagccaactgatcagactaagtccaaataaggtaaatgcctaactgtaaccaattaagctatttctatactttatttcctgcttgaatttcaaaaaacacggagctctctgaatgtcttctagttttgaatgctgcctaattcacgaagcctttaatgcttaaataaatttaaaaacattagaagaaaaaaacttcttttgaaaatcattttgtggccaggcgcagtagctcacacctgtaatcccagcactttgggaggccgaggcaggcggatcatgaggtcaggagattgagaccatcctggctaacacggtgaaaccctatctctactaaaaatacaaaaattaactgggcgtggtggcaggcgcctgtagtcccagctattcgggaggctgagtgaggcaggagaatggcttgaacccaggaggcggagcttgcagtgacccgagatcccgcggctgcactccagcctgggcaacagagcaagactccgtctcaaaaaaaaaaaaaaaaaaaaaaaacagaaagaaagaaagaaaatcattttgtatttatttgctcaaatcctacaagtacagattgaaaagtaagaaagtacagggcaggtagactcactcctccccagctcccaatcatttctctcttactaacagctgaatctcagttccattaggaaaaggggggtctttggtcctccacaacgcaaggatgccagtcctccactggtcagtagccctgactcacataaccagcctgtggagaattcagctgtctcaattggatagcaactcctcccagacagtatttacacaaggcgaagctccacactcattgtgtggtatccacaccatgtgtatgcatgtacgtgtgtgtgtgcatgtgtgcatgtgtatgtgcgtgtgggtgcatacaactgctactcagtaccatcctgagatattagatcaccttcgtgtatgtatgcacatgtgtgcacttctgtgcacacattgggggaaggggttttatacattttgagtagacaatatgtagatgactcaggctgcagatgctggttgagaaactgaactaaacatctgggatttcaagctcacaaatgctaaagacataagcaaagcagtccctgagagctgtccatgaactaacctgggtcatggtggagggtcctcagctttctcctagatcagtcagcaaacattcctgatttcctgtgcctggtctgagcatacaggcctgcactagatgctctccagtgagagttgataggggccaaaagaaaaatctcttctcttgcagacttttgattgattgattgattgattgattaagcagggtcccactctgttgcccaggctagagtgcagtggcacaatctcagctcactgcagcctccacctcccaggctcaagcaatcctcccacctcggcctcccaagtagctggaactataggtgcacgccaccatggccagctaacttttgtatttttttttttttttttcagtagagacagggttttgctgcattgaccagtctggtcttgaattcctggactcaagcgatccacctgccttggcctccaaaagtgctaggattataggtatgagccactgcaccttgccccttggggattttataatttaagagagggcagacagagaagacacacacaaattccctcaaatctaaggggctaaacacacactctaacaatcaccgacagttgcgcttgtttttgccaatgtcacaaaaggatcctactctgaatctcctgcagataccgcacagagagcaacagacctcggacgcaccacgagcaaattctagcgttctgcttgtgttttataggaacatcaaggagcataaagaattcttcaccaaaataaaaatgcacgcctggccccaggcttccaatgtgtgaaaactgacgtcagtgccttccctagtaggaaacaggagggtgtgaatgcctcacgtccttgtgaaagttaaataagccaccatttggtgacagccactaatgagtctgcaacaaggaagattagtccaaataaatcattacagagtatgatgcgtcgtgagcaatgaatcttcttgccgctcctggtaaggctagttcaaccatcacacccatcaagtaaaatgctagtgcgtgggaaaaggatgatcagttagcggaggcaattgccaagcaccttgtgggatgtgagggtgtgccagagtgacaagaacctcgtgaggtttcttgaaattggaaaggtttgggcacttttgaagtggagtttgggaaggaggagtagaggggggactatttcatttagggatgaaatagtcaatgtcaaactcagaagcaaaacaacatcagagacactggttaataggtaatattgggaacttatcttcaatgagtcctcaatccttacaaaagccccatgaagtagagattaatcccctttaacgaatgagtaaattgaagaacagagaggcagagtaactggtcccaggtcacacagccagtctgcagtggactcaggagtcgactcagcatctttgcctccaggagcccctcttttaactagggcctcatggttgactggggatgaagtggggggtggggtgggggtggagaaaaggctgaactgctcattgcttgccaaaaaaggtagtgggagcagttgctgccgtgagaaggagagtctggtgagctctcattgcctgtgaccagagtggggaaagactcaggagaaatctcgtatctataatcattcttacttgcagacaaacctgaaacatttcatgatagtagtatgtgttaacccattagacctactatttctaagcataaagtaattgcaagcagaaaatatttacccatgctaagcccacaacacaggcttatacttcttttgggaaggagaatgaagattctttgttgttaggaaaaaaaagttgcccatcattaaaattttgttttttaacttataattgagcatctaagaattcacacaaagaaaggacccactgccagggctcagcctctcatccttcccactccatctttcctggaaaagaaccacagtgctacatgaaagggtgaggacgacaataaaacagacagaaaagtcccaggctcacttttcccacggaatcaccaggtgatcttttctgatgcatccgcttccctgatttcctcttccccaaaacaaaggacatgattgtggccacaaaacatcataggatggagaaaagcagacacgggtcttgcgggcacaagcccaggggccatcagcaaaccctgctgcccaggtaagcccctgcccttcaaggtctggcttcctccctgcagagtggaagtctctgaagtcctctagtgaatggccccaaaccattttggatcagcaaccgcctttgaaagtacggcgaaagttacaatccagcaaaaaatacacagaccattttgaaataattgtcgggtccttatggattcaagaacgtcagactgagaacatcttgctagataaatgccaagttaacctccgttttcatagcccacgggcccaatcacaccagcaacacagaatgtatgtggtccctgagatggtgtaaccggctaaatctaatgggcccaatgatggaattgcaggcccccgatgaatatggcaatgctaattaacagaacactagccaagagagctttaacaacattcccatggtattattggagatgatttggttggattagcacaaatggcaaatcgtcatctgttaagtgcagaaagcatcaaatccctggaaaaactctttctaaacccctgttacaaaacaaaatgaagagtggccagcaacatatattcattaagtagtatgtatacacaaacaaaaccaaaggccaatcaaaagcagaatagaggccgggtgcggtggctcacgcctgtaatcacagcactttgggaggccgaggtgggcagatcacaaggtcagaagatcgagaccatcctggctaacacagtgaaaccccgtctctactaaaaaatacaaaaaattagccaggcgtggtggcgggcacctgtagtcctagctacttgggaggctgaggcaggagaatggcgtgaacccgggaggcggagcttgcagtgagccaagatggcgccactgcactccagcctgggcgacaaagcgagaatccgtctcaaaaaaaaaaaaagcagaatagaaggggatcaacttatattgtccctgccttcttgtttcccaaagaatcagtctagtttcaggtaacacaaattattatttacattctcatatgatgggaacttttggctatttctagactttttttcttataaatatcactgtaaaacctttaatgtatataaacaatcagaaattggacaaagttcccagaagttgaactgttgatcaaagggccatgatacaattccctaataaatttccaggaaggctgtgtcacttacccatgaacagagtttgcaagttctcattatgccgcttcttagccctggtatttctcatcttgaaataagtatatttatttatggggcaaatgacatttctcttaatgggtatttctttgactacaagtgaggtggaacatttttcaatttcaggcatatttctttcctcttttgaaagatgcctgctgcccaaatgaggcctctttaaataacagtaatatgattagctaattatttacagacactggtaattttcctgtgatccgcttaggtttgtcaatgagacctagctgggagtagcaggtattattatacatcagacagacgtatccacttggccaagttggagttttagcctcaaattttaaaattcctttttgagattcctcaagacattatagggctttaaaaaaaagtattacctgctttccttatggaactatgtagtatgatcctgaaagctaattttctcaggcaattgtctctttcaatattaaaactttttttttttcttttttgagatagattcttgctctgtcacccaggctggaatgcagtggcgcaatctcggttcactgtaacacccgcctcccaggttcaagcagttctcctgcttcggcctccagagtagctgggactacagacatgcaccaccccacccggctaatttttgtatttttagtagagatggggtttcaccatgttggccaggctggtcttgaactcctgacctcaggtgatccacctgccttggcctcccaaagtgctgggattacaggcgtaagccaccacattcttttttaaaaaactttcactttaggttcagggctacatgtgcaggtttgttatacaggtaaactcatgtcacgggggtttgttgtacaaattattttgtcacctaggtactaagcctagtacccaatagttactttttctgatcctctccctcctcccaccctccaccctcaagcaggctctagtgtctgttgttcccttctctgtgtccacaagttctcatcatttaacttccacttgtaagtgagaacaactggcatttggttttctgttcctgcattagtttgctaaggataatagcctccaactccatctgtgttcccaaaaaagacatgatctcattttttttatggatgcatagtattccatggtatatatgtaccatattttctttatccaacctgtcactgataggcatttaggttgattccatgtccttgccattgtgaatagtgctgcaatgaacattgatgtgcatgtgtctttatggtggaatgctttctattcctttgggtataaacccagtaatgggattgctgggttgaacagtagttctgttcttagcactttgaggaactgccacagtgctttagttcaacaacggttgaactaatttacactcccaccaacaatgtatacatttccttttctctgcaacctcatcagcatctgttattctttgactttttaataatagccattctgactggtgtgagatggtatctcattgtggttttgatttgcatttctctaatgatcagtggtgttgagatttttttcatatgcttgttggccacatctatgtcttctttcgaaaagtgttcgtgtcctctgctcactctttaatggggttgtttctttcctgtaatgtgtttaagctccttacagatgctggatattatatctgtcagatgcatagtttgcaaaaattttctcccattctgtaggttgtctgtttactctgttgatagtttcttttgctgtgtagaagctcttaagtttaattagatcccatatgtcaattttcacttttgttgcaattgcttttgggatctttaccatgaaatctttccctgttcctatgtccagaatggtatttcctaggttgtctaccagggtttttatagttttgggttttagacttaagtcttgaatccatcttgagttgatttttgtatatggtgtaaggaagggatccagtttaatttctatatatatggctagccagttatctaagcactacttattgaataggaagtcctttcccaattgcttatttttgtcagctttgtcgaagatcagatggttgtagatgttcagccttatatatgggttttctattctgttccattagtctatgtgtctgtttttataccagtaccatgctgttttggttactgtagtcctatggtatagtttgaagttcggaaatgtgatgccttcagctttgttctttttgcttaggattgttttggctatttggcctcctttttggtttcacatgaattttaaaatagttttttctagtctgtgaagaatgtcattggtagtttgataggaatagcattgaatctgtaaattgctttgtggcagtataggcattttaatactatcgattcttcctatctccataagcatagaatgtttttccatttgtttgtatcatctctgatttctttgagcagtgttttgtaattctccttgtagagatccttcacctccctggttagctgtattcctaggtattgtattcttctggggtcaattgtgaatggtattgcgttcctggtttggttctcagcttggctattgttggcatatagaaatactagtgatttttgtacagtgattttgtatactgacactttgtgtattctgacactttgcctaagttgtttatcagctaaagaagcttttaggccaagactatacagttttctagatatagaatcatgccatatgcaaacaggaatagtttgatttcctgtcttcctatttggatgccctgtatttctttctcttgactgattgcttaggccaggacttccattactatgttgaataggagtggtgacagagggcagccttgtcttgctctggtttccaagggaattgcttccaccttttccccattcagcatgacaagcatcactcttttcaaaagaagaggatgtacaagagcttctctaatcttctttccctcatagcttgggaattcttgtaaacaacacaggagttttgtaatcagtgcacacaaatacaaagcacctattgtggacaggctccttgctagggttgccagatttagcaagtaaagacaggatgcccagttatgtttaaatttcagataaaaccaagattgttttagtgtaagtattcccacatattgcatgggatctacttatgcaacaaggtgttcattgtttatttgaagttcaaatgtagcaaggtaacctgtatttgaactgacaactctacttgagcccctgaggggctcaaggggcacttctcctcttggagctgcagatcccgcttgggaacccaggcagggacaagggagaccaggacttcctgctccacagacccaatttagggaccaggttctatggagttgagcaagctgactgcactctaccctgagagcagccacatattcatctccatgtaaaatctatgcaggatgtgctacatgggccacgtgtagcccagggcaggagaagattccactggagaccaagaaaacttcatagaaagataactaaaatatttattatgggccaaggctggcggatcacaaggtcaggagatcgagaccatcctggctaacacggtgaaaccctgtctctactaaagctacaaaaacttagccaggcatggtggcacacgcctatagtcccagcttcttgggaggctgaggcaggagaatggcatgaacctgggaggtggagcttgcagtgagcagagatcgcaccactgcactccagcctgggcgacagagtgagactccatcaagaaagaaaagagactagacgaggagaggggaggggaggggaggggaggggaggggaggaaggaaagaaagaaaagaaagagaacacaaatcaaatgggatcgtggcaaacttttgccaaggtttgagttgaaggtgggtagtggagcatggaaagaaaaacccacaggcagcactatgacagagtagtcctgcacaacgatgggtgcccttggcagatcatgtttgcttcctgctagtttgctagtctcgccaccatcttcccattcacaggatcagcaaaagtgattcagacatgggatccaccatttccctcaccaggagtaccagggtagaaagccacaattgctgtgagtcccagaagtttccccttactcatctcttctgaatgttcattctgtgtgtgtatgtgtgcgagacagaatatacacatgtatgtgcccacatgcagattaaaagttgggcacagtttatgagtctgtcatttcctccagttcctctcctggggattgtcaatcaaatcaaaggatggtaggtgcaggcaggtgggggcacaggtggggacaacctaagttgctggcatgctggacaaaggcaaccagtcctcccagcaggcacagctcagggagacaagcgaaaaacccgtaccaggcttggtgcacgttcctcttttcttacttcttcaggattctctcttttcctttttctctgaggtattgacaaggaggactatcggtgtcattgcaaagaaagcaggaacaatgattctgggggactgagaacctgggccaactgcattcactcactgtaaagcagctgtttttctgcccatacatgttcatgcatcagggcgaccatttcctggttatgcatctttggggatgctcattgataccctctgcgcctcagtttatgcacttgccaaacgagggtaatagtattacccactctacaggattgttgtggagagtggatgagagtaggtataggacccatctagcacataacacgtacaacacaaaccacattctctagtttctgccacgaactagtattgcacttataaaaatataaaagaaagagtaatgtcatctagtacacctaatccattttaacttaaatccaaaagggcaagaggcccatggtggaggagaaaaaaattagattatgataagatttggtgcagaattttcaaataccatcaaatgccaattctccatgtcagcagagtgaaagcatgccttggctataatagcaacactttttaaaattccatgttcacgctgacattttcaaccttcagaaaggatcacccactgctaaagataatagagattttccatcaataaaaggaggggactgctgcccttcaagatagtctacactgctttggaatatgaagtcactttgtgttttttatttttaaatagtggatgcactcctctcatgtcgtttacttaggctaacactgacacaagtttgcacttcctaaaaaatgttgcagccaggaagatgggaataaagtaggtcgctagcatccttaaagcatgctggctggctggttatccagagcagactatgcttgatagacagattgacagacagacagatggataagatatatacacacagatacatgggtaaatacatgcaccatctatatacaacacattatatatatatatatatatatatatatatataaaatatatatattggatatatataggatatatatatacacacattggagattatatatatatatatatatatatatatatatatatatatatatccaatgctatttcattaagccattatatttctattttcaggctgatttttgttcaaaaattgtatatatatatgacttttagaaattcacttgagacattgaaacttaatgaaatagcatgagacagctaattgccaggaagaacaagcaccactctgtggtccatggatttgtccatatgaaatgaatgataataaaggaaatggtcaggaggaaaactggttcctgaaaaaaacaaaaaccaaaaccatgaatcaacccattcaaatgcagctcctagcaagggaaatacatctctttctctgccatttttttattgagtcaggggccattgccttttcaaaagatggctgtcttcttttaatgaatccaattagtgctatgccaagatgcccaagagacttaaggttccacacagactcccagtgcagggaggctaaattcttgaagcctctgctttctgagatggaagtgttgggtcagaagggaggctgacagacaaaggctgacctgaggttgcgtggagctaacagagccaagaaaaacgttggttctgagacaggaggaaaaaaataaatcagaaatcaaacagcatgggacttagtgaaatcaatatgaggacaaaggaggctgccctgatgttcaagaatggaccctgcttggtgaaccctaagaattaatggagcagagcagaaacgtttgccaggctgggagcatcctttcccatcctgttcctacttagacaaggaccacagggacacacaaagaatggcttagttcctaatggaaaacaaatgccattcagcaaaggttttgagaaggagcaaggtggctgctgagagctttgttttctttccatttcagctacgggcagacatgtcttgctgaaaaatgaaggtttgagaaatacagattgtcctagtgttcagatgagtactgcccactaaggttaaaaaaaaaggaccacagggctggaagatgaagaggcaattatcctcaattcaaccctgtggctcctattacacaaagaaaggtgggaagctgaggccacatgtgcatgcgggagcagactgtgagtagctgtatggtagaagactggaactgagcccagcccaagttaacgatattttacagtggttcttgagcttgagcatgcaaaaacaaaacacaaaacaaacgacaagaaaaccccacaaaagcacttggggagcttgagcaaagtgcagattcttggactccacagtagacccaggcagggcttgggagtctgcaggtctgactgctactccaggtaacttaattcagaggaggaagatagatctaggggaaaacacaaaggaaacccattaaaaataaactcctaagctgggctcccaagagcccggacctcttgctaactgtttagtggggatcttcacttgggcattatactctcattttacacaccttgccccaaacgaagcaaattaccttttgccaagaacatgttcctcttcttggaatctcttttaggatgacagattccataatctcccccatttaccaagccaggagcaacacaagagcaagtgtcagcatatgcaactcactctgacaaactctgttctcggaggacccaagggaaacccaaggagggactcagaccctagacactgggagagtgagtgtggaataacctgtgatggttctactcataaggctcccaaatccagtccaaagtatgtgagcaggaacccaatatcccacccagacacagccgcctgtcacgttttcttgaagtttaatattagagtctaccccataaaccacctcaagtggcaagttctgacctcctcactgacatctgtcccttattttgccactgcagaccagagtctgcagacagtcaggtcctggctcagtaagccttgtagaatcgcccatgccagaggcaggtggtaggggtgggctacagattgcagcgtgcctgctgccatggcaacgcacgagcaaccagggatgggaaagaaggtgctttacttaattgaaatccaggcaatgtcttaatacgaagctcaaggaagttaatgctcaattagattttctcctgcctcctttttcccctttccattcacgtcaccaaatgactttaaccatccctctctgccaccaaaacagaaaaacaggggaaaacccataaaacatctctaaagttgagtcactgtataaaccactgagactgaaccctctcctctcaccatactcaagcaaaaagcaacccaagacgcctaggttctctctgttcactgccaatccatctcaaaagaaattgtttgcccaaaggattcttaagactgcattggctttgccatcaccacctcaccggggccaccttttctcacactatgactacgaattacctggagatttaaaatgcatattccttgcctatgcatatatggacaaaatgcataaaatgcagatttcctggcctcatccaccagatagttggtttaggcaaatcagagacagaatataagcatcggctttttttttttttttttcctagcaacccggggaattctgatcttgtctagagccagatccaccctgtgagaaatgcagaccaaccgatttgggctttacctgcagatctgtccttcataggacaggctgagcccagctaaaggtggacatctaatggcctcaccaaataagccatgggctgtgaaagggttaaccggggtcccctgttactgcagtcgtgagtcccctaacataacgattctgaacaccatagatacacatggaaaacgtgtcttggggtcgatcctagccactatttctccattctgcaaggtggaacaggaaaataaacatgctcgtaatccaaaaatattcactgatgaactcaccacttataaaattagtcctcccactaaaaaattccctccctgcctaagagcccaacagaagtcctaacccgctgctccctgtcagtctgggtgattgtgaacatttgtttgtattttcatcttattgtggaatttgtggaaatgtcaagttataagtcttgaaaaagatacaagaagctccaggacatgatgcagaagaaaggctgttccctggccgagcccagaacacgaaggacccagctagggagtaaagatgaaagcatggctgttttgcaaatttaaattttgactagccatctatctgattccagcaagatgaaggataaagataaaccaaaatctccctctacaaacacctagaaatgatgggtgagatgaacagcaacaacaaaaaaatgttttaaatgcaggtacaagtttgcaacaaaggaaggaaatcattaatgatgagaaactagaaaccggagccttaaacaccaaaaccagttcagaggttgccttggggtgaatatgggtcccaggaacaggggcctgggtgttactgtccacatggaggtaaaggggaggccctggaacacacacaccaggggctgaaattttacaaatgcaagattcatggaattctgcccctatgcagacaggtgaaatagggggaaaaaattatgcaccaacagagagagacaaaaaggatgctcatatgtttctatgtggtctctgaagaaaaaaactgctcgaaaaaaaaaaaaaaaacaactttgggcctacaccttgcaaaggtcagggtatgagtttctactttctacattggctagaaaaaccccaccataaacatcaacataaaagctggttccagggtaacgaggctctcaaaggatgttacagaaacaaatgcaaacctactctaaaaaaaaatacgctcccatgatccaggacgctgaagaccctcaaggaaaaatgcagccaccagagaaggactgacgttaaaaagctgaaaggtctaagagaaatcagcactccatgcatgagagtcagcaggcaccaccgacagagagaagcagaacctttgtgtaatagctcttttttaaaacaatataaaacagcctaaccttattcaagacctaaaagaagaaattaaaaccaaaataaccacatacaaccaagaaaaaacagacgaacccactcgaacaactacaaaataaaatccacagtcatttctattgaaaactcaacagacaaattagatagtcggatattggctcaatgactaaccaatgagctggaggataaatctaaatcagagagaggaagagatggacaatatcaagaacagtttaaagcaggggtccccaatacctgggtcatgaaccagtatccgtccatggcctgttaggaaccaggctgcacagcagggggtgagcggcaggcaagcagttgaagcttcatctgtattgacagccgctccccatcgttcacgttaccacctaagctccacctcccgtcagatcaccagtggcatcagattcccacaggaccacgaaccatattgtgaactgcatatgtgagggatctaggttgcatgctccttatgagaatctaatgcctgatgatctgtcactgcctcccattacccccagatgggaccatttagttgcaggaaaacaagctcggggctcccactgattctaggttaggtgagttgtataattatttcattatctattacaatgcaataatagaaataaagtacacaataaatgtaatgtgtgtgaatcatcccagaaccatcccccacaacccccaggtctttgaaaaaattgttttccacgagacaagtgttcactttaaagtagtataccaaatcttaagataaataatacatagacacacatacaaacacacacacaatcacatcatactgaaactgaaaaccactaaagacaaatgaaaaaaaatgtatacacaaccagagagaaagacaaaaacttgaaatgaagctgctgctgtgtgcatttttataatgcttacagagaatgcaatgcaaagcacaaatcttcagatggatgaatgccaactaattagaataataagtgccaaaggaaatggacatttctattaacctacacatttaaatgcaatttgatttttctttcaaaagtcagagctaaatactttatttagctaactaactaaagcccctcacagatcctaaaatcccccatagattctaagtgaagagatattataagagaaatcaaaggcaatcaatttcacacaagaagcaatggtgagcaaagatattagcaaaaatgttggaaaatggaagcaaccattgattgtaaaatacaaacgaacaaaaacaataacaatactagcaactcatttgggaggtatcaaacaaagggagatactaaaatactggaaaagtagtaacattaaagcattctaaggtcctctgattggtagggaggaggggagagatgcagattaattttaaacaccgttattaggtcaactaggcaagtttaaagaaagtaaaaggaagccaggagtggtggctcacacctgtaatcccagcactttaggaggccaaggcaggcagctcacttggggtcaggagttcgaggccagcctggacaacatggtgaaaccccgtctctaataaaaatacaaaaatcagccgagcatggtggcatgcacctgtaatcccagctactcgggaggctgaggcaggagaattgcttgaacccaggaggcggaggttgcggtgagctgagatcgcgccactgtactccagcctgggcgactgcgtgagcctccatctcaataaacaaacaaacaaataaaggaaagggagacacagacaagatactgaattgaaaacttccaaattaataaagcgtaagggggataaaaagaggaaaataaaaatcaatcaatccactgaagtactaaaaaaggaaaaagaaaatgcatggtaaataaaatacgaggaaggagtataaatcttgagccaggccatacccacacacaagaaagggctgttcctcaagacagcccctggtgtgttgaatgaagtgcgcgcgcacacacacacacacacacacacacacacgcacacacacctatgcacaaacacactagacccagatggtattaatagtgttaaaaaaattaattgaaacactattaggctgagatgaccctagtgccttgggatcctacataagcaaaccaaaacccaactcactgtaaatggtaaaacaaaattgaagcttagccaatcagaaactgccaactaacctctaactagggattttccactttaaccaatcagatattttcttagtcttgcttcctggaacaccttatagaagttttcctactcacacaccctgggcaaagccctgatcacttgtggtttaatactggccaattcatgaatcgttcgctgctcaaataaactcttgaaagtttttatgtgcctaaatttaacttttaacattggtaaagaccgtcttgttatagaggaacaaataatccccatcccatgctaactattccagagaataaatagaaaaatgaggagagaaagaaaaataagtaaaactccccaactctgcatgatctggatgaggttggtataactttaaccttaatattcagagggaaaaaataataaaagcaacaatattcaaaccagaggaatgtaacataagaaataagttttaggccatgctaacttaagaacatagatgccaactgctagaaataaaaaggataatagcatctatcaaaaatgtgtctacggaaaatcttcagtaaggctgggcacagaggctcacacctataatcctggtactttgagaggctaagtcaggaggatggcttgagaccagtagttcaagaccagcctcggcaatatagtgagcccctgtctctacaaaaaaaaaaaaaaaaaaaaaaaaaaaaaaagaaagaaaaaattagccaggtggggtggcacatgccacaggcccagctacttgggaggctgaggtgggaggatagtttgagcccagaaggcaaggctgcagtgagccatgatcccaccactgcactccaacctgggtgacagaatgaaaccctgtctcaaaaacaaaaaaaaaatcttcagtaagtattatatgaatggtaaaaatgtagaaatgttcgctttagagttccacggatagacagaactctaaagatggcacccaacatttgcctctctccctgcctagagtacacactttgcataatccccatggataggatgaatttcactgctgcgaaactcagctcagctgactttaagacagggaggttagccaggtaggcctgacctaatcccatgagatctttaaaagagagagctttctccagctgatctctgaaaggaagtcagaggttcttctgggaataaggctcaggcatgagcctttgaaatggacatccccaaataaacgagccccccatgttgtccttcccaagtggcaccagtgaaagtaacaagaagcccagagaacatctgctgactgaggaggccccagcttttgacaaggtgtccatctggaagcatctgggacagagtcagcttctcaaaccttgtgcatgttaaatacggaagcatggtctccttccccagagaatctggtactacgaataagtgggaaatgcatttttattgattgatggatttttatttatttttgagatggagtttcgctcttgttgcctaggctggagtgccatggtgtggtcttggctcactgcaacctctgcctcccgggttcaagcaattctcctgtctcagcctcccaagtagctgggactacaggcacccgccaccatgcccagctaatttttgtatttttagtagagaccatgttggccaggctggtttcaaactcctgacctcaggtgatccacccacctcggcctcctcggcctcccaaagtgctgggattacagacatgagccaccacgcccagtgaatttttaaaaattgattttcataatacaaaaagcacatagagaaaagaaactggcatgtaatccccatgcccggataatccctgctgacatttgaaagcacgaaagtaacacatgttcgtgtttaaaatgcaaatagaacagaaaaagctgaaataaaaaccagaactgtctctcccctacccccaagtatttcttcccacaaataactggtcacagattttaatgtattcttctagaaaaaaaatattataataccagggcatatgtccttctcaacatttctaccccaaaggaattagatcgtatccagttttgcagcttgctttttttttcttcttcttcttttttttttgtttagcataacctgtagatttttctacatctgcatttttaaaaactacctcattcatttaactaggctcaaggcagggaaggaatcccatttttaatcagtgcttaaggtgagtctaatgtgcgaggtcagcagaccacactgagaaaccctgatctgagacaggtgtatgcatgtggaactctctggtttctatgccaatccatgctaaggtcttgggaatgtcctcttcctctccctaacaagcagaggcccagattatctctgaacatcccagatttaggtatgctgtcccaatacaaatggagaaatattcctctccagactgtgtttatccacctgcaagggtctcatgataacttccaggagttaggtagcatgagatagaaaattattcctggcttcactgctgaaaacgggtgccctgcggcaatgtgttcatttgcaaagcatcttcgctagactcccaaattgccactcatccattttcaatcttaggtcattgccaaagcaaagcaagcagccaagacctggtgttggtctcatacagccccagatgctctccagatgcagagacccctctccccattcctctacaggccacgctctcctgcagatttgtggccaattggtaagtagctccaagataatgttgctacggatttgcctcaagcatccttttgcagtcttacttatcttttaactggaaaaggtttgcctgctaatgagcctatgttatccttcatctaattatctttggcaatcccctcttccctggctgccgcaatgttaagggccatcagtcagagatctgcaggtggagaggtatgatactgtgatagaataagaattacatattttggtcttcatcttgattcctgacacagagctcttaaaatccttgtacatttcctaagtgataggaacaataaaggaataaaggagagtcttttgttattcataacaagcccttttctggtttttggttttttttgtttgtttgttttgtttttgttttttttttttttttggtttttctgagacagagtctctctgttgccccagctggagtgcagtggtgcaatccaggctcactgcgtcttccgcctcccaagttcaagtgattctcctgcctcagcctcccgagtagctgggacttcaggcatgtgccacaatgcccggctaatttttttgtatcttagtagagacagggttttactatatgcccaggcttgtcttgaactcctgagctcaggcaatccacccacctcagcctcccaaagtgctaggattataggcatgagccactgcacccggcctataacaagcccctttcaatcacacctaagtttacatgtgtgcggtgccttttggaaagcccttaaggatggggggcgctgtttgccaggggaaacaatcatgagattagagagttgaatttgggccccacacccaaacctggcctctggggaggaggagagggcctacaggttgagttgatcaccattggccaatgatttaatccatcatgcctgcataatgacccatccataaaaccccagaaggacggggttcagagagtttcctggtggctggacatgtggggtgctggaagggtgacatgtgccccatcccccaggccttgtcctgtgtgtctcttctacctggctgttcctgagttgggtccttttataataaattgattacctgtaagtaaattgttttcctgagtcctataaaccatactagcaaatgatcaaacttgaggagggggttgtggggacctctgatttaccctccagttggatgggtgagagcctggatctgtaattgttgtttgaagtgggggcaatcttgtgggatgtagcccttcatctgtgggacctgttgctgtctccaggtacacagtggcagaattgaattcaattgtaggacactcagctggtgtccttacaaaactggagaattgcttggtgtaggaacactgcacacatttggtcacagaaacgttctgtgttgagtgatagtataaaggcaatgatttttcctatacaagaggtaaagagagtaatgtctatgatggtgtctgctcctgtcccagtgcctggggagggcaggtgattccaacccagcaaagtcccaggagtggagggagttggaagccaagacccacatccctggatttacagaccctctggggtgtgtccctagcttgccacccacagcgcatccacatcctcacacatgggaaaccctaggatacagctgagctccactctgatccccaggggcgttggaaggtcatcagggccagatgggtacaaaccacccaactctgccagattctcagattcgacagacgggtacaacccacccaactctgccagattctcagactcaactggtctctcgaaataaggatgtaacaacgtgggggcagtggcgtagctcctaactggctatggcaccgaaaagctgatgaaactgcctttgcgaaaattatgacagtgatagaaatcttacatagctgatccatcttgcttctaacctcataagctgtcatccctggacataggccaagctagctacaggaggaagttagtttctagtgtaactttaaaacaaagatgataacagtcccttgccaaaactaaccaccccctccgttgtggggactgaaactgtctttgtaaaactaaccaattggccaccaggttagaattatggttcaggggcgggtgcagtggctcatgcctgtaatcccagcactttgggaggctgaggcaggtggatcacaaggtcaggagatcgagaccaccctggctaacatggcgaaaccctgtctctactaaaatacaaaaaattagccgggcgtggtggcgggcacctgtagtcccagctactcggaggctgagtcaggagaatggcgtgaacccgggaggcggagcttgcagtgagccgagatcgcgccactgcactctagcctgggcgacaggggcaagactccatctcaaaaaaaaaaaaaaagaaaaaaaaaaagaattatggttcaggactcatatagctggaggttacaagatctataacctccccagttgctcctattcttaacatcgctattataaaacctaagactggtatttgaggtgtttttcagacctcacgttctgatggaccggctggcaccacctggatgggaaacctataccaagaaactgactcagctgggtcctgtgacctctacccagaaattgattctgcacaagaagatagcttcaaccctctgtgatttcatccctgagccaactaatcaccttatccatttcctagccctctgcctgctaaactacccttgaaaaactctagcctccaaatatgtgaggaggaggacttgagatacatctcccatccttccaacttggctggccctataattatcaaactctttctcttctgcaactcttgccattaagtgtttggcttttctgggcatcagtcaactgcactaagaaagcaggtttgcagaatgaagagagctgatggaaaacagaaaaaagagaccctggtgggaggcaaaggagaatatgtgaacacgtgccctcaatttcccaccccctgactctagcaccccatgagactcaacttagcacactgcccttggattgtttccttggaatatattctgccttcctcctttagctggtctgaactgggtttcgctcccagaaacggtttggctctgtgtccccacccccacaacaaatctcactttgaattgtaataatccccatgtgtcaagggtgggaccaggtggagataactgaatcatgggggcagtttcccccatgctattctcgtgattccttctcacaagatctgatggttttataaggggctccccccacttgctcagctctcactctttcttgtgctgcctgtgaagaggtgccttccaccatgactgtaagcttcctgaggcctccccaggcacgctgaactgtgaggccattaaacctctttcctttataaactacccagtcttgggtatgtctttaatatcagcgtgagaaccgactaatatactcccttccaaccacaggcacccttccttgatgaagacaaaaccacagttgcaataaagtcttaatggttgacagtataataggagacaaggtaagaaatgatcacttaaatgtttgccaagggaaagtaatcacctgggactggtgagcataaatgatttttgctccaaagcaaagagaaaatccagagtccactctgggtttcctgcccgatgtagaactgtctctgttccttctctcccaccccggacatgcagttccctctcatgattttgtgggaaagctccatcctcagctaggatggatgctctgtggacaagaagctgaggcgtccatctgcaaggctgtcgcagggatgctgagcaaagctgacaccaggagggaggggaaaaccccgctgctggtaattcaaggtcctataatcttctcccattttgcaggtgaacagcctggtataggagcctgaagttatcggtccagaaagaaaatgcaggttcctgtctcctgtcaccttcaaaaccttgcttccaaagaaatcatcagggaacaccctgagaggaaagagcgagccctgaaaaatgagcagaagtatccttgatggagaggaggaagtggtagcaatgttgggttttgtctgtattggccatagccagcaaaagcccattcccctgtcccgctctaagaagaaagcacagccagggcctccaacccaactgtggacaaaggaaataagacaaagattgtagagtttgggacccagtcattcctcgttctttcccactgaaaactgagtggaatacattttgtaccccaaatgaagctaaagaatattacagtggctgcaggttgaataaactgggggaaaggagggagagaccagaaccaaaaacactcagatgggcaaatatatctcaaacacagcacgagagaaacacagggagtaaatcacagcaaagagagaaaaagaggagacagggttattttgggaagaaaaaactggtgcaattagatgcagaaataacattttcaaaggggaggaagtcacaagaaatgtaaggaagtgagctgtgtatattattttaaatcttgttcacattaacactgtaaatattccaattaattcatcattattgaatttgccagcaaggctaagggtaaaacttcagcccaaagtttaattataccgaggcagagtggagcatttttcatgtccccaagaactgccaatggagaaagatgaagctttcataatggccagggtgacagccacctttctgaacacagctgttacctacctgaggacttcccaggaagccagcgggattctggaaccccctgaggttgtccagctaatttgcaaagtgagacagagttttatggaaaagctattcaaacccactgatgccaaatgctccaacaatctgtccacccttcccttcctcatctcccacaaaggcacccatggctgtgcatgtttatgcgtgtgtctgtcatcctacattcatgtggctctggttgatttcccagttcgcatgcatttacttattaacgatgatctaattcggagtcattgtttcttttctaatctatttctttcttttcccttagagcactttcaatgcttactgtgtcagaccctccttctgaggaaggaggtgggacttgattccaaaggcgaggctcagtcacgggaccaaactgaggactagctaaaacaggggcagggtggaagcagctttctattagacatgtccacccagtgtgccatatcagcttaacactgccatggcaacatcctggagctaccacccctttccatggcaatgacccaatgacccaaaagctgccacccttttcctaggattttctgtatataatgccccttaatctaaatgtaattaaaagtaggttataaatataactgcaaaactgccctgagctgctactcttgtcacactgccttatagggtagccctgctctgtgggaccagtcatgggagtgtcaaagttaaacctggaatgtttccttcttgtgattttgggacataaccatgctctgccatgcccaaaagcctccatcaagatcaatgggtggaaacagaaattggattatggtggtcaaataaaaaataaagagctattgtagaatacttaggggagaaatgggcaatggtcaaatgcttcatatcccctggccccaaagccaaagtcaagtacaaagaagccaaggaagcatgttgttaagttccaaaagtttgtctctgcttgttagaacatagtgctagcaagatcacaatcacaggaacttatgaaacaggcctaattgttgcatgaaactgatatttatggtttcttttgaataaacacagaaatggaccctcccagccttaaaacttgagaaagttacattcgtcttatctgagttcctttctcagaaaaccaaccacctagtgcctagatagtatcatggagctgaaacttaccaatcactgcatctggacaatgaaacccctcacctgtcatgatcacctaactgatcatgtgcttcctattgaccaactcctctactcctccctaattcctgtttccccacacatggttccatttcttccctgctatataaaccccctaattttagtcagttgaagagaaggatttgagactgacctcctatctcctcagctgcaacacctgattaaggcctttcctggcagtacccactgtttcagtgattggctttctgtgcagcaagcaacaagacctagaccaaacccctggtttcagtaacacttagagcctacagaaaccactccaatttccctgtgcccacaaccacaaaataagctcccaggccctagccaggcacccagcaaatgcaggtccttggctacaaggtaggctaagaaaaaatgcataatgtaggttagtgtcccacctgggttagataaaatctaattaagcatcatcttatcaaaagagccaaaagaatcatcatctctataaagaagggcaccaacacacacacatacactcccttttctttagatcattgtaagcctcaagttataaaaaatgatggtgtgtgttaggtgtgtgctttggagggaaaatgccagaaaaggctttgtgatcaaatgttcctgtctttccaatctaactgcctttctctctcacctctctttgcttcaagaacattcatgacactgggtctctgaatagtaattcacaaggcaaaattattggcggctttatattacagcccattttcctgactcctttgaagggtgggcaattagaacctcaaacacaattttttcattctggccagtgccacgttaaaatgggcaaaaagcggggaaaatggcctcaacctttctttcgcaatcagttcacgatgcttgattgaaacctaccaattacttttccccccatttgctcatgagaggtaatcaaggtggaagaaaaatctgaagctaggagagacagagaaattgcaggcaattttcccagtgaaagggctttctctagctgcctgattctgatgtccctattaggagctggctgaacatggtccatggtctcacgacagacttggagagaccggggacagcgtgctttactctggcgcctcaggtccagagcacgtgatggcactggccttcatcttcatttttatttttttatttttatttattattattattattattatactttaagttttagggtacatgtgcacaacatgcaggtttgttacatacgtatacatgtgccatgttggtgtgctgcacgcattaactcatcatttagcgttaagtatatctcctaatgctatccctcctccctccccccaccccacaacaggccccagtgcgtgatgttccccttcctgggtccatgtgttctcattgttcaattcccgcctatgagtgagaacacgcggtgtttggttttttgtccttgcgatagtttgctgagaatgatggtttccagcttcatccatgtccctacaaaggacatgaactcatcattttttatggctgcatagtattccatggtgtatatgtgccacattttcttaatggcacaaggggatctctcctttccagaaccagggcagtccgtccctagagggaccttgactctgtcaaccgacactgtcaccttctgctaccatcttggaaagggtatctggatgtttcacttctcttggggatttccagaaaaagacagcccattagggtattgtcttcatgtattttaggaaaataaacaaggtccccagccccaggggccttcttgctgtgaacacaccaagcttgttccaacctctgggcttctgttcctgtttttctctcttggcctggtattctcttcctctagacattcccatcataacggcttttggccaacatccttcagaccttactcacatgccatcttctcagtgaacagtctcaatatcccacttaaaacatcaacatcccctacaccccctttattgctgtatttttctccatacctgtactatatataggaataaaatcccataatatttttccctactctcatataaaaatcaacacagaatacttctatgacctctggtcaccaaactgtatggggatttctccccaccaacatggagtgggggtaattcaattcaatccagacactatctacctggaggtagcatcagatcccacaggtgaaggctcagtcccaaaagactgcccatacttcaggtcaattgcaagtagtaggttgtcacctatgcttctgactgatccactataaattggggttcacactagaccttccttgggttcaattaatttactaggatggctcacagaacccaaggaaacacttcacttatgttcaccatttattacaaagagtattttaaaggatacagatgaacagccaaatggaagcaatgcatagggaggttatataggaagggggcgtggagcttccacgccctttccaggcacactatcctccaggaacctccaagtgttcagctatcaggaactcatccaaaccttgccctttgggttttttatggaggcgtcatgatttaagcctgaatcattaagtcattagcccagaggtcaggaggtgagattgaaagtcccaaccttctaatcatgccctggtctttctcttcaccagcctccatcctgaagctatctaggggctcccagccaccagccatctcgcttccatacaaaagatactcttatcactcatacaaaagattctcttatcaactccagagattccatgggttttaggaactgtatgctagaatgccggaggaaaaccaattatatatttcacaatatcacagtatcactcactgctatctagtttctacatgctctttttacttcattatcatttctgctgcccaaagctaacacaagctctgtgaggacaggaggttttgtctgttttgccgtagtgttactaaaaccaccctcacagggtgaacaagaatgacaagccaggctttaggcaggattatagttaggcatgaccagggtgccctggtgtacttcaacccacttccctgcagctgctgagtgacaggtagcatgctgaccacctgccctcccattgtttctatagataaatctctcaccctagacctttttacccaagaattgcttcaggaattcagaaattccagtgaaactggcaaatgccacctggtctgaagacccccgccaaggaaccgactcagcacaagaatgtggtttcttcagctccctgtcccatgacttcaccctacactttctgaccaatcagtgacccccacattttaccccatcatttgtccagactccttaaaaaccccatcctcaaacctcttgaggaggctaatttgaggtttcctcccatcttctcattcagctaccctgagatgattaaactctttctctgctgcaactcctgctgtttcagtgtgttggtctgttactgcacaatgggtttaagagcatcctaagagctccctactcctcacacactgcctggcacatagcaggggctccatgatctgtcatccatcatccatcacgatgtggggaatgacagaggacagcaaagtacgccccactcttcatggggtttatgaagaagaaaagaacttggggctgggcatggtggctcatgcctgtaatcccaacactttgggaggttgaggcagatggatcgcttgagcctaggagtctgagaccagcctgggcaacatggtgaaaccctgtctctactcccccacaaaaaaaaacctgttgggcatgatggtgcatgcctgtggtcacagctacttgggagactgatgtgtgaggataacttgagctctgggaggcagaggttgcaatgagctgagatctctcaactgcactccagacctgtctcaaaaaaaggaaaagaaaagaaaagaacttggtattgcagagaggagacaagtaaatgcaagggaaaaattgggagaggggactgcctctcacctcttaaaacagagatacccaagttcagatacatggctttttttttttctttttcagacagagtctcgctctgtcacccaggctggagtgcagtggcataatctcagctcactgcaagctctgccttctgggttcatgccattctcctgcctcagcctcctgagtagctgggactacaggcgcccgccaccacgcccggctaatcttttgtatttttagtagagacagggtttctctgtgtaagccaggatgatctcaatctcctgaccttgtgatccgcccacctcggcctcccaaagtgctgggattacaggcgtgagcctctgcacccggcctaagataaaattataaagactgaccatactaagtgttggtgaggatatggaggagatggaactctcagatgctgctagtagcaatataaaatgccaaaagcacttcggaagacagtttggtagttacttaaaaagttaaaacatacacctaccatacggtccatttcactccttggtatttatcccccaaaaatgacatcatatgtccacacaaagacttgtacacaaatatttgttgcagctttatttgtaatagcctcaaactggaaacagccaaaatgtctgttctgcaagtgaatggataaagaaatttggtatatccataaacaaaatacagcttagcaataaaaaaaattaacttgattgcagtgatggtttcccaggtatgcacatatgtcaaaatttatcaaaattgtaccatttaaatatgtgcactttttgtacgtcaatcatacctcactaaagctatttaaaatgtctgaaaaattctgggttaaataattttaagtaagtttcttttctgtaggatttccagagcctctaaatgttaagtgggtattattactctaccaaaagagaatatgatatatgtcatttcccaaacttattcttccacaaagcctttttaaaatttttatttttttttactaagtagttcatagagctggcatcccatggaacacgttgcaaaatacgacaaaatctgttcttgatttggacatttctaagtggcaaatgacaagaagacacctttaaattgtcttcaaaacaagagagctccccaatttataaaatctgctgtagcatatgtgaaaacatcccagttgcctgaagaaatgtgtatgtttgcctcacaggctgcagaatttctttagcttttcttcggcagccacagatcaggcttatttattttcttcagttttactaaatatgaaggtgttggccaggatttattggtctgttttatttctccatcccatgacatctgctagaggtggttgttactgttaacaataatgctactaaattacttgagcactccagaatatgacattctggggaaccaattaaaacagatgctctttcggccgggccggtgtggtggctcatacctgtaatcccagcactttggaaggccaaggtgggtggatcaccagaggtcaagagttcaagaccagcctggccaacatgtcgaaacctcatctctactacaaatacaaaaaactgtagccaggcatggtggtgcacgtctgtagtcccagccactcgggacgctgacgcaggagaatcgcttgaacccaagaggtggaggttgcagtgagccaagatcgtgccactgtactccagcctagatatcagaatgtacatattcctatatctaaaaaaaaaaaaaaaaaaaatgctctttcaactttctttaggagacacaccacacgcatgcacaatccaagacacggagaagagaaatgctcagaaaatccaagtacgatgattaggaagctttttctgaactcagcaactatcacagaacattgttaacttcctggctctctgcaaattttctttgactacttcaggaccgaatccaagagttgcagccctacacagattgtctttaaaccatagaattcagctggcccgctctgctactttattcattaaagccactctatgcaactgtttaacctagtagtcttgagtttcatctggaactctaatcattggcaaggaaagtaacacctgacttcagcagtattgggtcaactgcttttctcaattaaactcacacaacctgcttgagggagagagaatgcttctttttttttttttttttgagatggagtctcactctagcttccaggttggagtgcaatggcgcgatctcagctcaccgcaacctctgtctcccaggttcaagcgattctcctgcctcagcctccccagtagctgggattacaggtgtgtgccatgacacctggctaatttttgtatttttagtagagatggggtttcatcatgttggccaggctggtctcgaattcctggcctcaaatgatccgcccacctcggcctcccaatgtggttggattacaggctgagccaccgtgccaggccgagaaaatgcttttaggtggaattatcatgagggttcatcacgcagtcctgcatccttaaggcatactggcctaacataagcatgggcgcatgtgagtggaaagtgcataaaacacagccaagtccatattctacgcagagcaggcctcctactgttaacacatgtgcactggagtctacctaccctcacaggcctggatgttactatagctctgttttctcagtatgcttcctcttcaaatcctctgtaaccacagatggctgctgccaaaaacctggatgaaaatcacagagatgacccagtgcagcgccatctttatgactgaaccagttgaggtacctcctgggtagtatttacatgatgcaaaacatgctcaagcatcgccagtactgaagcttttcaaggtttcatggtggcagaagctagccagttaattacacggaatctgggaaggcaggttctagtctctgttctcccggtggattgtgtctgattcagggtcaggtgactacaatttctgaggcttgactgagaaatgaccgaggaatcccattcatttgtaagggagaaacagccaataaaaatgtattcttgtctcatcaaaaagacttggtccaggggaaagccatgaagatggctattatacacacctccatccctccttattgtggagggaaggggatgcaatctgtataatatcatagtgtgaaaactgaagttgggcccaagtagggcctggtctttaatccaattctgcccatagaaaggagaatctgggctgggtgcagtggctcaagcctgtaatcccaccactttgggaggctgagacaggtggattgcttgagctcgggagttccagaccagcctggaaaacatggcaaaactctgtctctacaaaaaatacaaaagttagctaggtatagtggcgtgcacctgtggtcccagctacttgggaggctgaagtgggaggatttcttgagctgggaggtcaaagctgcagtgagctgtgatcacaccacaaaactccaggctgggtgacagagtaaggctctgtctccaaaaaaaagaaagaaagaaagaaagaaaccttataaaggaccacagtgcccctgggcctgctaggctgcccacagcttggctcacaaaagcagcgttgtcactgtggatggcctcaggccatgttggtctttgtactgttgcccagccatttgcagggccagtgcactattctaaatttcatttcaaacaatgaatcctcagagcgttcatcccttccattctgttatctactgcagtgcaaggctgtggctcagaaagtctttagcttggaagacatctagctccattaaaactgcagcaattatgactacctggaggtgaataatctcctcttggctttatttaatgttcaatacaaagaaacagtcaccccattaaatttacctgcgctgtgtctcgctttggatttttcaggtagtcattggttctaaactatcatgttcagtatcttaaggaccagactatattactatggtgaggcagactggcaggaaagctctgggatctatcttgaacattagagtttaataaaaaggaaggcatgagataaactgaaaaatataaaataggaaatcgctgcagcagcattctgcattcttgaatagaaagactggaaaccttaaagctactaagtcttttcaaatggatagctttaacataattccactcaaaatcacaacagaattctaaaactggacaagggaactctaaagctcttctgaacaaagaaaaatgcataacgagaggaactcatcattaaatataaagtggtaatattaaatgagtctttcttgcagtaggatacttaactttcttcagatttatcatccctttaaaaggcctgttttgacaaaggggctggagcacttgaatgatttgtgtctatgtttctagagtaccatcaaaacacagcaattcttatccacttgtgtcaaggacttctgatgatacttgtaggttatcgaaatggaagatttcctgtggactaggatttggattctaaaaatcagcttataggttttccctgcagctccagacagctattcctcagtttttgcctcctctctatattggaattaaacagcttcctatgaagcttggaacgtcaacgctttctgcatactcaactccagtttcatacttttgcaaatcaagcattggttctgtgcagctgagtctattccaaagcgagtaataatttgattagtaattttttacaactctctaatcctgtaggctacgggctcacctcttgcaatcacctagttcccacctagacccatcctgcattcactgaagattccagcagcattattcaggtgccactattcatgtagataagccatctgcctcacctccaatgaacctgtcctgtgcaccatctcaaccaactaatcccaagggcactacttatcagatctacctctaaaatctcaatggcaggcattccaggtgttgaaccacctgcctgctatatttatttccagctcctttcttgtgaacgctggatccagttctttagtaccactggcacctctgtgccattggcccagccacctttttactccaacctcccacctatgtccacacttcccccctcatcaagcagtggccctcgctagagccaccctctagcaaatacctacacatatgcctacttaatgccgactctccatctattctgcacttgtcgccaaagagttgaatgtaattggagagaaacctactgccatgatgcatctccaccattctactgagactgcttttgtcggggtcaccactggtgcccatgtggcccaatccagtgctcccatctcagatctcagcttgctcatcctttcagcatttctttcacatgtctagtcaattcccctctttttgaacatccctcatttggcttccaagaaacctttctcccccagtattcctgcatcctcactggcaacacctctgctcagttccctctgctggattctgttccacttcccgatttccaaatggaggaccctggtgctcggtcctcagtgctcttcgctctcctgcctacacaggctcccctgggcaatctcaaccaatctcatgactttcgtcattcccaaatttatatctccaaccccaatgtcttccatgaactccaaagtcatgaatccatctgcctacttgacgttaccacttgagtattcagaggcatctcagacacagaacttttgttcttccaacccaaacttgtttttctccagccactccctgtaaatcactcaatcccaaaggctaagaatcctcctcctcctttctccttctctcagagtccttacctatccgcaaatcccatcagctcaacattcaactccgccactctttctgcagctcaagctatcctcccccactacaaacgcatcctccaaactgctgatctggattccacccttgtccgccagctcccagaatctcttctccacatagccacccaaacaatactttagaatgtgtgtcagctcatggaactcccctgaataaaacctcctgatggattcctgtcatactctaattgagatctgaaagtgctagtggtccctgcccgctggaacacttgctggacaccagcctcttgactgtccctcaaatacaccaagcacctacaagctccagggccttctcacgaatgctccctgtgacccggatgctccttctgactggagtgctccctcctagggtgctccctctgaccaggataatctcttcacactcactcttggcattttctctttcacatctttcaggtcttttctcaaaacccatcatcttacaggggtcttccctgactgcctgatctaaaataacagcccagtcacactttcatcccagtaccctgcttttctttttccctgcagagccagataacattaccttatgtatctttgtctattatctgtctcttccactggactataaagtcctgtgagggcaggagctttgtctttttgggtacactgatgtcatcccagagttcaggatagcacgaatcacacacccatcagatgagtgagtgaatgaataaatggatcagataatgaatgaaggaatggatcaactggctatcaaccgcagtggaaagctggacccctggaaaagtctacctcctccagtctgtatcagaaaggggctatgcaacaggacagagaaagtgcatcgaaactccgttttcaagccaatgggctcaaccacactaaggaaacagccgcaaagatgaggagcacttctcccgagggctctgccttcttcccctttcatctgcatcatctttcttgtgcctgtgtatgcagtaggtggctttgaaaggcagagacaaatgtcagaatgcaacactgcacagttcttattgctttcaacagtttcccgtcttccgtcataacgagaacagtcgcagccatgctataattttctgtttaggtaacatcttatttgcattctgaaaccatgtcctttttcctattactgatataaaagattgcttatttctaattatattgcaggcattcagggaattcaaagagcagaaaatatgtcaggaacaatttacaaattgtggctatttgtgtacatgcttgcctggactccagcaaatttagaaacgaaaaaaaaaattgcttattaaagtgccatctctcctcagcagatctctgcttctatttgttctctcagtcctaactaaatacaaacctaaaccctaagtgtgaatgtgcttgtgaagaaaagtactcttccccacttctcaattgttttcaatgagaatttcgaagtgatattttccccactgctcccatcctgccttggaaattccatttctctcacactcaagtcattatttctaaaaacaaaacaacaaaaagaaacacacatttttctgtttttgtgatttgagatgtctcaagagctagaaaattcttcccagagtcgtatgagtcagtactgaataactattccacagatattaggacgaacatactgtgcatgaggtggagaaccttcatactcaaaatgaaaccctgagtctaaacttattttgttccacattttaagctcgaataaattataagaagcttgaagatgtaaaatatgccttctatttctttggtatcttgccacagtgctaaggaaagaacaaacatacagaactttcaacgtattaattttcaatccaggaaccttcatagatctgaacaaagccactcaaaagagcctaaacacatggctctacctgatcccaacagatggggttagtggttgattgtcaacagttgcctgcatttatctcccaaaaggccttctggaacctcttccctgacctaaatagagacgcttctaaacattttagaaggcatgatcttttcagagtcccatgcaacaacatcattttgcctactcgatcagctctaagcttatttcatccaagataagtgttgaggccaggtgttgtggttcacacctgtaatggcagcactttgggaggctgaggaaggaggatcacttgaggccaggagttcaagatcagcctgggcaacatagcaagactccatctcgataaaagatgaaaaaattagccaggcatggtaacgtgcacctgtagtctcagctacttgggaggctgaggagagaggattgcttaagcccatgagttcaagactgcagtgagctatgattgtggccctacactccaatctgtgtggtatagcaagaccctgtctctcaaaaaaaaagaaagaaaagaaaaaacgaaagtgtagacaggagtaactagatacagttgcagagacatggtgtgcagaggtcaaacatgttcataaagaggcctcagactcaagcaaaattctactattgcccaaataaactctgactctgaatacagggcaaatctctatttgcccattttaaaagggaggttcgatcaatgtgaatttataaacgtttagagatgcagatatggataccaaatatctattagccatacttaaaccattaatttagttacagatgtgtatttaaaataaaataaaatattatataaaatatattacatggccagatgcagtggctcacgcctgtaatcccagcactttgggaggccaaggcagatggatcacctgaggtcaggagtttgagaccagcctagccaacatggtgaaaccccatctccaataaaaatacaaaaatcagctgggcatggtggcgggcacctgtaatcccagctacttggaaagctgaggtaggagaattgcttgaacctgggaggtggaggttgcagtgagctgaggtggaggttgcagtgagctgagatcgtgccactgcactccagcctgggtgacagagggagactccatctcaaaaaaaaaaaaaatacgttaaataacaaatactgcttttatacattctgacatttcacaaaacaatttgattcaatctctgcttctttgatgctagtgttgttgcattcacaagaaacgcttcttgacttatcaattttcaacagcacataatttttacttccatctaaattaagatttggctgttgcataatctgcatgatactgtcaccagtaattttatcctgagccacaaagactcacttgcacggcaatagttttttcattgtttgtattcatcctataggagtattagtgatttgcactaggaagccacgtgctgtactgagtagcatggcttgagtatcgtgtaaggagcaatggactctgatccagtgaagggctggaagcaagaaaatgcatagagttaggtgggtgagagatggcacaaaaccagaggcagggcaggcatggtggctcacacctgtaatcccagcactttgggaggccgagggtggcagatctcttgagatcaggagttcaaaaccagcctggccaacatggtgaaacctggtctccactaaaaatacaaaaaaaaaattagctgggcatggtggcaggtgcctgtaatcccagctacttgggaggctgagacaggagtatcacttgaacccaggaggcagaggttacagtgagccgagatagcgccactgcactccagcttgggtgacagagtgagactccatctcaaacaaacaacaacaacaacaaaaaaaaaaaaaaccaccagaggcagaggaatgcaaaaagagtccgttggtatggtcccagcaagttataactagggattcaactagaccagtcatagtaggaagggattcaagaaacatttgtgaagcaaaatcagcagggcttggtaactaagtggatttgggggattagagaaaaggaaaagagagaaatgatgctgaggttcctggcttgagtgactgagtagatttggttccattcaactcttctgggtataagtaataaaggagacagagaaagctgaactgggagaaaaaagctatcaggtaatgtattctattttagacccattgaatacaagtggctgttggacagataagtaagctatctggcaagagcagggggatttcattctgacatttaggaaagaaagcttggctggagaatcaatttgggagcctgagcccctaaattctaagtagaactgtgagtctgggtgagattccaggagagaatgccaggaaaaagtggactgctgatgaaatgtagggggatagaaaactaatttaatggataggcaaagaaagagaagcccaaagggggactggtaagatgtcaccagaaaggaaggatgagaatgattaagcactgcaaatatactgagaatttcagcaaaatcatgagtcatgattttccactggatttgatgtttagtgggtcgctgatcacaagggggtggaaagtgaagaaatgcaaatagctctcacgtacctgtattttccaaagctttgttgaaaacataagaaaacaaaatggatatcaggttggggggtggggggtggcagggcggagggaagacttttccagataaaagacatatgaggctgggctcacacctgtaatcccagcactttgggaggccaaggtgagtggatcacccgaggtcaggagttcaagaccagcctgatcaacatggtgaaaccccatctctactaaaaatacaaaattagctgggcgtggtggcacatgcctgtaatcccagctcctcaggaggctgaggcacgagaatcgcttgaacccgggaggtgatttggactcttgctctcctgcctggacgcccctgccaaccttctctaccctctcaaaaaaacagagaaaataaagacttggaaggacctgaagaaaattcctcagatcatcctgttccccagctgcctttccaatctcccaccctcatagcctcccacttgctgctccccagtctggaaggttctatcctcactctctcccctcagttcatgattcaggtccctgctcaatgccttttttgaacatcctatcaaaaatactccctggtcactctctctccggccattacctcgcttttacttccctctttggttttaaacctacttggcattattacacatatagatatagatatatattaacacacacagatacatacatataagtgcatatataatataaagccaatagaaatgattttattactatttattactattttatatttaaataaaattatttaaaacataattttaaaattattttaaaaatgtaaaataatttttattattttaaaatttaaaaaactctcctccactaactcatgagcctggggcattactgttctgtgctatgcacttctgcagcctcagggcctagcacagtgtccagcacacagtaggtgctcaataaagatgtgctgaatgaatactatgaagagccaaggtagagataagactattttttttccccaaggattgcacaggatgaaatgaacttccctagcaatataagggaaaacattaataatttcttgtctaattataaaaagttattagaggctgggcgcagtggctcacacctgtaatctgggaggccgaggtgggcagatcacctaaagtcaggagtttaagaccagccaggccaacatggtgaaaccctgtctctactaaaagtaaaaaaaaattagtcaggtgtgatggcgcatacctgtaatcccagctattcaagaggctgaggtaggagaattgcttgaactcaggaggtggaggatacagtgagctgagatcacaccactgcactccagcctgggcaacaaagtgagactccatctcaaaaaaaaaaaaaaaaaatcttattagagcccagaatagatgtcaaagagaaacacagaatctcctcttgagagtcttagaaaaaaaagataattatctttctggggtagaaaaagaataaagataaatagattaaataatactgtatggttcgtttcaaattcaagagtctatttccccactgatttggggttattttttgcctgtcttttccaaatgagcaggagacaaaattgaatctcttggttccagggctaaaagatgctatcaatttctgttgattctaggtgagataacacaacgcagaaacaattggtccacaatccaaccagtaaactggataatagacaatttctgaagttttttagaaagagtgcagtgagaaactgttcagatttgacagccatttcccgcataactccttcctccaactgacttgttggatccaaaagacaaactggagggagtgagggaagggaacgaatgtagctagtcactcattgccagcatccatgtattttccagggtaggttctccaagaggcaattatgttaaatcaatcatcaggaaatgaggtcttcgtaatgatagctatgactttgatttcaaatactgtgccaatcagaatgagggcttttgttcccttgtcaaaaggatcatttatactaagttctaactaaacaatacccactaccaacttccctccaaaaagaaaagaaaagaaaaaggaaaatgaagcccaatactattgaatgaaaacatatggaccaggggccggggcggtgattcacgcctgtaatcccagcactttgggaggctgagtcaggcagattgcgaggtcaagagttcaagaccagcctggccaacatggtgaaaccctgtctctgctaaaaatacaaaaattagccaggcgtggtgacacatgcctataatcccagctacttgggaggctgaggcaggagaattgcttgaaatggggggtggaggttgcagtgacccaggatcgtgccactgcactccagcctgggcgacacagcaagactgtctcagggaaaaaaaatatatatatatagatacggaccacagaagctcaatatagcagtgagttccttagctatctatattgtacaatttgttctttaagtctcattcctgctaaatcacctgagaatcctcattggaaaaccaatgctcttcccgagtctgcaggccaaatttagggttaaaaaaatggggggttagggagggccttaatttgctatcaaaacccaaaacacacaacatgagaaaaatcaaggttagaataagttcaaaagaagatctggttcttgaccatgataatgtcactattctaatagggtcctaggaagaagagggctaaagacaccaaggaggctggataagtcccattgttggagagaaagttagtgagttctcctaggtgactaaggcacttaccaccccaataaaaatattgttttccttttagatatttcctcgatgtctgctatataccaggccctgtttgtactaagtgctagggatatacagacaggtgctgtatagtgtctgaacctttagaaccaagcagtgagtgtgatcagtatgtaaactgataaagttcaatgcaaaataaccaatgctcatgataaatagaaaattacagagggggttgggcatggtggctcacatctgtaatcccagcactttgggaggctgaagtggaaggatcacttgggcccaggagttcaagaccagcctgaccaacatggtgaaaccccatctctactaaaaacacaaaaattagctgtgcgtggtggcgcatgcctgtaatcccagctactctggaggctgaggcatgagaatcacttgagcccaggaagcggaggttgcagcacaccagtatggtatcactgcactccagcctggcaacagagtgagactctgtctcaaaaaaaaaaaaaaaaaaaaaaaaaaaggccagggacggtgactcatgcctgtaatcgcagcactttgggaggctgaggtgggcagatcacgaggtcaggagaccatcctggctaacatggtgaaacctcatccctactaaaaaaaaaaaaaaaaaaaaattagccgggtgtggtggcacgcacctgtatttccagctacttgggaggctgaggcaggagaatcaattgaacacaagaggtagaggttgcagtgagctgagatcatgccactgttctccagcctgagcaacagagcaagaccctgtctcaaaaaaaaaaaaaaaaaattctagagggaacctagaaggagccagtacctcaacctgaatgagtcagaaacgtttcagagaggggaataattaatctaagtattgaataagacctgggaggttgctaggcaatgggagaaacatctccagtggagtggtcaatttcagtgtgggcctagagagatggtgctgtagaagatgcacccagggatggtgggctgaaggtggactgggagaccgtctttctatgtgatcctataagcagcaggaactgaccagggtggtgctgtgaaggtagggcagtgttcatcctcctctccactgtttccccagaaactaacgcagaaactgatttgcttcattgattaacttaaaacagaagaatgtttctttggttacttcaaggtagctattgctagttgcattggtgggtgctagtcgcattggtgggtgctagtcgcattggtagggatgaggtgggatgtgacagaacaggcagcgggcagggaaggctgggaggcagcagggttggtgcgatgggagaaggcagcttggaaaatcattcctgagatgttagtgcacaggaagaagaaaacagccctatcctgctttgagaaccaaataaatggctgggtgcgcgggctcacacctgtaatcccagcaatttgggaggccaaggtgggaggatcacctgaggtcaagagttcgagaccatcctggccaacatggtgaaacctcatctctactaaaaacacaaaaatcagctgggcatgctggtgcatgcctgtaatcccagctacatgggaggctgaggcgggagaattgcttgaacccaggaagcggaggttgcagtgagctgagatagtgccattgcattccagcctgggcaacaagagcaaaaactctgtctcaaaaaaaaaaaaaaatcccactaaatggaatgaagaccctctaaacatgctgtttatatcaagaagagcctctgccacccttaccctaaagggaagcaaacatctgagctgccagttctccaccatccatagtgagttctctatttttctctttttcaattttctattttctattctttgagttcaaggaaagaaaattccattactttcagcaaaactctagttgagaatgttcaataaactccttctctgtgaagaatagttggaaaggggtattttatttaaccaaatactgtagttaaatgaaaattgctaatatagatcatacacaaatggccaattttgaaagaattagcgcttaataaagtgcacataatcccaaggccctattaaagattatttttaatctttttttttggtgtgcatatgtatgattcagtatcttaaactcaatagtcttcagggaatttaagttattttatattactatgaaaacggcattctggttatatgatttttgtaatagataggatttttacaacaaattttcaaaaatgtataacgtaatctaaaaccaaaaagagaacatttggggattgttcacattaatcctttttttttttttttttttttttttttgagacagagtctcgctctgtcacccaggctggagttcagtggtgcaatcttggctcactgcaacctccacctcccaggttcaagtgattctcgtgcctcaacctcctgagtaactgggattacagatgcctgccaccacacccggctaatttttctatttttagtagagacagggtttcaccatgttggcaaggctggtcttgaactcttgacctcaagtgatctgcccgcctcagcctccgaaagtgctgggattacaggcatgagtcactgcacccggcctacattaatcctttattcactcagtaaacatttgttagtgctgtaccccaacagcgtaccgaaagatgaagaaagaccaaggctgttcttcctcaaagagttcacagagggggatgcacatctatttttaataatatttataacacatttgttcattgtaatgacagaagtaggaagagaaacacagatgagaaaatgctcaattttgcctgtaccagggagtgagggaaagggacatgggaaatgacgcttaagaaaagtcctcacagccaggtgcggtggctcacacctgtaatcccagcatttggggaggccgagtcaggcggatcacctgaggtctcaggagttcaagaccagcctgaccaacatggagaaaccccatctctactaaaaatacaaaaattagctgggcgtggtggcgggcacctataatcccagctactcgggaggctgaggcaggagaatcacatgaatccaggaggtggaggttgcagtgagccaagatcatgccactgcactccaggctgggcgacagagtaagactctgtctcaaaaaaaaaaaaaaaaaaacaaacagaaaaacagaaaagtcctcaagggtgagtgagagcactccaacaacagaaatttggaaaggaccaggaagcatggaaaccaatttgggagctcctgtagtaattcatggcagagatgatgaaggcctgaactgagaggaccccagtggggacagacagtgacctgctggacatcggaggtgggaaaaggaagccatctgcactgtgctgtctaatatgagaaccacaagccacatgcagtcatctaatataacctcattaaaacatgttaaaattgaaatgaactcagcttgcactagccacacttcggggcttgatagacatgtgaagctagtggcatctgtactggatggtacaaacagaacttttctattattacagaaagttctactgtacagcagagccaagtgtttggggcttgagataagtagttgaacgttggtacccctaattcagaagaaatgccagagaggcaacgggtttaggaggagccgatgggttgagtttgggatgagctgagtttgaagaaagtctaatatcatggtgatgtcaggatccttgtgagttcagcatctcataagcgacagcatagtgagggtcctggtttttagcctcttccttttctgaaacaaaatccaagcttcaaaagctaacctgcatgcctgtgcctattagagggaaaacaaaaacaaaaacaaaaacaggcggcaagggaattcggtgtggagttctaaaagaagtgtgggcggctgacccagagttgggagtcagtggtatactgagggtagttaaagtatctcacagagaaaagattacccaagagaagaggggtggaaggtgagacctggaggaaggggtaaaagcaacaggtacaggacggctgggggaacaggatccacagaaacgtaggagagtctggaaaaaccccagtcaggaaggagatggggagaaacaggaacaaagtgtcaccagtaaagcccaggatgaagagaagggggaagagccaagtgaactgaatgcagcaggaaatctaataaggcaccaaaaagtgtctggtgcatctggcaatttgggggccacctcagtaagaccagttccagtggacagatggtggaaagatacctgcgcacatagacacgtggaaggaaatgcttgtttttcaactggccgcccccaaagacataaggatacactgggagctcctcaaggggctggagcatccgagttcatgagcaacacagagaattgatcaggacgcttcaggcctcccggcgcatccactcagctataccgctgctactggggaggaaatgtattgttgaccatgttagcactttagaacagcccccagctggtccccagaggagggaaggcatgaatttctgggcttctcccctgaacaggaccagacccaagaatcttagtgaaacaaatggtgaaaaacttctgctgtgacatagaggcagggattctgatttcattgaaaactcttcagcttgtcagagaaaaaaaaagacacacacacccagtcatacacacatgcaagcacatgcatatacacagtgcatacatgggcatgcacacatatatgcatgcacatacatgtatacatgcattgtgcatatacactcacgtagacactcatatagatattcatacattatgcaaaatgtgcacacacgtgcacatacataacaccaccctggttctcttttcttttctgcagcggcagaaccaggtcaagaacccacgtctcctgacttcagaaccctcactctttcccctgcagcagttgctcagggaggcgactgccaagaggaagcagatgctcttgctggagcaggaggagacccttcggggactatgcaagactcagcctgaagtgggtgccaagtgttcagaactgtttaagtaaaagccacttgaccgacccccatcagcccaagtaattcggctgcactctcctaagctttatgcaggaactccgctggctcttaataaacccaaataggaacaaaagaaaacgtgatgactttcagaggtggacattagctgtgctgcgctgaaggatgcctgggctagatcctgcccaggtctccaggctcggtaaaagggcagctccatttccccagcagcaacccccaccccaagcccctgctgtaccccaccttgcccctcccctgccaccactcttgctggggtggaaatacagggtaagaaaaaaggccctaaggagtccacctgccaaacccaactacagactgaagcccactttaaatttcctatcctgaaaccaacaatcgtaattatttacattgtttttttaccctcttaagtcccattttctttgtgtttcatcatcatttgaagtggggagcgaaggaatcttatggaaaggcaagggtcggatagacttgatggcctgtctcatttcccctcattactctaacaccacaattcctctccggccacattcaccacttataaagtgctattctcatcatcaggattatagcaatgggcaaatcaacgaactggggaaaggagacagcagcaaggaaaaactcatgtagcagaatgctgagggagagaacgacagcaggggccgggcacggtggctcatgcctgtaatcccagcactttgggaggccaaggtggacggatcacttgaggtcacgagtttgaggacagcctggccaaaatggcgaaaccccgtctctactaaaaatacaaaagttagccgggcgtgggggcaggtgcctgtaatcccagctacctgggaggctgaggcaggagaattgtgtgagcctgggaggtggaggttgcagtgagccgagatcacaccactatattccagcctgggtgacacaacaagattctgaaaaaagaaagagagagagagagagaaagaaagagagagagagagaaagagagagagagagaaagagagagagagagaaagagagagagaaagagaaagaaagaaagagagagagagaaagagagaaagagaaagagaaaagaaagaaagaaaaagaaagaaagaaaagaaagaaagaaagaaaaagaaagaaagaaaagaaagaaagaaagaaagaaagaaagaaagaaagaaagaaagaaagaaagaaagaaagaaagaaagaaagaaagaaaaagacagcaaggcaaggagatggaaagtggcctttgggagaaggagctcacttcccagagagataccatttgagcaaggatgtcaacaaaggaggaacaagtcgtgggggtatctggagggaaggaagggcaggcatcagggttctgagaaggagggtgccaggattatgaggatgcaggattatgaggatgtatgaggatctgcaaggaggccagtgaggaagagaaagaggaatgaagggggcgggctggggtgacagtaaatgagtccagaggggcagccaggaccctgatcctggaagtctatggttaggtccttggacttggctctgacacaatctgatttgcacttttacagtcactgactgctgggtggagaccttactgcaagagggaaagagtgggggcaaagggatttgtgaggggggcaggcgcgccctccagggcagaggaaatagtggtaagtaactaggaatgattgatgggtgagcacttcaacagcatctgcagttattaatgcaacaacaacaaacaacggcatccatgctgcaggtgtttccgagtcactgtgctgggaaagcagacactaatcatgaaacagcagcaattacagagttcagcatctcacaggcgacagcacagtgagggtccttgtttttagcatcttccttttctgaaacaaaattcgagcttcaaaaggtcacctgcatgcctgtgcctattagagggaaacaaacaaacaaacaacaaaaaaaaaacacgaaaaaaaaacacgatgctgccctccagaaggattatgttgcaggaggttgcaacgctgaggaaacccatcagaatatcagcaatgctgttaaactgaaaaatcgtgtccaagtgaagtcagagagaaatatttctcctggtagatttatgaaaacgaatgccaaaaggcaatgaggtggcctcggcagctggaattccactgcaggggcctggactgcgggagctggagcgcatgggaagtgatggacgtctctactccaggaaaagggctttgctcattgacccacaggcccctgctgaggcgaaggcccactgcatcctggagatagtcagtgtgtggctcagtgttaaatcctaagacaattagaggcgtgggttgtgggtggaaggcagggactggcaacagagccctgccctcttgagctctgagcaaacatataaaatcaggtgtgtcctgtctccgtacataagaagtagagatttgggtacggtacagatgaaaacacccacctggatgggccgggaaggcagaccacaggagagaggctcgggtttggactataactggatatttgtgtgaagattcaccactgtcttccccagcagactacaagttctaggagggcagggccatgtccgccagtgcacactagaattaaatatattcccagcagacagcagaatgcctaacacccattaagcttttgcataaacaccagtggcagtgagttgaatggggtcccctctaagattctgaattctgctcttcaacactgctaagactcttaacagggttgattatgggaacagatgctggtggctcacccaacctatgttggcactgtgctgcatgcatggggccctgagataaagacacagctagggcctccctggggaacaggaaacagggtctttgcagaggtcataaagataaggccatcttggattggggtgggcctcaaagccagtgatggtatccttataagaagaggagaggccgggcacagtggctcacacctgtaatcccagcactttgaaaggccgaggcgggtggattacctgaggtcgagagttcgagaccagcctggccaacatggtaaaaccccgtctctactaaaaatacaaaattagccaggcgtggtggcacacgcctgtaatcccagctactccggaggctgaggcaggataatcgcttaaacctgggaggtggaggttgtggtgatccgagatcatgccattgcactccagcctgggtaataagagcgaagctctgtctccaaaaaaaataaaaaggaaaaaaaaaaaaggaagaggagaggacacacagaggccaggcgacatcaaaagcagagactggagtgatgcggctacaagccaaggaatgctaaaaatagctggggctaccagacactaggaagaggcaagtaaggattctctccttgagccttcagagggagcatgggtggccctactgacgccatgatttcagaccgatggtctccctgagaaaataaatctctacggttttaagtcttccaagtttgtagtaatttgttaacagcaaactactccataggaaatgaatgcagttgctaagcgaagaataaatgaataaacaaatcaacaaagagatggctggtccataccagcatgccaagagcaaatatctatagatagaataaccggacatactttgaaaaccagcaagggaaacaataggcttaacatgcagctggtggaggtaaaccaggtgtacaattagcttaacaaccagtgggtacccctctggtttcttccagtgggtacccctctgcccaggaggaacactcagtcccaaggcctttttccagcaccattacagaactattatagagtggatcttgccttgcaaataagggaaactcagaattattttgttttttgttcttcttagtcaaagatgataaattgtagttagaaaaaaaagtcattaagaaattccattgaaataggccgggctcggcggctcatgcctgtaatcccaacactttgggaggccaaggtaagtggatcacctgaggtcaggagttgagaccagcctgaccaaatgatgaaaccccgtctctaccaaaaatacaaaaaattagcagggcgtggtggcaggagcctgtaatcccagctacttgaggaactgaagcaggagaactatttgaacctgggaggcagaggatgcagtgatccaagatcagggcactgcactccagcctgggcaacagagcaagactctgtctcgaaaagaaaaaaaaaaaaaaaaaagaaattccatcaaaataaacaagaaagggccaaaggaaaaacaagttcttcttcttggatggatcttcaacaacaaaagcccattgcagcccctgatgctgggtctctctgaggcacaactccatctataatactcgctagttcctaagaccccgattcagacataagaaaaataatcaaagttgctcacgctctgtagtgacctcttgcaataggtccagccactgtgactctctcaaaggtttatttgcagcactgtgaccgtagaggccccagccagagcacagaggggcagccaagcccccgggtaatgagcagacacaaagtctcacagcccatgagcaccaggtcatttatcttcctagttttgttcattaaatttgaagggggaggtggagagagaagataatggaggaaatcaatgtgaatttttcaaagtaatcgggcttgattggtctttttatttgtctaggaaggtctgtctgcctagaggactgggagacaaaatatcctgaggtctcaataaccagcctcctcccagaaccggaaaactcaactgcccttgccctaaaaccatgccccacctccctctcaccctgctatatgcataacaggagcaagtgagctcctgggcaggaaaaaaagtctgcaccctcctgctaaaactcttaatagtgctgaagacgggaacagatgctggtcactcactccacatgggccaggcactgtgctgtatacatgggaaccctgagatgaaaacacagctagggcctccttcctcagtagtcattactgctagggagggcagatgacacagaaactgcagtgacagaggacactccctcaaaagcggtgagcccaagccgggcgcggtggcacacacgtgcagtcccagctacttgggaggctgaggaaggaggaacatgtgagttcgagagcccaggagttcgagagcagcctggacaacacagtgagactctatctctaaaaaaacaaaaagaggtgagcccagagttggaagcctggggacgattttccagtaataaaggggaagggcatttcaggcaaaggaacccaacacgttcagtctccactgaattttcaccatacagtgtccaaaataaggaagagcggccacagacactctttggtggtgacaaagcaaatcctatcagcttcactctggtctgcatggcaagagtctgtcacctagacacagccactctgagcaggtgcagggccactctgaggaatgtggtgaagggagggctcgcctcgcagcaacaaggaaggtcccagagcaccccaggcctttgccactgaaggaatcctgagttggcctgaggaaccctctgggctctaactgggccccggtttgtttctttccttctcaggtggcactgacgggccaagggattcaggatctcagagcgagaattacttcataggcatgaaaagccttgtgatataagtgattctctcacaaatgtggtccccgaaggtgggcaggagggcatggctgcattacagaacctttccccctcctggaaaagctcaccagtcccatcagcagggatttctttactcaagaaaagatagcacggctgggcacagtggctcacgcctgtaatcccagcactttgggaggccgaggcaggcggatcacgaggtcaggagatcgagaccatcctggcgaacatggtgaaaccccgtctctactaaatatacaaaacattagccaggcgaggtggcgggcacctgtagtcccagctacttgggaggctgaggcagaagaatggcatgaacccgggaagcggagcttgcagtgagctgagatcgcaccactgcactccagcctgggcaacacagcgagactccatctcaaaaaaaaaaaaaaaaaaaaaaaaaagatagcacaggccatgattctcctggagaatgaccagtatgaaaatagcagtgctttgtggctggatggattctgtttctgtttcctatttttttttttttttaaatagtgtctaggccaggcacagtggctcacacctgtactcccagcaatttgggaggccaaggcaggcggatcacctgaagtcaggagttccagacccgcctggccaacatggtaaaaccccatctctactaaatacacaaaaaattacccaggtgtggtggcacatgcctgtaatcacagctatttgggaggctgaggcagaagaactgcttgaacctgggggacggaggttgcagtaagccaagatctcaccactgcactccagcctgggtgacagagcaagactctgtctctaaaaaaaaaaagaagacaaggtctctcttggtcacccaggctggagtgcagtggcgcaatctcagctcacggcagccttaacctcgtgggctctacccaacatctactgtcaaccctgacccctgcaactgccactcctggcatgaagaagaactcaactctttttttttttttgagacagagtctcgctctgtcgcccaggctagagtacagtggcgtgatctcagctcactgcaagctccgcctcccgggttcacgccattctcctgcctcagcctcctgagtagctgggactacaggcgcccgccaccacgcccggctaatgttttgtatatttagtagagatggggtttcactgtgttagccaggatggtctcagtctcctgacctcctgatccgcctgccttggcctcccaaagtgctgggattacaggcgtgagccaccacactcggccaaagaggaccccaactcttgacgctcttttgggttcacaacgagctagagtagagcaaaagggccagaatgaggagtctggttagacaacacctcaaaagttcctacaagtcacatgggagagagggcagatccaaggagctccacaatggcaaaggaaagcagatgagaaactggctgcggccaggtgaccagaccccattcaggagtccacgggagaagaggaggaagtcagccagaggtctgagccacaaatggccaggaagccaggccaaggagtctaaaatagtcaggattgagagacgtgggcaccacgggtgagaaggacacctgtgcctttgcaggcagtgtttcctcctgggcttccttcctacccaaaaccagaacggggcttggctgggtctgtgcacacagttggaaacagtggacaagtgctggcacagagagctggggaggtggatgcaggcaactcctgacccagcacctggaatgatgcctaggccaagggtatttcagctggcctgccttgctgtgagagatatacactgaatcctcctgactccaactgatgacagaaggcaactcacctgaaacagaccttgtttaatgaaacagggctttaatggacaaatcagcataacatccactggcagaatttccttaaacaaatccgattaaaggcccaaaatcaaaatacacttaggtttcaaatgatgctttccctggacagcaaacttcatagatcactatgatgtgtcttatcttccacctgcttacactcacctggaaacctgccttgttaaagtgtacgagaacatggagaccacccttcaagtcacaaatcctgccagcagtgctcctgggccagctcttgcaccggagatcagggctgcctaatcaaagcatctgctccttcctggaaggctccaacagccaattccactaaagcataaggcactgaccatcccagaagaaggaaaatgggctgattaaagtcccacaatcaccagaggagataagtgggaagagagagctggcatttaggaagcagtgagatatttcctgtgttttcacacagcgagtccctcctgctcatatctcttcctgtcctgctggagagcacaaggaaaacaccatcagaaatgaatgagtcacgcgctgggtgcgggggctcagaactgtaatacctgcacttcgggaggccgaggcgggcgcatcatttgagctcaggagttcgagaccagcctggccaacatgatgaaaccctgtctctactaaaaatacaaaaattagccaggcacagtggcacgtgcctataatcccagctactcgggaggctgaggcacaagaatcacttgaacccaggaggcggagattgcagtgagccgatatcacaccatggcactccagtccacgtgacagagtgacggagcgagactccaactcaaacaaacaaacaaaaataaatgagtgaatcaggaagatggtatgagacctcctgcccatgtggagcgggcagaacttaagtgggaacctgaaagatcttcctgcctcacagaagttctgaaatagtcatcctttctcgctttcctccccagaaacaacaaacagagtcaactgctccttactccagcccacctccatcccactccactcaggtgatccagttccattccccttaaatgggtccatgcagaacctcctactgcagataaagccaacaaccacatgacacatgaaacccacagaactctgcagggaaacagtctgcacccatatcccacgccacagactgcggtgcacagcatggggcagtcaccaaagcggggcgtaggggagaagtggaaggaggagacaggtcgttcctggacgtgggaaggggtagagtgtgttgaggtgagcaggggcagggcacagaggagaggacagatacatcacttatttacagcttggctcttgtcttctcatgggagcactccaagccttctatgatgtaggccttagttcctccttctccctgaatgtccctttattctgcatgtgccacaagtgagacatcaggctatgttctggcatccagggcccgtcccttcagtggccgtcctcactgaaacccaaggcttctttagccagcgtccaggccaggtgctctctgcctcctgggatgttaaccagccagcctaataaatccacaggtgtgaatgggttgaggctgggggcctccactttttctcagataaagaatattttatcagtattcttttggtggcagggagcaatcctgggagagagattttgggggtaggtaaagtcttacagcctccttcaaatcgctgctgcaacctgctagccacacacacagggccaggctggccacttcggggccaaaacaacacggctgcatctgaccaagacactatgtgacttgcgacaggacactaccgtgccgtctctgccaagggcaggagaactgtccagagagccccggcttgccaggctggttctccatgaaaacaggtcacacaggccatcgaggcggatgggtttctttaggaggattctgaggaagcgtctacagcccatggggtgaccaccagtcagtaagggaggagacgggcatgctgtaggggtgatgctaggtgcatgccaaataccagagggcaaaggaccccagcatggtgtcattatatgggtgaggccttcaccccaaactgccagggtggcaaatcccaattggatgggtagaaattacctttaactgccccacgctgacgcatgactgtatctccccagtcaaacaaggatgctggccagagaaggttccagatcttatactatgaccagggatgtttccactccctctccaaggcacgggagccaagcctggtcatctcacaggatataaagattaaccaacaacatccacattcaaacggaaccccaaagctaaacagaggtatctcaaaaccatacctttcagacaacagaaataatctcagagaaccgtttcctaagagcaggttgcctcagagtgcattctggaaaaatctttttgttttgttgttttttgggagtcagagtcttgttctgtcaccgaggctggagtaaagtggggcagttatggctcactgtggcctcaacctcctgggctcaagcgatcctcccaccttggcctcccaaagtgttgagattacaggcgtcagccattgcatcccacccattctggaaaattctaactggtccagtaggtatgaagaatgcgattctggggagagtcacgttgcctgttagcaaattaaccttagaggggtcttgcacttcagaaacacattgacttgaatcccattttccaagctcacttgaccactcattattagcacccatcagacgggtctccatgcaacacgctctggagaaagcaaactggaaaattacgaagaaagaactggtccaggggttcttaagctgggcttcagacattcaggaactgtccaaaatcctaaggaaaaaaaagaactgtctatttgtgtctttttgttagggaagaggatcctcagcttccacaggttcccaacagggctgtatctgccaaggtgaagaattgttgatttatgccaaagtcctcactcaccaatcaggaaacagaggcttgcagagccagtttgctcaactgtctttctttcttttttttcttttttctttttttttttttgagacggagtctcgctctgttgcccaggctggagtgcagtggcgtgatctcggctcactgcaacctccgcttcccgcgttcacgccattctcctgcttcagcctcccgagtagctgggactccaggcgcccgccattacgcccggctactttttttttttgtatttttttagtagagacggggtttcaccgtgttagccaggatggtctcgatctcctcacctcatgatccacccacctcggcctcccaaagtgttgggattacaggtgtgagccaccgcacccggcctcctcaactttctatagcagttacagcagaaggttggactggaacccagatctcctcaattctatcacaacatttttagtcgtaagttgtttgccaaggctgatattacgaagaggggaggtgggaagggctgaaaaactacctgttgggtactacgctccctatctgggtggtggggtcattcatacccctcagtgagtatcacatgatatactcatataacaaacatgcatatgtatctcctgaatctaaaataaaagttgaaattatttttttaaaaaagtaaaagaaaccgggtgcggtggcccgtgcctgtaatcccagcactttgggaggctgaggcaggcagatctcttgaggtcagaagtttgagaccagcgtggccaacgttgtgaaaccccatctctactaaaaatacaaaaattagccaggcgtggtggcatgcgcctataatcccagctactcaggaggctgaggtgcgagaatcgcttgaacctgggagatggaagttgcagtgagcagagatcgtgtcactgcaccccatcctgggcaacagagcaagactccgtctcaaaaaaaaaaaaaaaaaaaaaggctgggcacagtgactcatggctgtaatcccaatactttgggaggccaaggcaggcagatcacttcaggccaggagttcaagaccatcctggccaacatggtgaaacctcatctctactaaaaatataaaaaatagccgggcgtgatggcaggcacctttaatcccagctactcaggaggctgaggcaggagagtcacgtgaacccagaaggcagaggttgcagtgagccaagatcacaccactgtactccagcctgggcaacagagcaagactccacctcaaaaaaaaaaaaaaaaaaaaaagagtgttctttgcatcagaataataccaaccatagcaccacactttgcccagaacctccgtgggacttctactcacaactcagtataggttcttttttcttgcttaatacatattaaaacccacttataaaacaagtaacagagtaatcacacctttataaatagaccttccctgtacacataaaataaaataatatcgctgcctccaccatacggatttagagatgaaccagttttttaaaacactcataggtgggaattgaacaatgagaacacttggacacaggaaggggaacatcacacaccggggcctgttgtggggtggaggaaggggggaaggatagcattaggagatatacctaatgttaaatgacgagttaatgggtgcagcacaccaacacggcacatgtatacatatataacaaacctgcacgttgtgcacatgtaccctaaaacttaaagtataatttaaaaaaaaaaaactttacacaaaaacgttctctttttacacatctcgtggtctccctcacatctgcatctctgtagtttgctgggtcctgtctggagtgcccttaccctcccgacctcccttttcctgtcagcctcctcgttctccttccgctcgcccaggcaatcttctgtccttcctaggagaggcagtctgattctgattcttctgtgaagaccaccctgagcacatcaaacaaaaccaaaccccacctcaaccattctgagcccaggctggagtacaatggtgtgatctcagctcactgcaacctctgcctcccgggttcaagcaattctaccacctcagcctcccgagtagctggaattacaggcacacatcaccatgtccggttaatttttgtatttttagtagagatggggtttcaccatgttggccaggctggtcttgaacttccaacctcaggtgatctgcccgccttggcctcccgaagtgctgggattacaggcgtgagccactgcagcctggcccagtttggaaatttctaacaagcagttgaaaatgcagggctggtgctcaagaaggcgttctgagcaacgtgatgggatttgggatgcacaggcacactcctggtgggcattggtgctgcaggcatgaaagatgttacccaaggagcgtgccaacaccaaggaaaaggaggaggtttgaagagagccagacctgggtttaacctctggtttttctagctaataaatgagcagctaagtaagcctctctgagccccaatctcctcatctctagccagtccaatcctatgatatggaccctgcagaagcctggagagctggaacttcacgatgtctacagaggacctagtgcagtccccaccaagcaggaggcattacaacagaagccacacacagaagacctcaaggcaacaggggaatctggagaaggtggtgccccaagtcagaagagaaagtggctgttaacattatttacattcttaggacaatatcttttttttttttttttaagtgatgggggtcttgagccgctacccaggctggagtgcagtggcatgatcacagctttctgcagccttgaattcctgggctcaagtgattttcccacctcagcctcccaaagagctgggagcctgccaccacaccaagctcaaggtcattaaaggtgcaagacaggatccttaatggtggcaacttcagtaggctgacggaggagaacctgagggtacgggggtgaggaggaaacaccggaccagaagcatcgaccagagcagagcatctcacttggtcctgcctgtgccaaggacaagctgacatggagaaggcagaagatggaatcaaaatgtcagcaattggcatgatcttacaccccagccctacttgctcatctccttgcccagaccctgagctgcgcccccttctttgaccttctccccatccctcttgctccattggcaatcggctcaagagtgctgactcgagagacagctgaaccccaagagctttccccagatgtggtgtcaggacggtagcaaaatatataccatttctgcttttttaaatatgcttgggtattaaagtaggaataaaacaatcctgatgtttccagcaatttctaaaaagtcctgatttatactctgaatgccaaatgtccagaatataatatgccatattatatactggtgtagactagagaaagttagataggaggtaagagggcaggaggaaagaaattggagggtgtaggggcaaaaaaaaaaatccttttttaatttttttaaatgggaagccttgggcatctttataagctgaatgaaagaagtcgacacagcggacactgtcataagtggaacaaaggatgaagctaatcatggaggcaagctccctggagagacagggacaaaatcaagaatgagctggagaaattaatcctggagaaagggagggacctgacttccttgaaggcaggcagccaggaagtaaagaggaaggaaaaatcaagatacatttttggcaagggggcaggaagtggatggagtctcctcctgggatacccagtttgctcagtgaaataagagatgacatcatctgttgagaaggaaaggcctaaaggataaggatgaagtagggggtagggggagagaggtagagatttggactaatcaccgtgggaaacaaatgagagcacagcaagtgtatgttagaggtctgaggactcgcccaaggctcctctgaggttgcggaccatgaacttgacatgaagaccctctgtggcatggtggggttatctgctagttctccagaaatcaagatacttcttttatcagagaaccagggtatctgatagactctgtatctcagtctgcatgcaacagaataatcttctgttctatattcttcaaacatctccagttcccattgacaacggtaatttttaaatgtcaaaaattctgaatatcagcatcagaaagttaaaatatgcagttgccaaagaaaaagaaatccacatacagttggccctctgagtcggaacccacagattcaacctaccatgaatttaaaataattgaaagaaaaaaaaaggctgggtgtggtgatgcgtggtgactcacgcctgtaatcccagcactttgggaggccgaggtgggtggatcacctgagatcaggagatcaagaccatcctggctaacatggtgaaaccctgtctctaccaaaaatacaaaaagttagccaggcacggtggcgggcacctgtagtcccagctactcgggaggctgaggcagaagaatggcatgaacccgggaggcagagcttgcagtgagacgagatcgtgccactatactccagcctggacgacagagcgagactccatctcgggggaaaaaaaaaagaaaaaagaatacaaaataacaatacaataataaaaataatacaaataagaaacaatataactacttatatagcagtgatatagtattaggtatgataagtaacctagagatgactgaaagaatatgggaggatgtgcatataggttatatgtaaatatgatgccattttccatcaaggactggtgcatctgcagatttcggtatccacagggtcctggaactaataccccataggtactgagggacagttgtataaaacgttgaataggccgggtgcagtggctcacgtctgcattcccagcactttgggaggtcgaggtgggcagatcacctgaggtcaggggttcaagaccagcctggccaacatggctactaaaaatacaaaaattagccagatgtggtgacagactcctataatcccagttacttggaaggctgaggcaggagaatcacttgaactcgggaggcggaggttgcagtgagctgagatggcaccactgcactccagcctgggcgacagagccagactctgtctcataaataaataaataaataaaattgaatatctgtgccttttgtttgcggtggtttttggttttgattttggtttttgccaatcaagtcattcccctgtttctgctttagtggcacaggctggggccactttgtttttcattgggaaaaaatggattttctttttattcatggatgttcgctgtcctgaccggagcctcccgggtatctcagttgtacccaaccttgagaacctgttgtcatacccaccccacgtattaatcatgttacagacccagggggagactgcctgtcccagggctaggtaactcctcaagagaggaaacagcttattctgaagatgcctctcctgtgctagccaaccacctccttatcaaatgctcacaccgggacactatttctctcgcccaccatccacccaggcccaggtaccagtcaactagggacacccctgtagcccaccagaattgttcaaactagctcgttttaatgctttacctaattgttaccctgccctgcctcgcttttcctgagaaaatcccaacaaaggctctagtcccggctttcccctcactcttctgcttcctggtgctttcctgtggcctgtgtggtacaacgtgggcctggcatgacatggcagtgtgcccccttctcttgggaaatgcaactcatacatcctcacctccataaattaaaatcatgtggatacaagtgagacatcccactcccaatcccaaccgtgctggcctttctccagcctttcccctgctacctgtcatcgggtgtttagctcatatgctagcaccttgggaatcctggcagtgggcgaaagccgagccagtctgacaataaccacaaaccaggggcccagatggtcccacgcctcgtcagcctggagcagctcacatccagtagctcctatattcacacctttgtgactgctatgaagtgaaatgtccccgaatccattttttcaaaagtctgctaagtagacatttttagggaaccttcgctttcttttcatgtaaatagaaaccagccacctacacccacacaaccatatgccaaagtctggtgccatctactgaaacacacatccacacgtctggccgtacccagtaatactcgagtacacaaaggagatctggccttttgttttacaagaagggattgtgtgtggagctgctccatcttttggaacaaagagaacttctgctcaattaatgagcaaatgctggagttcactgcatttgagcactccattaatctcagcactgcattcacctccaagacacgacattgtgagctgccctcacagcagtgaaatgcgcgcacacacaggcacgttacacatgcacacacatatatctgtacacacaaacacacaaacttgaaaccttctgtcaagagggaaaaaagagaccttaaaccactatttgatcaccttaagcataaatgaaaccatacagccctaactcttgccacactggctcgggcaggctcttacacggttcctccaatgagcacagctgggagtcctcagggccagtcccaggagttcatcaaagtccattgcacgcggtcccttccatgtctattatggtcctcttctgaatgggaggcagccacacccagctgttaccatggcagcagctgggcactgctgccacttttccaggatgtcactgtaggaccaccaggcctacatcctccttctgtttcacaaaccctctcttcccctgccccccaaccatcctggccttagtacttgggcaggaacccaacagtcaaaactgcaccagtggccaagttcgagagatacatcccagccttcctctggccactgaagccacattcctgggtccatatataccctattcctctttaccaggcaaggactctcccaaaaggcttccccatctccctccgcacctcaattcatggcaagcccacccaactcattgaccaaacatgcccagacagggctgaatccctctagcagactcaagctcaagctaggaatacccacacgttccacacacatagggagactttaattaagactgtgatgcaattcatacacttctgaaaacatttgcaaattaaaaggaagttggagagggtaacagaaaggaatggaccagtacaaacgtcatgatttactgggggatgaccactctatcttcagtgaccagataggaagtggtccaccgcttggtaaaaggacacccagcgggggaagaataggtccacattccattgagataccaatgccagttcataacaaacacagctgtttcccatcacctgccaactcaagatgcacacacgtggttaacacacactctcttctccacttctctcttctccacttccggggttgggccctgaaatcattctgctttcccagcatttgctaagcatctgtcaggcgccaagcactgtgtctgggctgtggattcaaaggcaaggaaggctggatccctgctctctgggatttatctcgcggcaaaatgctcctacctaaatggagttgggaggaaactgcgagttggggaaaatcactagagggaagaagtgaggggggatttgggaacacctggagcatgtgagggacaaagagcatgaccacttctcaacagagcagctaacaggggagatatacacagccagcaagcagcatgcaagacactgaaatgtctagaaatggaaaaagatggacaagaggagggaggagacattccaagaaaaaaatttcatttgcctgacaatttaactagggcccttgtgacatgtggacgtcatggaaatccactggctgctctttattgggctgtgtacaaaataaaagtgggcaggaaccactgtgatgtaaatatctaacatgctaagtgtccaactgagttattatcagtaggtcaggattaatgagtgaaggagctgcgttgttttctccagaagacattcttgagctgattcatctgaacagactccatctcctctgtgaccaccagctacctacagcaggaaggtctctgatgaggtgaggggttaggtgctataggtggccaaggaacagaatgaaactaatgggatccaaagacctcacctcatcggcactgttacctgccaggggcagaacaaaaagaccagggtgcaacctaacgagctgaacttacgagattcgtgggccatctggtgcttattatctctcctctacaggactcattgtccttacctgtaatgtaagagcactgagctggctaggcgtggtggctcacgcctgtaatcccagcactttgggaggccgaggcgggtggatctcctgaggtcaggagtccgagaccagccaggccaacatgatgaaaccttgtctctaccaaaaatataaaaattagccaggagtggtggcacatgcctgtaatcccaactactcaggagtctgaggcaggagaatcgcttgaacccgggaggtggaggttgcagtgagccaagatcgcaccattgcactccagcctgggcgacaagcgtgaaactccatctccaaaaaagaaaaaagaaaagagcactgaactggatgatgatttccaaggtccacttaaactcctaatgtccctgattcacaccttgcacccacccagtctcagccagagccctggcgcaagacagtgctctcaggaaatgttgggaggaaagtgagtctattacaaccagcatcagaagaagggtaaaaggaaggaaagaatgtccctctcaactggccccagctttcccaaaactctgcctttggcttgtgctgcacagatgacaaataactgttataaaacacatttataatccagcaacagtcagcctgcggagcacctcaaacccaaagaaagaagggcccccggccagccttataaatcatgctcgaggctgggcacagtggctcaagcttgtaatcccagcactttgggggttgaggtgggtagatcacttgaggtcaggagtttgagatcagcctggccaacatggtgaaaccccatctctactaaaaatacaaaaattagctgggcgtggtggtatgtacccataatcccaactactcaggaggctgaggcaggagaactgcttgaacaggggaggctgaggttgcagtgagccaagattgcaccactgcactccagcctgggtgacccagtgagactctgtctcaaaaaataaaataaaataaaaataaatcacgctcataacccaattcggacctccaaacctggtttaataaaatttgcctctccacgtgattcattctggagcatggttatacatttgttaatgtgccacagcatgatcttgaaaagttggggcatagaagagtgtgccgaaagacagtctctgcccactcttgctgataataataataataataaagctatagaataggaaatgggtaagccatttggaaaaacaaaaaaacagaaataaccaagcaaaccactttaccatgatcataaaggtgaagaaagagacagggaagagaaagggagagaacttggaccacagcaacaacgatgaatagcgtagaggggcttttgatgatacctagcatgtggggagctgagaaattgatctgcttcccagaagtaaagagaaggtgaggaattgaaaacccaagggaaccgggcgtggtggcgggcgcctgtagtcccagctactcggggggctgaggcaggagaatggcgagaacccgggaggtggagcttgcagtgagccgagatcgtgccaccgcactccagactgggcgacagagggagagtccgtcaaaaaaaaaaaaaaaagaaaaaaagaaggaaacccaagggaagagaagccagaaccctctgcctgtgatgatgaccccgcgtggggtggagacagagctgccagggtggtcgggcagcacggccaccacagctgcatctctgatgctctggttaaccccagtgccctgctaggaccacaggctctggctggaattcactttcggagagccgggtggacaagcacaaacgtggtcacaatgaatttcaaggacttcttcgaatgcctttattactgcggaaattcattgcctgaatgatgtttgagatcaatggactgccagctagagcttgggttgctttctcttttgggagaaactgcagtttcaatagattcggctggtgtggccgttttcaaaagggctcctctttttgtgctttcgctaaacatttaataaatttatgatttctctgtccaccaaacacggccagaaccactttagacataagtggaaattcaacagggggataagggaaaatgtcctccctgctgcaatctatcccaacacaacagccagggtgatcctctttaaactgaagtcaggtcacgttcaaacgggaagcctcagcacaaaagccaggatcttactaggacttctgaaggcttgtgcaagctggctaccattttatttcccccttcctcttctaccattctctgcttgggcaacccctctttctgactcttcttgaacatgccagctctgccccacctccaggcagtgacacctgctgggccttccacctggaatgctcttctccccaaatatctgcctggtttggtccttcacctgcttcaggtccttatagaaatgccaccttctcagatgttccctaaccatgctccctaaatttacaacacttaaaccccatacacacacaccctcttcccaccccctctacaactacaccccatacacacacacacacctcctacccccttacaccatgtacaccctatacacaaacacacttctcacccccttacaacacctacaccccatacacacacttcccaccccctctacaactacaccccatacacacacgcatacttcccaccccctctacaacacctacaccccatacacacatgcacacttcccaccctatctataactacaccccatacaaacatgcacacttcccaccccctctacaacatctacaccccatacacacatgcatacgtcttacccccttatctgctgtttctttctccttagcagtcaacaccatctaacgcactatgtattttgctcatttagaactcattctctgtctcctccactggaatgtcggctctctatgagaggggactttcatttcttgttcttattcttgcatttgtttgttcggttggttggttgataggctggctactacagtaatgtgcagtgcctagaatgtgccaggaaacacttaagaatttggtaactgcatgaaatgaatgaaaaagtaagaacacaagcccagcatcttgctccttcccatgacctggcttaacaaaccataggactatgcttcacgagaacctgctgctgatgctgcacttagggtcaggatttggagagtgtgacaccgaaggcgagagttcttccacggggggatcaactggtgatactgaatcagaagacagtgagggcaaggaaagtgaatgggactagtagggtgaacacttgtcacagaaagactattatatttcctagaaaatgaaaacagctacaacctaaagcatgcctcagtgagcagatcagagtggagaggagaaaaagaaaaagaaaagcaaagaataattatagtatgaagaatgcatgacatctgtgccttctcccaagagactgggcctaaggaagagcctgaggacattctatgaaatgctgaaatcatatgcagaattttgcaggaatatgcatattgctggaataaagatccataactttcaccagcttctcaaaatagcccctgatcgaaatgttagaggaacgctaacttacacaagaatgccctaattccttttatttccacttatatccatttattaagtgcctattaccatatctcaccaaattctaagacaccaacaattccaagacacagcgttattttatgcagcatgtcagttccgctatgacatgccattggttgtaaggcaaatgctaatttcagagatgctaaaaatgcaaaacgatgtgaggcttagaagctacaaataacagtatatgtcaagctctgttgctagtccctttacatatgttatctgagtcctagtgtgaaaaatgttattattcaattataattacaaatgaagacaaagccagaattccaaggtgagttccaacctaggtctgtctgaaagcctccacaccagcacaccacctcccagcaaagatatggctcccacatcggcagaccttataacgaagtacagaacaagaacctctaaacaatcaagctacagacaggtaatgagagttgggtatcaaatgatcacagaagcacccagcttgtgtctggagcaatccttcaaacaaacttccaaatctcccgaagacagtttcacatttattattctaaggagcctctgctctttcacctactttatagctccctctcacttcaataaactacttaagtggaagttaatgatccagaacatatagtgctctgtgttgaaaggggaacttaggaacaaaaggtgcatgattccttgtcaatgttaaaacacatccctattatcaaaggattgacgaaagcaggtcctggaaggttggggttgagatgtgtgcataagcacatgtgtgcacatgctacagggtgagaagaaagaggcctcgaggaataaaaataaccatttcactggatgtcttcacaaacaggatatgctgccacttccctaaggagcttttaaggagctcaatgagtagaactactgccaggagagaaccagaaagaaatcaccccaagaaaacactaaaccctggtcaggcatggtggctcatgcctataatcccagcactttgggaggctgaggtggccagatcacttaaggtcaagagtttgagaccagcctggccaacatggcaaaaccccatatctattaaaaacacaaaaattatccaggtgtggtggtgcacacctgtagtccccgctactcgggaggctgaggcacgagaattccttgaacccgggaggcggaggttgcagtgagctgagagtgcgccaccagcctgggtgatagagtgggactccttctcaaaaaaaaaaaaaaaaaaaaaaaaaaaaaacacacagaaaatacgaaaccccctctccccacactctccccaattttgctttgtatggtgatttgggtgtgattttatcttatcagtcagctctttcttgtcattttctatctaacactgaacaagcctagtggtagattgtaatagctgtttacaattactcaatcctcccctttgctgtaagacttatacatccctgcacaatgtcatacactgtgtggggctatggaccaccctgccccatggtcagggttggacatgtgagttgcatgggccaataggacccagtggatgtgaagctcactacatccaagcaggagttttaaggagtatcataaacaggtatggccaatgtggactggccctgagtctcagaattacaatgcatatgaagcagaaccatggcctgcagcctgcatatatacaaagagccactgagatgtgggattgcatgcaaaaaattagtaccagaagtgggatatgccataacagataaaatacaaggcataagctttggagctgggcagtgaaaggtatggaaactgtcactacaggatagagaaatagtgacccgtgatccagcagtaacacatttagtaaaactgcccctgtgatcacttcgaaggcaggagttgcaatgaacgaatgtgtagctttaggtgacaaggtcgcaaaacagaacattgctagggggatttggttactattaggtccatttgacgaagtactacaataaagagacgagctcagaaaagagttagctggttttccaataggattgaggcgggaaaaaaagaaaattaggaaatttgggacttaacaattgcaagatacaatgatttctcatctcctataaataaagaaaaaaaatgggccagacgcagtggctcacacctataatcccaacactctgggaggctgaggcgggctgatcttttgagcccaggagttcaagaccagcccaaacaatatggcgaagacttgtcgctacaacaaatttttaaaaattacccaggcacagtggcgtgtgcctgtaatcccaggtactagggaagctgaggtgggaggatcacttgagcccgggctatcaaggctgcagtgagccaaatggcaccactgcactccagcatgggtgacagagtgagaccccgtctcaaaaaaaaaaaaaaaaattttttttttttttttaaggaaagatgattaagacctagcctcaggacacagacaaaactaagggcacgttaaagtctctaaaggaattaagacacccccacctcgccctaccctaaccctagtaaatccttttagttgagcaaaattgctacaggaaaagtgattagtgacatggtctcacagaaacctgataagctcaaagtggcctgtaattaaatccagaaggagagatatgtctggtaaatagttacctcaaaagaggtgtaggtgtggctactggcccagggagtaactaaaatcaaatggaaataaaaattgatcattgtttagcatgaatgatatccccaaaagagacaccagcctggtctaaaagagactgtgaccacaggggacctaaaacaacttttggcaccccaaattgctataagcaggaagtagcctgagaaagctaccaagtccccaatgaagatatattctctaatactttttcaggtgtgtccgaacaggatgatcaaaaaggaaaaatctcccagagggagaagtcaaaagtcagagagaggccaggcacggtggctcacacctgtaatcccagcaccttgggaggccaaggcgggtggatcacgaggtcaggagttcgagaccagcctggccaacatagtgaaaccccgtctctactacaaatacaaaaattagccaggcatggtggcgtgcacctgtagtcccagctgctcgggaggctgaggccagagaaacacttgaacctgggagtcagaggttgcagtgagccgagattgtgccactgcactccagcctgggtgacagagtgagactccatttcaaaaaaaaaaaaaaaaaaaagccatagagaacaatggatttgagagcttctcatttgaggagaattccctatcccaaggcaggtgggcctctcatgctgtccagtggaatttcaggatggccatgtggatgcgcttctttctcttttgaaatacaagtgctcactggggttggcctattcctgttcttccacgacggacatgtggaccaggtcacttattttggttcacagctctctagatgaacagcaactaaatccagacctgctgatagaatctcatgagatcctgaaattcacacctgattccatgattacatgcgaatttttaggtatcttccatgagtcagaaatgaatttatgtcgtatataaatatacaaaatgatatataagatgattatttatgaccaggagggaagactgtagcagactgtattatacagtcatcccttggtatccgtagggatacctcctccctcccacagataccaagatctgctgatcaagtcccttgagccagctcttcatatctgtgtgttcctcaccacggatgcagaaggcctactctattcacaattattcatgtctccctccccttagtagatgtttatgtccccacctggaattgcagtacctgcctattggccaagcatacttccctgtacaatgtcagactttgccatatgatttgttaagcaacagaatgtgaatggatgtgaacactccacatccaagcagaattcttcaaggacgtcatgagtttccaccaattctctaattcttcccctccaccatgacattgcacatggccacaggggctgctgtttcagcctggaatccagaaggagaaaacaatgtgacagagatacagccaacctgcagcctgcatgttatttggaagcaaaataaaccttcaggatggcaaaccactgagatttgaggtttccttgctgtgaggcaaagctgacttaagcagcctgttccacccagacaactgaaatcaatgcttaaactcttagcaatacacaatctaatgcaaggaatatgcctggggtcccatgtgagccctcaggcttttaaatcctcatctttcctgggaaggagacatagagctcaattggttccatataaatgcttcttcaacttttgagtaaattccatcatctttgtgagccatctaacagtgaaagtattaacaatgaaattttaaaaaatcaaatcataatttccttttaaccagccatgctttgaatgacaaatatgtagagagtgagtttgttctcatctctcttctcactgcattcttactgtagcctctcacctaaccttgttggctccagagaccaaaagaaagtcagctaaagccacaaaggccaaatggacatgagaaaatgtctgaaaatgcaatatcagggattgtgtttgtcttgtgaagtcctttttgcccctcagggaaaaatgactggaggctcctctgacttcggagtaattgctttgaatgttttgggggaagatattttttctggggatgttgctgttgttgctaaaatgatgtccatccagaaaaacataagattgcctttgtttttaaacttgattataaaccagccctgagaagccttctaagagacttccataagtcttttgaataatgccatcattccaagttgaccatttccagggagcccaatctcgtttgccagatgagttctgccgtgtttgttcacataccagctttattacgttttaattagttgttatctttgaccccaaaaagggattcccgagcacctcagaatggagctcacaggcactggtaggccttagtggccctttctgctcctgaccccagggggacacctggggatcaagctgaggtgagaagcagactcaaagtcttctgttcacagataaatgccccacgtgaccttgcacgggaattactgaataaaagagaccactaccctgatttgaacagcaccagacacagagctgtgaaagaaaatgcctcttacagatgacaatgtccggttgcccagtcctggatttgttttatttatttactgagacagagtctccctctgtcgcccaggctggagtgcagtggtgtgatcttagctcacagcaacctccacctcctgggtgcaagcagttctcctgcctcagcctcccgagtaggtgggactacaggcgcacaccaccatgcccagctaacttttatttttatttttggtagagataaaaaaaaaatggggtttcgccatgttggccaggctgctcttgaattcctcctctcaagtgatccacgcaccttggcctcccaaagtgctgggattacaggcatgagtcactgcgcccagtcccagccctggatttgaaccagtgttcactgaagcatttccaagcctgttgttgtgccttcaggtatatgaaattcaacacatattctaaaaaggaccttgccaatgttcagtagaatggaaggccatcccatgagtttcagaaacactgatgctgctttaaaacaaaaaactcccggtgattataaggcttacctggagtatctcaaatatttcagtagcgaaaattcaaagacaaggaccagcaggaatgccaattccatgttgcaatcacgcctccccacccacaagcatgttattagtgtgtgcttccaatgcataattacctttcattttcccatagaatttcaggaaaaaagagcacagggctcagatggtttgtgaaatcaataggtgatttcatctcttacatgcaaaaataatcagttctattgagaaggaaatgtatacacacacacacacatacacacacacactacacacacacacactggaaagcccacattcaacagtcaaggtcacacacacaggaaatattcatgaaaagggaacatttgtagtatcatcctgagccatatagcacagtccaaagtacatgggttaataaagggttaataaaggaagaaaccatctcactctcaataaggctgaatttgatgtgctcaaataacactgattgctccaaaaaaaaagataaaattcctacaaagaggaggatcccaggcctaacgattggattcttttctagacaactgtaaccaccctctggacactataaaagaaaacaagtatccaaaatagcaggatgactatttgtaattactgtgtaattgttggttttacatgtctgtctcttcctgggcttagtgaaggcagagaccaagttcactaattggattcagccaaggagagcagttggctccatgaagtatgaatgaacaaatgaactaatgaaaaaaagaacacgtaagttctgtaccaaagaaagaggaaagaaaaccatgaatcctggtagtaccaatcctgattctatcccacctgccagcaaacaagaaaacaaagggaccatcaggaattcttcatttagtccaagctctgaaaagagaaaataattccaaaatgtcatattaagaaggtaaggaagacatgagaatttgaatggaagaaaacagagcagtgggtgggaaaaagtggagactgaaatcttacaaccaggaagtgtaggctgtggctttgaaggaaaaaaaaattgaatttccaggttcccagggccctgatagttgattctctccttcactctcctgctttgagtctacgtcaatagactctcacagcctgaacctccctggccgtacctcaagcattagagcaagattgaaaaggcttctagatagaggtgatacaaacaaagggaagtgcgtgcctctgggaaccgagcaagagttttcatcaccaaggatctttggaccctgacaaaaccacaggtaggcttcattcatttcactcagtcaacagacatgccctgagcacctgcttcatgccaggcactgcactgggccagcccagaagcagtaggaagtcgaatgttaaatgcctgtgaacccgcattggtgtgctttgctggggaaagggtctccagcaacagtctgtagccaggggtgatggccaggggcagagcgaacccacagagcctcccagtgcacactgcaaaggtaccccttcctctacacagacccagcctggccccaggctgtctactccacagcagaatctcagctggaattcaaactccttgggtccagtgtccttgtgagagacccatcctgccctaccctatctgctcccttgtagacagccctctagcgaccatcagaagtgtctggggcatttctgccccatgcacacattgacggggggtactacaggcacttaggggctgcggaccagcagtgctaagcatgctgcaatatacaagacatggctaccccataaagaactggcccgccccaaatgccaataacccaatagtgtgtggtttttatcgggtgctcgggtagtctcctttccacaaaacggtcaaggtcaatgtgctaaggatgacaggccaggggtcatcatggtgagagcccaaataaggaaggagtgagcagccacttcacggagtctacacaggcatcgctgcagccttggaagatctgctacccaattgtcagccaacaattctattcaattaaaaaattcccaaatattgaaacttcatattttaagattaagggtgcaaattttttttcttaaagggagaaaaataggaatcaaggccctttgatagtcatagcagacgactcccttcccctccagacctctccagttgtgccccgggggtcttgctacccttggaaactggatttaacttttgttaagcactctatagaataaagaaaagaactgccaattggttctaagaagacactgtgcttagaaaacagggcacatcgctgtgttaaatgtatggtactgaagagtttcctccagggaaagacaatgtgtttgtctgcctcaatgtacccaggggaaagcaacactgaaatgtccctgactttgcgaggatattaaatggggatccaaagtagaggcatggaaaacagaacttctgtagccccttcctagaaatctcctgacttttaaaatacagtttctgagttgaaatgtcctgttctgcaggttgaaatatacgatcaaaacctgctttgtgtagccctctgcatacagcattttaaacaagcttctggagccctattactccctcatagcaggccagcagagaagccagggcagctcattagttctgggagagctgtttcaattacattccagttgtagcccttcctgttcccttgctttgttgttaaagttccacccgcaaatgctttcctccactggcccagtcctataaattggtgagctacaggggctgcttaatcccataactagcaaagacaggctctgaagtcttggtcagatcataggatcctgtcagataccagtacagagtctctaccctcatcctactgttcttgtccagcctgagacaggtctacggcagcaaagggaagagcagcaccattaagaatcctcaagttgagtagtactggaacataaggttctgaggaaaagaaaatgaagatggcaaatcttctttactccctggctgagacacacagaagaagcgactacagtttgacactaagtggttaataactctaatcaagcaggctggatgaggggctgaaggattgtcacagaggcactgagaagggtggcctcaaggagaggcttgtgttccataataaatctcacggaagcatctagactggtcacttccatcctgaatgtatggtggggccctagcaacagaccagtggctgagtttatttagcactgtaggctaatgggcttccactgtgtaagtcaacctaaaccaagcctagaggagaacttcacccagatctcgttttccaaagagagggaaggaccccagggtggcatctacccacatgggtctccatacaaagaaagaagacagggccccagaagagctcttccaattcctggtaccaaccacccaggaaatgctgcactggggctgcacgtggcagccctgggtccaagagagcctgagagaattcttcaaggagctgctgatgcttagaagtgagagagaggctgggggacctcactccagccttggatagatggaagaggggcagatcacctgaaacagaagacaaagaggagtacaggcccaaaaagagaggtacagagagagctgcaaaggagtgagtgaaagagaccaagagaaatggagagagcaagaaaaaagacaagacgagatgaaaccaaacaggaagagatgccttgttaaccaagtcgagaagtactggtggactgcagaagcgagaggaaaaggttaccatggcaacaccttgcagaaagcgtaggctgtgtagctgagtgagcccagccaagagagctgcagccgccaatggcctcacctgctactgcatctgttcacctgtgggactgtgcctcgaaggctatgcccaagctcccactccccatctccaagatctcagcccagaacccgctctccgttcatccgctgccccaaattttgtgtcacatgatcccttcccaaatgcaccagatagacagaggaggctggggagccatgggctcagctgcccggccccctccccaggtgtccttattcttggttcaaggttgaggaatcttggaacatgacgaaagtcttagcaagttactcaactcaaactttcacactgcacaacaagcctctctgtaacttccctgaccactggtcaccacaactctgcttgaatcctttcagtgacagggagctcagcccactgcatgactcaaatgcttacgacttcagctttcattctctgatctaagatcttgctctacaactcggtagaggcaagggggaagatgaacaaagtccactgtgactagtgaaccatgagccatgctcctaccatatgctgtgattcaacccccaaccccaggccctgctctcaccacagacatgcacgtcttctacacctctcactgcaattctctataatttatcacatcgattttatagtatatttttcgttaacctcacatttgtacatccaggctccatgagctctttggctatttttactgttgtccagacagaataactaacattcattgagagcatacaatatactaggcaccattctaagcattttacatgtattcacttagcctatcttcccaaaactccaacgtctagcagccactaaggagctgagtcagaatttaaatccagtttctttagggatttatctttcctcttctacctgaagaatgacctgttcttttattattattattattatactttaagttctgggttacatgtgcagaacatgcagttttgttacataggtatacacatgccatggtggtttgctgcacccatcaacccgtcacctacattaggtatttctcctaatgttatccctcccctaccccccaccccccacaggccccggtgtgtgatgttcccctccctgtttctatgaaacaacctgttcttttggtatggattcctccatatccctgattcagagagtgttcggacccaaatgtgctcaatgactcaataagaatccacacctgaaccaaaacattctccaaagtttccaatatgggcatcaaaatccccacggtctgggccaaaaaattcctacatccaggctccatgagctctttggctatttttactgttgtccaaacagaataacaactaacattcattgagagcatacaatatactaggcaccattctaagcattttacatgtattcgcttagcctatcttcccaaaactccaacatctagcagccgctaaggagtcgagtcagaattcaaacccagtaagtctgactccagaacttattctctgaactccaaatctataccatttctatattgtgacatctttcaggacagtggtggcttttcaaatatgcataccgttcatctaccgaaaacctacaggtaacatcacactcaatgtgaaacactcaatgattttcccctaacatcagaaataaggcaagactgtctgctcttactcctcccttcaacattatactgcaagtcttagccagtacaatcaggtaagaaaatgaaattaatagcatacagattgaaaggaagatataaaactgtcactattcatagacatgacagaaaattccaaggaatctaccaaaaaattcttagaaccaataaatgagtttagtgaggttggaggatacagggctagcacatacaaagtcaattatatttctatatactagcaatgagcaattagaaatttaaaatacagtataatttaaaatagtaccataaaacacttagaggtataaatctaaccaacggtagagtatgtatgatgaagaccacaaaacactgataaaggaaatcaaagactttggagaatataccatgttcataaaatggaaaactctatatttattaagatgtcaatttcctccaaattggtttatggattcagtgcaaccccagtcaaaatcccattgggatttgtttttctgagatggagtcttgctttgtcgcccaagccagagtgcaggggtgcaatctctgctcactgcaacctccgcctcccgggttcaagcgattatctagcctcagcctcctaagtagctgggattacaggcgcgcaccaccaaacccagctaagttttgtatttttagtaaagatggggtttcaccatgttggccaggctggtctcaaactcctgacctcaaacgatccacccgactcagcctcccaaagtgctgggattacaggcgtgagccaccacgcctggtgccattaggattttttgtagatattggcaagctgattctaaaatgtgaaaggagaaaggatacgcacaaaaaccaatgaatcagaatgaagggtccaaaaacagaaccaaacaaatatggctcacgaactttttacaaaagcgaaaggttaattcaatggagaaaatacagtcttttcaataaatgctgctgggacaatttaacatccatatgaaaaaaaaaaactcaaccttgaactctacctgacaccatatttttttgaaacttcaaatagatagtagacttaaatgtaaaacgtaaaacttttagaaaaaaaaaataggagaaaacctttgcaaacttaagttatgcaaaaaattcttagacgtaacaccaaaagcacaattcataaaacaaaaaaaaagaaaaactgataaattggcagttcatcaagattaaaaactttcgatctccaaaggcactgttaagaagagggaaaggcaagccagggactgggagaaaaagaaatgcaaatcacatatctgacaaaggtcctctatgcagaatacagaaaaagaactctcggggccgggcacagtggctcacacttgtagttccagcactttgggaggctgaggcaagtggatcacctgaggtcaggagttcaagaccagcctgaccaatatggtgaaaccccgtctctactagaaatacaaaaattagccaggcagggtggcgtgtgcctgtagtcccagctactcgggtggctgaggcaggagaattgcttgaacctgggacgcggaggttgctgtgagccgagattgcgccactgcactccagcctgggcaacagagccacactccatctcaaaataaaaagcctctcaaaactctaccataattaaacaaatggattaaaaaacaagcaaaagattttgacaccaaagaagatgtacagatggcaaatgagcacatgaaaagatgctcgacatcattagtcattagggaaatacaaatgaaagtcaccagagaccactactacactcattagaatggctcaagttttaaaaacaaaacaaaacaaaaaagtgatgaggccaagggctagtgagggtgcagagcaactagaactctgctgggactgaagaacggcttatccgctttagaaaacggtttggaggtttcctatcacatgacccagccatctcactcccgggtatttagccaggagaaatgtaaacatatgtttacacaaaagcctgtatgccaatattgatagacgtttcattcataattgctgaaaaatcaggaaacaacacaaatgtccttcaactggtgaaagtaaacaaattgtggtgtatccacacgatggaatgctactcagccttaaaaaggaacacgctgttgacacttgcaacataatgaagttctctgaaatgcatgacgccaagtagaaagaagttagatccaaaaggctacatactgcatgagtccatttaggtgacattctggaagaggcaaaaatataggggcagagaacagctcagaggtcaccagaggttaaacaaaagggaaacagggataggttgagggtagggtttaactacaaggggccaagaggctgctcaagggaatatggggaggtgatggaactctcctatggtgatggttacagatctgtgcatttcttaaaaactcgtggaactgtactccaaaagaatgagctttatgatatattaatttaaagaataaatttttaaaaatattcatgtcctttatcacctgagcaattctttttgagacagagtctcgctctgcagcccaggctggagtgcagtggcacgatcttggctcactgctgcctctacctcccgggtcccggttcaagcaattctcctgcctcagcctcctgagtagctgggattacaggcacgcgccaccatgcccagctaattttttttgtattttcgtagacacggggtttcaccatgttggccaggctggtcttgaactcctgacctcgtgatccacccgcctcagcctcccaaagtgctgggattacaggcatgagccactgtgcctggctatcacctcagcaattcttgaaatggccatgaaggctgggcacagtggctcacacctataatcccagcactttgggaggccaaggcagggggatcgcttgagctaaggagtttgagaccagcctggccaacatggcgaaaccctgtccctactgaaaaatacaaaaatcagctgagtgtggtggtattcgcctgtaatcccagctacataggaaactgaggcacggaaatcatttgaacccaggaggcagacgttgtggtgagccgagatcacgtcactgcattccagcctgggcgacagagtgagatgctatctccaaaacaagcaaacaaaaaagaaatgaccagggagcttggactgtcacaatttgtatttcacagggtttttgagaccaagttgcacattttccgagatgatcccaatgtgcagtgtggcttatactaatgaactaatgaatcctggcatccttgttttggtgagaccacagggtataactacaggttatggcagtatctcatctgaaaaaaagtaaaaaaaaaaaaaaaaaaaaaaaaaaaaaaattcccctggcaattacccggggaacaaacaggagatcctaggaaaggcaatggaaatttggaaggcaagtcttggccgggcctcactttctttatccaaggtggtggaaatgacctctctctgggcaggcagatctgaagacctgagaaaaaccaaacctcaaactctgcctctaaagacatggaactaagtaagaacctagccctggagccagacagggactctccctggagaacagcagttcccaacctttttggcaccagggactggttttatggaagataatttttctacacataggaggtggggggtagggggtggtttcaggatgaaaccgttccaccctccgatcatcagacattagattctcataaggaaggcgcgacctagatccctcacgtgtgccgttcacaacagggttctcgctcctgtgagaatctaatgctgctgttgatctggctggactcagagctcaggcagtaatgctcacttgctcaccactcacctcccactgcatagcccagttcctaacaggccacagacccatactggtctgctgcccaggggttggggacccttgcggtagagggtcccaagaggttagcaagcgccagtgggctctgagggctgcctttgccatggtcagctgatatccttctctctttgttatttactatatttgctcatcctcataccttgaataaaatctcactggcagtcagatacattggctcacgcctgtaatcccagcactttgggaggccgaggcgggtggatcgcctgagctcaggagttcaagaccagcctggccaacatggtgaaaccacccccctccctggtatctactaaaaaaagtacaaaaattagctgggcatggtagcgcatgcctgtaatcccagctactccggagactgaggcaggagaatcgcttgaacctgggaggcggaggttgcagtgagccgagattgcgccactgcacttcagtctgggcaacagagagagagagtccgtctaaacaaacaaacaaaaaataaataaataaataataaatctcactggccagctggcctcagaaggtctgtaaggcagtaaaggcatgatttgcgctacagaggagttaggaaagctggcccactaaggccagcacagtggtgggacccacttatatgattgctagtggtttatatagctttcatgctggaccatacaaaacgacctcatatttgtttccccaggagggctgaatctccttgaaggcacgtgtctcctggttttatgtgtacgacagggccttccctactggaaagggcacaaccaattcactaagattgacttgagcaaacctcaccaaggcagaaaccgctaggtgagcctggtctcctgggggaatagagcagagacttctggctcaccacatctaagagctgtaagagaccatatcatgcacttctctcctctgccatcctcccggaatgcctctgcctcccaacaagctcatggtgagtttgtgtaatcaagaagttggcagacagagagagtgaattctgtttcagagacctaagctgggagttgctggcaaatccctgaacatccagcttcaaaatgttacgaccctcaaaatcacgttgcaactctgaaaatcatgtttccttgagacaactgatttaattttcagatatgcagagctattttctttctctggactcaggagggaaaatacaccagagagaagaaagcagaacagaatgctagcatacctgccacccagaaaggagacggagggttgaacaggaaaaagcaaatgcaggtcgagtggagcatatccctgattcctttctttagggaagtgttacatgggccccatcccaaaggttagcgctgttctgtacttcacgcaggttcaaagcccagttccacatcttcctcctaaccctttccttctcgaaggctgactattccagtaactgctgtcaatttcctcccagcttcacaggctcaaatccagccttctgttccttattaggcacttttagtaacaggcaaaaggttgacatgggagtgaataaatgcaaaggactcctaaagatcccaagcactcaaaaccaacgtgccaccctgttgcatccccagaaggagcttctgcaaaaataactgctgcaaaacaaagcaaaataataatatgaaaagcgcccaggctgtgtggcttcaggcacagactcttaaatcttcgacaaataaaagcctggcaggaatatcctaatgaaggctgctgctacccaagccacttgtctgttctttctgtttccctaaagcacattaaaaacacattttccagtttaatagacttatgagctgaaatgaatgtgtcagaatgcttataaatatgatagaacctgctaaccaagcaaatgttaaattttgcataaggagactgtatccctaactcctcagtagatacttaatgaatatttcaaacaaagcaccccagcagctgctctaagggctccagatgaattaagtggacttttattactgccaggactcgtcctcttgcttcctctcattttatccatcttcctcctttgtataagacaaacatggcgcctcagacgaaccaagctcctgaagtctggtcacggagtgatcagagtatggggttggtcaatgtacagtgctgaatactgtcccccgccaaaattcatgtctagccagaacctcagaatatgaccttacctaggcagggcgtggtggctcacgcctataatcccagcactccgggaggccgaggtgggtgggtcacctgaggtcaggagttcgaaaccagcctggccaacatggtgaaaccccatctttactaaaaatacaaaaattagctgggggtagtggcgtacacctgtttccagctactcaggaggctgaggcaggagaactgcttgaacccgggaggcggaggttgcagtgagctgagattgcaccactgcactccagcctggtgacagagtaaggttccgtctcgaaaaaaaaaaaagaatatgaccttacctagaaattgggtctttgcagatgtaattagttaagaagcagtcatacaggattaagtgagccctaaatccaatgactggtgtctttatgagacaaaggatacggagttttggacatagacacacttcacagacacacacagggacgaaggtcacaatgtgggcagagattgaattgatgcagctacaagccaggaaacgctgggggccaaaagaagttagaaaatttccctagaattttcgagagagtgtggccctgctgacaccttgatctcagacttccggcctccaaaactgtaagggaatacgtttctgctgttttaagcagctctgtatagtacaagataaccatcccttctctgaagggaccagagtgtttcagatttttcagattttggaatatttgcattattttactggcatcatttaccagttgagcatcccaaatctgaaaatgtgaaatccaaaatgttccaaggagcatttcctttgagcatcatgtcagcgttcaaaaggttttggatttgggagcatttcagatcttggattttcagatttgagatgctcaatatgtactttgttgtgacagcaacaggaaacttacacagtcaggagagaacttctacacattcagatgtgtattgcaattatttccccagaagttaactgagccgactgtttcaggtgacagtggaagcggtcatccctttaacggtgccatccctttaacttcatgatagcatagatgtacacctgccagcagtcttaaaagatcagacttagagccatctgactttttttttttttttgagatggagttttgctcttgtcgcccaggctggagtgcaatggcgtggtctcagctcactgtaacctctacctcccaggttcaagtgattctcctgccttagcctcccacgtagctgggattacaggcatgtgccaacacgctcggctaatttttgcatttttagtagagacggggtttcaccatgttgaccaggctggtctcgaactcctgaccttaggtggtccacctgcctcggcctcccgaagtgctgggattacaggcgtgagccactgcgcccggccctgactttctttctcgctgcactctttgagtaacttttcaacttcattctactcttttttcatcctgcatagtctgcattcccagcccatgcaggtatgaggctaacgtaaggaggcagccatgcagtgagagaatctagaaggcagaaacaaagagaactcctttctcctgacacctggaattccttgaagctaactactatctctggaagacaacttctcaaaaaattgttcagcgcaactatggcctgaatcacgtcccccgcttcaaatttctatgttgaagtcctaacgcccagtacctaagaatgtaactgtaagggagataggatttttaaagtgttaataaggttaaaatgaggtcattagagtgggccctaatccaatatgactggtgtccttataagaaaaggagattgggacaccgacaggcacagaggaaagaccacgctttgggaggccgaggtgggtggatagcttgagcccaggagttcaagaccagcctgggcaacacggcaaaatgccatctctacaaaaaaatacaaaaattagccaggtgtggtggcgcactcctgtagtcccagctactccgggggctgaggtgagaggatagcttgagcccaggaggttgaggctacagtgagccatgatcgcaccactgcactccagcctgggtgacacagtgagactctgtctcgataaaaagacagaccatgtgaagccacagggagacgacagccatctaccagccaaggagaaaggcctcagaagaaaccgaccaatcttgccaactattagtcttggacttccagcctccagaactgtgaaaaaaataaatttctgcagtttaagccacccggtttgtggtattttgctacagcagccctagcaaacacatgtgagtgccaaattgcctctagcctcatgccacatgaaaatttgctctgaaattactgcctggcttagaaaatcaggactgtgtttttttttttttttaaaaggcagaagcagataaagtgctatttgagtgctccatattaggccaaatagaacactcttcagaagcaaaagactctataaagcgtacccaccctgataatgttcccatgagctaggacactaacggtctcatgctgcctgcacagatccctgtccaagaaggtatctctgcattgtttatttaatatccagatgcgaaaaagcttctggcagttattattattgagccctttgccctcctgcaaaatatttttgtgcggcacattttaacgctggtttgcttcattctatttatttatttatttatttatttatttatttactgagacagagtctcactctgtcgcccaggctggagtgcagtggcacaatctcagctcactgcagcctctgcctcctgggttcaagtgattctcctgcctcagcctcccaagtagctatgattacaggcatgtgccaccacgcctggctaatttttgtattattattattttttttttagtagagacaggggtttcaccatgttggccaggctggtctcgaactcctgacctgaggtgatccacctgcctcggcctcccaaagtgctgggattacacgtgcattctcacacttcaaatgaagaaacccaggttacgggtcttagcccagaaaggaggtagcagccagggcctacctatttttcagttcctagataactcctctcaattgggccaggacaagattttaaagtctcccctaaccaagcaggtacagggaaaaaaataaataaataaaactctgattgccaaaaccacatgccaagaaattatatctacatgaactgttgtgaaaatactctttcatttttagagatcttaccaataaaaagtcaaaattaataacatctcagagacttccccaaacacattatttcggaaacctagttataaacactcagaatttctcctaggagttacacctcactctcgatcaaatttaagatcactaaatttgactggaaatatcagtgacaaaaggaacatgtccttcaggaagacatggaaagttagaagatacagaaaaagaaaggtaataggaaccatgaagctgtttaaataagtcatctttgcttccgtaggcttaggctattccaagcagttttagcgccaaggaaacttgggagtggaatgtacgtggctgagcttatagcgagaaccagctgcttcagagaagagattgcatcccacactgcctggctgccctccctaagccccacacattatgtctaaaaaaatgcaatcctccaaagcctagccagtgtgaaaacccacctattgggttcattgttgaactagagaaaccgttcccagtcaacagacaaacacgtaagcagtagtaaaacatgaagtcaatgggccaatacctccctgttcttcagttcatcaaatctttttccaaaggcacctaagggaggatgtttaacagggaaaatgggagaaagggatgattccaaatacaagactgaaagaggacactgtgatacctggagaagagagagtgtcttgaggtggaagaaggggatcaaagagcaactgaactccatcgtgttcccgaacaggacaagccctggggttgctgatccggggttgggcacttgagaagcttgagctagaaaggaaaatcatctcctgcaagaccatttccacaggaagagtgccacgcagcacatcagaagcagaaccaataaggaattcaagattttagagtagaaaacaaagacactcagctaatggccagtgactgcagttctacaatctataatccacttgacacgagcttggcatcagtttcattttgcaaaacatggctttgataattgcatcagatctgcaaggctgtgtaggcagaattcttattgccaagtgaattttcctataagaatagggcattaagagaaaaatctgtttcttacctgagtgtcgtacggcttacgcttccctgacttgagtacccattcactttttcccccaacacttcagaaagatttacagaaaatgcacagatggcacctcacaactgaataatctcctaaagtaaatccacctcttgctctaccagaaaataatgccttctcctggtctttccacagatacacaaaatgataggcaattctcctatgctaatagaccgatgaaattcaccaataataatagtgatgacaaagttcactagtgaagagtatctataactgcatcagaccaatctggttcaacttttatgtaacaaagctgtgagctgcttttcagttgccatggaccctcaggtcatgtaacctaagcatgctcagatgaaccaagtgtacaaccacagggggaacctaagtgctgggacagaggagtgggactgaattaagaagcagacaccacatggcaggatccaggatccaatgagattgaactctggcatcaccccatgacaggatccaatcagataatgcctcctaacgtcacctcattgcaagatccaatcagatcacacctcattacttatgcttataaaacccaacccaacccccagctcagggagacagatttgggcattccctcctgtctccctgccagttgacttgactcccaataaagctgttcttctctcaaaagccagtgccacggtattggcctctgtgtgcatcgggcagcaagcccactgatgcttggtaacatttcaacttcctcccccagaacatactgcatatttaaatggggaaattaacaattagtaagagaatcaactgattcacttttaactaccttctctttagcctacagaggatgctatgaagaaaagaaaaaaaactcaacttgacagctgagtggggacaactgagacagagaagcccaagatcttgaacaacactgggtgtatgcagccatctggggtgtgatgaaatataacttatagtcccttgcctttcaaacacacacacacacatacacacacacacagactttgcataaaatgcaagaggctcgtgagtcctttggtactcatgcatggagcccagacataaagaactcctggcctcatttctagaatttactcaacaatataactgtccacagagatgtagatactaaaatgctctgtgccacattctttgcaatagcaaagcatcagaattaaccccatgggcatccagagagggctaattaggtagcatcatggccaataacaagaatgggatggatctatgagcacctcaggaaaaaaacacccaagggtaccgttaagtgcaaaaacatatgatacagaacaatgggtcaggtgtgattatagaaacatgataattctgaaaggatgcacaagaaactagaaacgatgtttgtgtctgagatggggggactagaccataagggatttgaaggtggaagaaaaattacttttaaccgatgtcattatatttttaattaaaagaaagctaattggagatggatggatggatggatggatggatgggagagagaatgaaagaaagagagactgatagatttaaaggaacttcttctggcctacctaagtcccaaaatatccccagccttgagaatagctgatatcagaaaacattgcacactaagacctaaataggaaagtatctcataaatgcttttcccagctcaggctgccgtcactgctgctgctcctcagagcagctgaactcctctcccagagtgtggcctttctagttcttcctctggtcgaaccaattatgggacattacaacagcagcaccaatatgatgttttaaaggctaatgttattcactaaatacccattaaacccatctccttgctccatttacagcaagcttaagggcaaatccagatggtacaaataatgcatattcaggctccatctgcatgaagccagttatcaaatagccattatcagttttggagtcctcaggtgcctgacacccacaggtgtgtccaggtgagaagaacagcgacctttcaagagatggctgggagatcatctctgtgcttccccaagagctgcatttgcttttgcagctgaacagctagcaacggttacaagggttgcttggtaacccggtaacaggctgtgcctagtgttcttgagcagggggactgggttacatctccctcccacacacctcactccgctaccacttaactctgggttggccaagaagacccagcagtacccagaggctgtcctgcagagccaactcccctgaccccgtcccggctgtgactccattggaaaatgtccatccaagggcttgccaatgtttaccttttttgactgacaggcactgaattcactgtaccaccttcccccgaccccaccagcccatggccctgaagatagaaaaatcagataaagtctggccaacttttataccctagagaagactcacaatcaggatcataaggtcttcaaaggggaacccaggagcccagcgcagtcatgttagtgaaaatagacagaaaaggcctgtggccttgtgttcagaactcagcatgaaaaatgacaagttttacttgaatacagtgctctactgtgtcaccagacagtccttgactatgttccagtaaaaagagaagatgatacctaaagcgttctgatgggtataagtgacaagtgtgattggaggcaggaggaagatttgtcattctaaccctctatgatttaagctcacattggatgaaatttttatttcctggttccatcccacgtaggaagttgtgggcggcagtgaggattaacccaaatggagaagacatttgagttctccatgaataattcatgcaggacataatctgaacacagataccagagccctggctgcagcatagctttaacttttgtacatttgctctccctaaggggtagagatcatcttagcatagagatggcaaaaagattcaattaaaatgccagcatggaaatgggaaaggactgttctccctgaaatcactcctgtgaacacagtgactggtcaccaatttgtttttccttaattcactcaggagagcactccacataagcgaggaggggcccattctccacagcatcctggcatggttttcgtccccggggtcttgcaggattaaatggggaacttctatataaatccaaaggggaaaaaaaggcatccaactctcctcatgctcactggcccttaaactagccaagtgtccttagtaaacaatgaggggcaagaaggagaggcgtctgaccccgaggctggaaaacaatgtattgcattccatcttcaacaacttctcaaagggcaacagcccactctgcatctctccccacccagcttcagtaattgctgtctgattcctcttgagggacgcattccctctaactcagagaaaaggcatgactatgctgtcagcatctttagcttttctggctccaaattgaatcagtgagagaaacgtccacagttggccaggtgcagtggctcatgcctgtaattccagcactttgggaagccgagacaggcagatcacctgaagtcaggagttcaagaccagcctggccaaattggtgaaacaccatctctactaaaagtacaaaaaattagccaggcatggacctgtagtcccagctacttgagaagtcgaggcaggagaatcccttgaacctgaaaggtggaagttgcagtgggctgagatggcgccactgcactccagcctgagcgacagagcaagactccatctcggggggaaaaaaaaaatccacagcagtctccccaggtaaatcaaaaagatgtaaattacaacacaaatgaaaaggagtattcagggttcatcagagagggggacactgagggacaaatgctggtactctctaacccaaagcagccccatcaccatcagagtgaccccactgtccacctgtccaagtcgaaaagatgatcaaaaggtaccgttaccttctgtagactaagcatgtggtttggacaacaaatgagaaatgaaggtgctgggccagatgccagtttagctccatgcagtagtagggtgagtgattcggagggataggacagtgctggcatttctctcactattcatcctaccaccagcccccacgtccatattgcctgactcagctcagtgtctgcagcaaagagcttgcctgaaagaagcccagctctacctatccggatggaaagttcactctcagggaagagcagcgcgggaccctcaggatcagacttcttcttcatcaacgtagagccgaagttcagtgccagggtcgtctgggggtcttctgctgcaccctgaaacaagaagcggtaacatcactagagcaccactactgtgttaattccccagatgcttctggctcacgggcgccaaggcaacttgccagtctctaccaagaccgccacagctgagccagtcctccggccaacccagttgccaggccatgctgggtcttcaggaagatgacaaactttccaggtataggactttagtggttacaaaaaagaaaaaaacaacacgatctaaaaagtcagtgctgatcctaaaaatggggaaaatatataccaggaaagattgggacccaaacaccaaaactccactgcaagcgtcatcgccgcacacacacaaaaccccactgcaagcgtcatcgcctcacacacacaaaaccccactgcaagcgtcatcgccgcacacataccaaaccccactgcaagcgtcatcgccgcacgcacacaaaaccccactgcaagcgtcatcgccgcacgcacacaaaaccccactgcaagcgtcatcgccgcacgcacacaaaaccccactgcaagcatcatcactgccgggcaaatgagcaatgaagttggttcctgatctatcaaaagaagtccatatggcaggttcacgtgaatggcagtctcagtacaggaaccacggtcaacttatttggaattcaccatctccacatcttcacgtgtcttatgagatcaaaagaggagatccaaacaaaaccatctcaaaggaaggaagcagtgcgagttgcagagaatgcacacatatttagagttaactccagatgaccttaaaacaatcatgtcattcttcagctttgtcctaactagttaagcactgatcagtttgactgtttcgcattaaccaggcaaaatcgtgcgtttgatcctcacatttatttgacaaatattaattaactgccaactctgtgtatatttagtgaaagagacaaagtcccggttcttctgaagcttgtgttccgcttgggagtaaataaatgaatccacaatggggtggtaagcttctcttccaaaggcatcatctggaagccccaaccccactgaccacttacaaatgcacaggatctcaacaggaacaacaaggcagaggagagactcaaccaactacacaagcacctccactttcatccaaacacctcaaagctaagggaagggaggcagaatcatctcaattggcaaaaaatagtagatatttcttgaaacctaggtgtctctgtctgttcaggctgccataaaataaaataccatacactgggcagctttttttttttttttttttttttttttttttttgagacagagtttcactctgtcacctaggctggagtgcagtggtgcaatctcagctcacagcaacctctgccccaccgtgttcaagcaattctcctgcctcagcctcccgagtagctgggatcacaggcactcaccaccacgccgggctaatctttgtgtttttagtggagatagggtttcaccatgttggccaggctggtctcaaactcctgacctcaagtgatccacctgcctcggcctcccaaagtgctgggattacaggtgtgggccactgcacccggccagcttttaaacaacagaaatgtatcacagtttctggaggcaggaaattccaatcaaggtaccagcacagtcagtgactggtgagagcctgcttcttggttcacgacggcacaggctagctatggaaggggcaatgggtctctttcacacgtctttcattacggcattaatcccactcatgagggttctaccctcataatctaatgatcacccaaaggtcccacctcctaatacaatcactgtggcagttaggatctcaacataggaattctgaggggatgcaaacattttcaggccacagcaccaagcagaaataggtccaaacaaacacaagttttcatttaaaacatgtgtctctaatgcgggagaggagaaggcttaaaatctaatcacataaatgcatccatttattttaaaaaatactaaaacaattttcttggataagttcctttcatgaaggaatctcacaaaagggataccaggctgctgtgacacacacacacacacacacacacacacacacacacacacacacaccccttcttgttttttcactgtcatgatgatgagagttaagaaagagaacctaatgattcagatcttttatttcattatctgcttccaaccaaatgttgaaaatgaacacatatgcccttcctctcatctattctcatttgtctagacatcgctactgtcatcacttatttgcgatgtcctctatgaatgtcttttaataaaggtgccaacacccccatgtaactttgtctcaactaaacaaacacacacaaaaaagcctcctgcccctgtttgagctacccttgtacaagttttcagtcccctttgggtatccacctcttctgtcacataaaggcagctgccctgcagtatcacggttaaggtagacctacagatggccagaatcctgggaacagagaggctttgggaaggccggtctctccctctgtagaaacccccctccctaaccctgctgacacctggtgtctgtgtgatatgccacgggccatggagtcacagctctttgtttgtttatatgctttaattatttctaattctacatctcctgctgacatccgaggaatcactgcagcaataaaagatatgtttcactatgaaagtatgtcagctgattttccttcctttgtcttctttctttttataatgtgattgatgcgtaactgggggaaggaataaaaggagaaccatttcattacagaagaaatgccgcagcattaatacgcattaagctgcaactgtgtatttgattgaagcccatctggtaaggtgcagcttacagagaccctggttttcatttagaacatttgttttcaattatgtgatttttgtcccccccacccagaagacactgagcactgggcattttggaatgtcataactggggggctgagcatgctgctgatatctctagtgggtagagaccacggatgctatgaaatattcaacaatgcataggacagcccccacaacagagaatgagccagggccaggcacagtggctcatgcctataatcccagcacttctgaaggccaaggtgggaggatcacttgagcccaggagttcgagaccagcctaggcaacatagtgaggccccatttcttaaaaaaaaaaaaaattagccaggtatgatggcacatgcctgtagtctcaagctacttgggaggctgtggcaggaggactgcttaagcccaggaaggcgaggctgcagtgggccaagatcacactactgcactccagcctgggcaacggagagtgaccctgttgcaaaaaaaaaaaaaaaaagccagcaaaatgtcaatagtgctgagcttcagatacctgctttagaaagagttacgatgatcaatcaggacgccatagctccctgtaatgctggaaactcacagaccctctttttactgtaaagagaagaatttcgctagtttctctaggaagactccctgctcaccttcacgcatcccatagatttctgttaagtgtcaactctgtatcagagatgctccaggtactggcaattcaaaaaagccaagtctcctgtcctcatgaatcctacattctccttcgagagacagatgataataaacccatcatgataaactaaaaaataagagtgtcaggtagtgataatgccaaaagaaaaataagccatatctgtaattcacagccatccaaaacattgcctggcacaaaccagaacctagcccatataatacaggctggtttctggtttgtgccgggtgatgttccaagcattttacatgtactagcccattattaactgtaaagacagtgttcctttagggaagatgccaagagaggtctttgtgggaagatggtatttgttcttcccttactttcaggtttttgctcaaacactgactccctcttcccctccatctcttttcacctttctatcaatctatattctgtgggttgcattgctttatttcggcgttttcggggcagggagacgagcactaagaaaatcccgccctaacttcacttagaagctgcccttttaaaagctagacagagatccgttatctccacctgtacccactcccgcctgtaccccccgcttcccccatgtgctccctccaacatttagccttcagaacaaccagggtcagctatgcagcgtgggagctacagaaagtatctccggagtaatgccaaggacagctccttcgctatctccatacctggcaaaacctccacatgcctctgatcccaggcactggcctcccagggctctttttagacacctttccaggattctcaacattcctccaactctcaattattgatagggaagaggaatacatccctctgaatttcaagaaacagcatggagggagaggccagctcgctttgctagctttatcatagcgtccctggcggtgggggaaagtcagaagctcctgctgtggcaaagtggctctcaacctgctgggctgacatgccccgcatatcccccacccccctgctgccatggagccccatctgctcactgggcatggggactgcaggttgagggcactggagctctttaccaggacacctaaaataaatacagccttggcccgtgcatgaggaaccaaggccctcagggagaaattccttctctacatccctctcttctttacttgatattgttgtttacatttctggtttggtttggtttgatttggttttcatctctgcaatgcctttctatccatattacctcactcaatccttatagccctgcaaggtcggcaaagtgcgagcgtgatccttcttagggcaaacacgtgaccaacgcaagctgttcttgactttccacagcagccccgacagtctgctctgctgcccatcagagggtcagtgagtcactctttcccatctccacaacacacagtgcttcaggtaggcctctggggctctgaatagttcaagtgtgctgtgtcaccttgcagctcccaaatgtcaaggtgtcaaatacaagggctctttctccagctgcaaggtcaccccctctccttctccattgttccctctcccgatcctctttccctgtccttcttcccgcatccccacccactccaaacccagctcagtacagaaagcagggtgtgggccaatggaggcatgaggtaccacccacccaccacccagggccacggaacttgagactcctgtcctcttagaatggaattattatcataatgattcttcttcttggtggggggccaatccctggctcggaataaacagagcaacttccacccactttggaaaggccatgcagaaaggcaggagctgaagaagaagaatagcactttccagaacaaaaagagaggaaatagagagaaaaagaaagaaagatgatgaaataatgtgaaggaggtgagggggcaggaggtaggaaagcagctctgcaacttgccttacattaaaccaaaaaggctgcacaaaacaatatgtatatctccttcaagaaataaaatcctggggctgtgcagtgtggcctgctgtcccaggcaggaggagggcaactgttagtggctgatgtctccagagccccccaaaagaaacaagtcacctgagaaacaggccagagcatcactgaagggacagagctacctgcatattaagtctacaagggcgaactaaggccccccctacaaagcacgttgggtgtcatagaaccgcagaccctgcagccctcaaaccttgctgcaagcagcttggtgcatctgctccaggtcccagtaccaaccttcaataggtcttaagtcccatcacctcctttctggctcttcctcactggggtgagtcattgctactaacaaccgtgtctgaggatggcaaaacaaagcaacctgtgatgattgtcagcgtctgggaggcaaacctgacctccgccaaacccgcacacaccttctatcgcacggattcaggacgggggagctctgttcattttgttctgaggtttcattcaactaaggctgtgatgaccctgcacgttgctggcccatgaagggcagtctcttcgtttttttaaattttgtatttgttatttttgagagacagagtctcactctgttgcccaggctggagtgcagtggtgtgatctcagctcactgcaacctctgcctccctaattaaagtgattctcctgtctcagcttcccagtagctgggattacaggtgcccgccaccatgcccggctaatatttgtatttttagtagaaacagggtttcaccatgttggccaggctggtctcaaactcctgacctcaagtgatccgaggaaggcagtctctttaattgaagcttgtcaacaagtcagagctccctgaggaaaggccaaggccaaggtcaggggactaattggtgccccctgccagctacagctacatggaagccaagtgttacacgccagtggaaaagggtacagggatctcaagaggagccacccaaggggcttgggacgtgcagttgccagggaaggggctggcgggtggcctgcctggggcccagcataggtgctgcctcctcccattccccagcctctgcctcctgccatcctcacttaaccccagacacacaaggcaacgttcaataattgatgctgtttttattactgagaagttgccataataatgacactcgtaacacaatcttttaaattattccacataatggaaaaaaaattaaatgtcgcccctgatcaacagtcagaatatggatggtgcttacataacacatgaccttctctcctcgggagcccggcaccaggcagctgcccagggccaggctggctcccggtgatgagcagccagctaagaagcaaacagggacacagagtggcacagacactgaggcagagggtacagtcctgcctcgggtgtcaggcaggtcaccgctgtcttctttgccctggttaacctatacattcagggatcatgggtcatagtcagaatccctaaagacaaggaggatgacggtttaagtacttggtctctcctggttttttaatgcaattcttgccttgtccaaagcactaggattgtacctctaactcagcttcagttcattccttgtacagtaataatgctatatccaatcagtggacagcaaggcaggttttcaagctttgaattattctacacttgaggtttttaaaatcttggccaaagaagcctgagctccttcctccaggaagccttcctagatgtactcaacctagtatggatcaaatgtactcccttccatcctcccctggtatcctgaataggctttaacttttcagttctcttttttttttttttttttttgtttgagactttcttgttctgtcgcccaagatggagtgcagtggtgcaatctcagctcactgcaacctctgtctcacgggttcaagcaattctcatgcctcagcctctcgagtagttgggactacaagcacgcaacaccacgtctggctaattttttttttttttttttcagtagagatgaggtttcaccatgttggccaggctggtctcacactcctgacctcaagtgatccatcctccgcagccttccaaagtgctgggattacaggcgtgagccgcagcgcccagctgacttttcagttttcttaagcatctcaaagccatgaggctcaaaatggcagctgtgtctcgcggccctactgtcagggcccagcacacggtctgtgttcaataattcaattaatttatctgaacgaactaaatgacagaggctccaaaataagagggaaatgttgcataatacagaacataccgatctagggtaaccacaagtggttaggccctgagaaaagagaggattggtgcacagaggggaagaaaaggcttaaaagaattaacgattttctagctaatgccaaaaagcgtgacgttccatccacccctgccgtctatcctcttgatgattaagataatcaatatcagccctgcgaccacatgaggacgggtagatacctatcctatgactccccagtgaaagcttccatctccatcctcctttctggcataaatagtcagagtgggacagcctagctcactcccttttaaggtaagatctttccaccctgaagcccacgatccctccaatgccacatcttccagcttcgtccccatcaccttcatgaccttaacatgaaacttcacaatggtggaagttaattacgaacttctagctatatttaagctacataagtacgccattactcaaactatcttgtgagagacaaaaccttttcctagtcctgatgccaaagttctattcaaaatcaagcgtatttaagcacataaaacagatttgaaagcatcacacagctctgcagagacacagctctatgagaatctgcagatagccctccagtagccattccaggtaagcagccctgagcttgtattccaaagagctaggtctcctactagcacggctgacagagaggtagagcttggcagagttttccaaagcattatgctttttcttttcgctcaaaaatatcattttccttaaaacagtaacagaaatccaaaagaacacaagtaaccgaagtataatgaagtatttcttttctaatcctcgatgattatccaacactcttaatctaatcctagacttagtcccagactttattaaaatgcacccatataatccactctgagctttttctggcttctcaacagactgagaacctccagctggtgtttatcaataaagtttttctgacctatgttatccttttggaggatattagatgccttcaaaaatccatcaaaagccacaatttctctttcctaaaaatgtgtatgtatcgcacaactattgctaggtagcaaaacaccccaaaacttagtggtttaaaaaaacagccggttattattgttctatggtcaactgggcatggctgctcatccacctgggctcactggtgcatctgaggtcagctggtggctcatcgaggggctggatggtctaagatggcacatgcacctggcagccagcaggcagttggccaggagttgactggaaaacactgattcttcttggtggggcctgtcatcttccagcagactagatggagctcattcgtacgctaacctcagcatccaatgtcaaatgcttttcaagtctctacatcacagaggccaaagcatcatcccagtggccaaagcaagtaaatgggtatccacattgaagggttggatgaatcaatggtactttttgttgggaggacctgcaatgtcacattgtcaggtacggatgctgacggggaaatttgtggctattttgccatttattgcagtacatatgcacagacatacaaaatgttgtgtgtaatatgaggaaccccaggaattccctgcagctctccatggatccagactagaaacaattgctttagcttaaacccacaaactcaatctcattcacttaaaatagggcttctccagtgaggacacaaggatacattcttagaggtctgaaagttttacacagattttttaaaatttcggccaggcgccgcagctcatgcctgtaatcccagcactttgggaggccaaggcagatggatcgcctcaggtcaaaagttcgagaacagtctggccaacatggcaaaatcccatctctactaaaaatataaaaatcagccaggcgtggtagtgcacacttgtagtcccagctactggggaggctgaggcaggagaatctcttgaacccaggagacagaggttgcagtgacccaagatggtgccactgcactccagcctgggcgacaaagggagaccctgtctcaaaaaaaaaaaacaaacaaaaattagccaggcgtgatggcttgcgcctataatcccagctattcaggaggctaaggcaggagaatcgcttgaacctagaggggtgaggaggttacagggagctgagattgcaccacttcactccagcctgggcgaaagagcaaaactccgtctcaacatcatcaacaacaaaaatagacacatagaccgatggaacagaatagaaaccccagaaataaacccaaatacttaaagccaactgatcttctacaaagccaacaaaaacataaagtggggaaaggacactctttttaacaaatggtgctgggataattggctaagcacatataggagaatgaaactggatcctcatctctcaccttatacaaaaatcaactcaagatggactaagcactttaagatgtgaaactataaaaattctagaagataacattggaaaaacccttctagacattggtttaggcaaggatttcaagaccaagaacccaaaagcaaatgcaataaaaacaaatataaatagctgggacttaaagagcttttgcacagcaaaaggaacaatcagcagagtaaagagacaacccacaaagtgggagaaaatcttcacaatctatacatctgacaaaggaccaatatccaggatctacaataaactcaaatcagtaagaaaaaaacaaacaatcccatccaaaagtgagctaaggacatgaatagacaattctcaaaagaagatggcccggcacagtggctcacacctgtaatcccagcactttgcgaggccaaggaaggcatatcacctgggatcaggaattcgagaccagcctggccaacatggcgaaaccccgtctctactaaaaatacaaaaattagccaggtgtgatggcatgcacctgtaacctcagctactcgggaggctgaggtgcaagaattgcttgaacctgggaggcggaggttgcagtgagccaagaatgtgccactgcactccagcctgggcgacagagcgagactctgtcttaaaaaaaagaaaaaagaaaaaaaaaaaaagaagatacacaaatggccaagaaacatacgaaaaaatgctcaacatcaccaatgatcagggaaatgcaaatcaaaaccacaatgcaatagcaccttaatcctgcaagaatgaccataataaaaaaaattttgaaaagtagatgtttgcatagatgtggtgatcagagaacacttctacaatgctgctggaaatgtaaactagtacaactactatggaaaatagtgtggggattccttaaagaattaaaagtacaaataccatttgatccagcaatcctactactgggtatctagccagaggaaaagaggtcatcacatgaaaaagatacttgcacatgcatgtttgtagcagcacaatttacaactgcaaaatcatggaatcaacccaaatgcccatcagtcaatgagtggacaaagaaactggtgtatgtatgtgtgtgtgtgtgtatatatatatatatatatatatatatatatatatatatatgatcgaatactacactcagccataagaatgattgaattaacagcattcgcagtgacctggatgagattggtgactattattctaagtgaagtaactcaagaatggaaaaccaaacatcatatgttctcactgatatgtgggagctaagctataaggacacaaaggcataaggatgatacaacggactttgggaacttggggggaagggtggcagagggaggagggataaaagactacaaacagggtgctgtatactgctcgggtgatgggtgcaccaaagtctcacaaaccaccactaaagaacttactcatgtaaccaaataccacctgtaccccaataacctatggaaaaaaatttttttaaatatatactaatattgagaacctaacaatgattcttctaagctcaaaaatcacaaaaactatttaagtcaccactctctgtgcctccagtggtcaaagtaggagccaagagtccatgtgtacctctgtacatggacaaaatctccttaattcctcattctgtcttaaaccacaatttcccagagttccctgcttcgtgagatgctccaagggaaagattctgcagacaaatatgtttggtgaggtctatttcataagcagataaagattctgagaaatcccgcagtaaagaacagggttttgtttaatcctatatttcccatacttatttggccacatataaagcctattcatactcagcagatgaacttttaggggacagtgtttaatgcaattctattctgtattcaatgagcagaatactcagcaaaatatttctccttacacagcagcatggtcatatttatccaggggaaaaggcactggaacccttggcctcaaaatgtctatcactttcacaaataaatgtctttgtttaccatcattaaaaaatgattcagtagcattcatcatagatagatagataaatagataaaaatgattcagtagcatttatcatagatagatggatggataggtagcctcttgtatacataggtaggtaggtaggtaggtaggtagatagattgacagatagatagataaatagcctcttgtagtcataccagctggagattacaaaaaccaagaaggtaatttttctataaaacccagccctcaggctggatgtggtggttcacgcctgtaatcccagcactttgggaggctgaggcaggagaatcccttgaccccacgagtttgagaccaacctgaacatggcgagaccccatctctacaaaaaataaaagtaaaaaattaaattaaatttaattaaattaaaaagcgggtatagtggcatatctctgtggtcccagctactagggaggcaggaggatcgcttgggcccaacagctgaaggctgcagtgagccatgatcgcaccactgtactcctgccaagcaacatagtgagaccttgtctcaaaaaacaaacaaacaacaaaaaaaaaacccttcctttttcttcaccacaatttataaaaataaaagtaagtacaccagcgcttctattaccaatcctggaaaagagatctttatctcagcactgctgaggaaaaaaggttaaagtatggcttatcaacatttttcatagctttggcaaccataaaatgatttttcctgactccaggaacacgagggtgagagagagtgtgtgcacaaaagagccagcatgaaagagcgagcctaagacagtcacaagccaccaaacagagtggactgatggctcaggaggcctgttctcatcaccttctggtgagacctccgagtattaggacaatggataaggctggaaagaaatatgcttgctattctcacatcagttagaatggcgatcattaaaagtcaggaaacaaagatgctggagaggacgtggagaaataggaacacttttacactgttggtgggattgtaaattagttcaaccatcgtggagaaagtgtggtgattcctcaaggatctagaccagaaataccatttgacccagcaatcccattactgggtatagacccaaaggattataaatcattttactataaagacacatgcacacgtatgtttattgcagcactgttcacaatagcaaagacttggaaccaacccaaatgtccatcaatgacagactggattaaaaaaatgtggcacatatacaccatggaatactatgcagccataaaaaaggatgagttcatgtcctttgcagggacatggatgaagctggaaaccatcactctcagcaaactatcacaaggacagaaaaccaaacaccgcatgttctcactcataggtgggaattgaacaatgagatcacttggacacggggcggggaacatcacacactggggcctgtcaggaggtggggggctgggggagggataatattaaaagaaatacctaatgtaaatgatgagttgatgggtgcagcaaaccaccatggcacatgtatacctatgtatcaaacctgcacattgtgcacatgtaccctagaacttaaagtataataagaaaaaaaagaaagaaatagtatgcaaatggtacctaacttacttcaaaagaaaagctgtggctttgaagaacgtgttcaatgtttctttaacggggctttatacatggcatcactcaacttggagcagaattcattattaaacttatctgggcttgatgaggacttgagagctgagaaagtactgaagcagcttgcttctaagggaaacatttctctgcttcctgctgtgggtatgtggagactggcatcttcccttctctctcttttctaagcctaaattccaaagcaaataaccaaattgagacatacaccatgcctggataagattgtcactgctgcatgaagaattaccacaagtccagaggcctcaaacaacactcctttttcaccaccgtttccatggggccagagtccagggatcggtgcagctaggtcctctgctcagagtcccacaggctgaaatgaagacagtggctggggctttgatctcctctgaggctcagggtcctcttccaagcatattggctgttgtaagaattacgtttcttgcaactaagaaggattcaggtccctattttcttgctggcttcaggctggtgacctctctctgttcctagaggctgcccttgggttttgggggttttttgctaattttttttttctgagatgaagtcttgctctgttgcccaggctggagtacagtggcccgaccttggctcactgtaacctctgcctcccgagttcatgcaattctcctgtctcagcttcccaagtagctgggactacaggcacacgccaccacacctggctaagttttgtatttttagtagagacggggtttcatcacattggtgaggccggtctcgaactcctgccctcaggtggtccacccgcctcagcctcccaaagtgctgggattacaggcgtgagccatcgggcccggccagcccttaggttcctgacaagtgtctgcctctacggggagtcagctccataaagagctggctatatgactataagccacacagctgttagcttctgcaagaccagcaggagacttctctctcacttcaagtctctctgacctcaaggaaggcccactctctcttttaagggctcacctcactatgccaggcccacccaggataatctccctttccatggagtcaagtcaagagactgataacctgatcagtaacttaatgggacttaattcccatcacagggaggggcttctagggcacacacaccatggggtataattctttttttcctttctttttttttttttttttttgagatggagtctcactctgtcccccaggctggagtgcagtggtgcgatcccagctccctgcaagctccgcctcccgggttcacgccattctccttcctcagcctccagagtagctgggactacaggcgcccgccaccacgcccggctaattttttgtatttttagtagagacggggtttcaccgtgttagccaggatggtcttgatctcctgacctcgtgatccgcccacctcagcctcccaaagtgctgggattacaggcgtgagccaccgcgcccggccactgtggggtataattcttaagggccatctcagatctccacctaccaccacatatctgtttagaaaaaactctctccctgacatttctagcacgttgacatttctagggtctaaatgtacccttaggaaactaattctggagccatgtgttatgaataagatgtagcgctccaccaatttttttatggcacaaacttacaatcaaagctccaaactcataggaggaatcccatttcttctgatacatcaataaatgacaacaagtcattatatagttgaggttctgcctggcaaaggcttcagctcagccatccagggaagatatctgtgttggcctcaggggcaaaagcagcattaggcacaggagacgcaatgtccagtagcccacctttagggacccatgaacagttttaatttcttctcaaatcagaagaaaaaataacaactacatgataatgaatccagcctagattatattcatccttataccaacacagctgcaaaatataagttttagtctttttttgtggagaaaggagcccagaaaggcaaaagctgctaggacccccaaaagtacaaaggtggctctgctagtggcgccccccgaggtacacacgagttttcctcgtacgatgcaagtgccatggctattccaaagggcacctgagccagtctcagaaagagactttagtcaagactctgatcctccagtgctgacctttgggctaagcaacaaatgaagatagttcccagaccactgcaggacagaattaatatgctaatttgcttaatgagaacaaattaacctaaagttacaaacacagggctaatgaagccacatgtggtccctggatgagctgcgtagttttgtttggatccatggttaccttggcctcccggtccgcatcagccacctaacagctgtaagctgatggcctccagggagatgtaagggtataaatgaaacaattaaaatcctcctcaaatgccagaaaacaggcataaaactattatcagcaatatcaataggattatcatcctgtttaaaaacaaaggaagaaggaaaaagaagaaattgaagtaaaagactgtaaattgggaatgggcgtgacactcaatgttctgaggtaagtgctagtgtgagatacttggccattagtatgaaaccaggtagagtatgccaacaactgtaaactagttcaaccattgtggaagacagtgtggcaattactcagggatctagaactagaaataccatttgacccagccatcccattactgggtatatacccaaaggactataaatcatgctgctataaagacacatgcacacgtatgtttattgcggcactatgcacaatagcaacgacttggaaccaacccaaatgtccatcaatgatagactggattaagaaaatgtggcacatatacaccatggaatactacgcagccataaaaaaggatgagttcatgtcctttgtacggacacggatgaagctggaaaccatcattctcagcaaactatcacaaggacaaaaaaccaaacactgcatgttctcactcataggtgcgaattgaacaatgagaacacttggacacaggaaggggaacatcaccggggcctgttgtgaggtgggggaaggggggagggaaagcattaggagatatacctaatgttaagtgacgagttaatgggtgcagcacaccaacatggcacatgtatacatatgtaacaaacctgcaccttgtgcacatgtaccctagaacttaaagtataatttaaaaaaaaagaaactggaataaaacatctctaaaggttgaaaaaaaaagctggaggaaatatgggactagaaaaatgctgagatggataaaagtatggacgatccctggtttctggcgtttcaagcttttttgactttacaacggtgcaaaagtgatatgcattcaatagaaactgcactttgaatacctatacaaccgttcggtttctcaatttcagtacaatattctgtaagtttcatgaggtattcaacaccttattataaactaggctttgtgttagatgattttgcccaactgcaggctaatgtaggtgttttgagcacgtttaaggtagctgggctaagctatgatgctcagcaggttcggtgtattaaatgcatttttgacttacagtattttcagctatgataggtttattgagatgtaatcccactgtaagtcaaggagtatctccaaaaggaaggaggtgaggcttaatgtgtggaaaagataccaggatggaagaccagaaaatcatgcagggagatacaaggtgccacaccatgccaacagctgagaaatctgaacagagaggaagttctgctgttagatacctgaccttgtcacttcaactcttgttcataaaactagggaattcagactgaatagtccctgaagcctgctctataccaaaccatccacaaacctacaaatttctagaaaaaaagacaccaactcccattccatggaagagaaaatggctccaacccctccccataagtttccaagccacttgtagaagtcgtagcacaccttgaggaaaagagcccttggctgcaaggcaggtcttcattctgctgaaccagggtgacaggcccagctgagggcaacgcagccactgaaaacccacagggcatccaagggaggcgcaggctggcacccctgctggcctgggtggtgctgcctttctcagtcagaggttccctgtgggaacatcacatccagtgggttccagagaggaagaactctcagcaaaggtgaaggtttaaactgagaaaattgtgacctccacgcaagccggcccaggctctttcgggtgtgggcattcctcctacaaagattatctgttgagaattactaccgccccccacagagggaggcttagcacatatactcaggtgaaagatgggaatgttctggaagtgatagtagtttcagaaattaacagatcttctagggcaggggtccccaatccccaggtcacaaaccgggccgcacatcaggaggtgagcagcagggggttgaggaaaggaagcttcatctgtttttttttgttattgttgttgttcttttttttgagacggaggctcgctctgtcgcccaggctggagtgcagtggcgcgatctctgctcactgcaagctccacctcccgggttcacgccattctccttcctcagcctcccgagtagctgggactacaggcgcccgccaccacgcccagctaattttttgtatttttagtagagagggggtttccccatgttagccaggatggtcttgatctcctgacctcgtgatccgcccgcctcagcctcccaaagtgctgggattacaggcgtcagccaccacgcccggccgcttcatctgtatttacagccactccccactgctggaattactgcctgagctccacctcctgtcagatcagcagcggcattagattctcaaaggagcatgagccctattgtgaactgtgcatgcaaaggatctaggttgcgcgttccttatgagaatctaatgcctgatgatctgtcaccgcctcccatcacccctagatgggaccacctcgttgcaggaaaatgagctcagggctcccactgattgtccattatggtgagttatataatcatttcattatagattacaatgtaacaataatagaaataaagtgcacgataagtgtaatatgcttgaatcatcccacaaccatccatcccccgctctgtagaaaaattgtcttccatgaaactggtccctggtgccaaaaaggctagggactactatgctagagtgagatattatacctttttattataagaaaacaccctcatgagaagaaaatgctatataagcatgctcagagagagagagagagagagagagagagagtgtgtgtgtgtgtgtgttttccttttatctagaagaccagctcctaagcatatcctgggagccatcctaaaaccagcctccacaccagagtgcccgcccaggaagcaggcaaaagagggtggtatgtccacaggtccctggagggttgggctaacttaagctaggaaaatcaaaagcatcccttcccaagcaggaaaaataatccgtgacgaaaagctccaacagccagaggagagagtgctttgcaaaaaacacaaacccatcagaggcaaaaggtactgattgcttttctctgacatgtatcttcagctggagcaatgcacaaagcattcgcactgtgcaccttcagagtggatgctccaggccagcaaatcagcctcagattaatgttgagagccgctggagagctcatcactgccaggacatgagggatcaactagggaggttaataactgtgcccagccccttaacagcagagctaaggagggcgctttcctctctgcagtctcagttcttttccaccctcggttgttacaattgtctacacgtggagaactaatagcattcaccaccccctctcctccaccccagaccccagcctccttcttctccacctcctgacagcatcagcccccatccaacctgtaacatcatcctgcatcccggcctgggagcaacaaggagaaaagattgtgttcccttgtgggcctggaaagcaatgtttgtttttggttttaggagctgatgcatgtccagaaaattagctgttgccccagaaaccccatgagctaagcgggaaagcaggaagggaagacatcagttctagaatttaaaaggaaggcatctgcgaggtaactatggagagcctgagactcagtccagagaacagagaagagtttgcccaggttccaccagagccgagaccaactcacagcaaagtagctgcatgacgatctctctctctctcttttttctttttttctccattcctaagaccaggacaattgtgtggaggaaacccattgggaatctgaagggctacaggtcatgcataaggtcacacagaaggaagtgactaatggtctttcagtttccccaacccagtcagaccactgtccctctgcttctgcccaaggtgggaactagcctgatgtgcaggtggtggactaagcagcaagggacagagtgaccacagaggcctcgctcttcacacacacctgtgcatttgggcagaatcctccccgaccgcccatcagcacctacaggctacagaactctacacaaaggacagaggaaaaaagcgtggtgttgactcctgtgtaagaaaaatgcagccaccacagaattcacaaagagcaagacacgatccttctcggccaaggaaggttctacacacgtgcggacgacacaatccctgggcctcccagagttaactgaaaggaaagaattattttttattcttttttttcttttggctaatttcccaagccaatgtcattgtgccctgcgcctacaccgtcccctgcttgagtaggagatcagagtccagggtcctctggctcacccatctctgatgcacgtgctcaggtctaccatgggaagccaatgccatcaaaggacaggccacgatgtcccgtgttctggaggcacggggctctcggaggcttttcccatgtctgggacacattccctcaacttaaggagtcacactgccctcagggaacatattgcaggaaggttacagggtttgacattttcactggagcttaaacatgatggcccaggcctagggtaaggatgggaaaaccagctggttccaaggagaccaaaatgaagccagcttcattggcagcagctagacaccgagcgcccaccagaggactttccagggagggctgtaatgtgcggagggagaacagggtcttacagaagaggacagccagattcaggggagagaggagagagggaaaaagggggtgggaccaacagaagagggacaggatccatttcaattctccactaaaacaagcccctggggacaaaaaccaaggcatctccggagttcaaaaccacttctgtgtcatgccttatggacaccaaccaggaaccttgagatgccaacaatatggcattcacgttccttcttgttccctcctctctcgcatcctcttccccctactcccttccccttctccccttttccccatctttctctctctctctctcactcacacacctctaatatttcctctacattatgtatataaattttcaaaacctatgtatataaatacacagcagacaatccagaaggaaacacacccaactcatctccctggttactagggaaacggatggcaacactaaaatagatgggtggcagagagcttgttggttttctctttaatatttaaaaaaaattatgacacaggccacagtgtggaaggttcatcccagaatataatggcctctaaaatattctgcccaagcctggcaggccagcccctggaacagagattcctcctcctaaaatgaaatcttcctgcagtgaggctggtccggggaccgaagcccagggaaagagacaccaacggcagtcccagcaccacctccacatacctgagcgagatgcttcccagcatccccagagcacttatcttttgttccaaaaaaatgttaatagtccccaaaccatttagactttcatctttcaaccgttaaaaggtcagtctttccaaaataagtctggagaaaaatcatcaataagcaggtcacggtcatttggtggagttagagaaaagatatcagcagaatctgtacacactctctgcctccctccagaaacaaattcattttttgctctgaactaggaaccagcttcctagcttagaactttctgcttctcatggtcacaacttttcacaccttcacgtttgcaatactatttatgtgagccgggaagcaagagcttattacaagtaacaagccctcagatgcagcaacgctctgcaaccagccacatcacaccaacacgggtttcccttttatgtctgaaacaaagggaattctgagcaaatgtgctgctgaattgccagagaggcagggaagcaaagctgctagtaagagaaaacatataataagccccatcagcttaaagctacacacacaaaaaaaaccaagcttttgacatcttgctgggggcaaactcactgatgagaattaagtcagctgtaatgcaccgggaattgcccagaagactgtcattttatgcttatttaaaaagtggctggaggactggctaagaaaatggcaatccaggagtgcctgggtcaaagggccagtggatcctggggtcaccttgggtttctaacagccccccaaggggatgagaggaagcctccccaccaaaagaaaagtggagaaacagtggaaaacttatttctccttagacagctccttcgagctggccgcatgggcactgtgtcctcagagcctggctcatgggctccctgccttgtcttccccttgcacggcacctccgctgggtgtctggggctctgggtgtccccaccactcctccagtgcccacaaacaggctgatcgcagcagcaccttccttatgcggccggatgttacatcggagaggctgactgtcctgcctctgaatcacccagacctcttgtttctccaattccctgctttctgatcagtctctgctgaccatacgagtgacccagaaggaagacgataaaatgcaaataaccactcatttactatgaccatctctgatgatagatttgggaacggttgagaacttgaactaaaatgagatttctggtagccggttacctctaaatctgcttacagaaataatcatggtttgtatgcaccactgctcaccccctccacacacacatacacacacacacacacacactctctctctctctctctctctgaaaaaccagtttacttctcaggtggcaagaaagcagctctgggcccactgctcaacttcccctcccacaggaaatggcacagcgccccccgattttaatgaaaatctcagccctttatttccaaaaccctctggactgggaatgcattttctcccacttcccatccagatggaaagcaaacataaaatccacaggagagagtctgccatcagcacttgtgatcaacagcatttcgaggaagcttgactccccgtgagcagagcaccaacgtgaaggcgggtctcagcagctcctggctgtcccagctggggccgggccgccccccaggaggactaccaaactgtatcccttgttactagcatatgcaaccgggatgccacccccacagtctacctacacaagtgggcttacaacaccaaaactggtttgtagtgtgtttaaaaaggagaagactcaggggctgggtgggaggggcgcaggattccaaatgagccatctggggagacaggttttatctacaaagcacctacggtttgcagactcaagttctgcttacaacctgttgggacccgagcttctctctagaaggagaatacagtgtgtgtgaagtttccaggacacctggcatgtaataagccctcaattaatatgaactgtgatcatcaccagaatcattattaaaccaaatactattctggaactaccttagcagtggaaggaacagagaaggagaaagaaaaacggtctcaacgttgctgtaacaaaatcacagccactcaaatctaaataagtgaataaaagcatatcccacagaatagaaaaggacacgttatagttattggtgttaccgctttctcccttccccatgggtgacagccatcacggcccatcatgtccagagagccaaggatgcaaatcagtgggtgggaagtgagatgaagtgttcacagcccagccaggtaagggcattgcaatacacatcaccgccccacccttccatttcatagatgtgttctgtggtctcccgatccaatcgtaaacctaatatttactcagtgaaagcagtatttgtgtgcgttgccatctaaaatccaataagtatggagacagaaaagaggctgtctgcttatgaggcatgagggcaaacacagcgagctctttaaagagccattgagctaatcaatatcctctcccatttccattcaggggccctgagccaacggagacttaataattattttccatcattacaaccctccgagaagcttacaaagaaaaggtcactgtttctaagtttgttcttctctatttgccaaacacagattatttcctggggtccatgaggatctcttcccagactgtagcaaccaaagacagccctcactaggcctcttggagccggctttagaaacaggatattgctctgcccgtggaaatcactgtggtcatcacatttagttgtctggcctcctgtcctgaccttccctgccaaggtcaagttttggccaaccctcctgttggatattctttttaatttgtccaggtctcaaaaataaacaccaacctctgtggtaggtcaggcaggaaggaaaaggatgctgtgggttgctggacaccatgaccagctccttcaaccgagctcctggacagcgaccacacaggcttcagctgagccctttgtgcccacatgcacaccacgaagcccaccataaataccccaagctgccttctgcttgtcctttccttaggaaacgtgaacaaacaataacatagaaaaattatggaaaccatcttttccttgcataaaagttggctcaaacaactagttaagattaggtttgattagaagaaatagaaaaccctactgcagcgacttacacaggaaaggtttatttgtctgggtcagcagaaggaccagggtcagccatccagcgggtacagtggccccagcactgccgggggggcaccaggctactctgtcacctgagtgatggctgtcgcaccccaaggaccaccctgctgtttccaggagaaggaagggcaagtagaagatgagaagggacaacctccctgatgacttttgctgacctcacatggtttccctgggctgcaggggaggctgtaggtctaggaattataggtaggcacattgctagatcaaacagaattggagttctgttagaaagacaaaaggataagtggatttttttcttttttgagacagggtctcactctgtcaccctggcaggagtgcagtggcacaatcacagctcactgcagcctcgacctctggggctcagatgatcctcccacttcagcttcccaagtagctgggatcacaggcatgtgccaccatgcccagctaattttttaaaattttttgtagagatggagtttcaccatgttgcctaagctggtcttgaactcctgggctcaagcgatccacgtacctcggactcccaaagtgctgagattaaggcatgaaccaccgcacctggccagtaagtgattcagtaggtaccatggtctgaaagtttgtgtcctcccaaaattaatacagtggattcctaagctccgaggtgacagtccagtcttgtgtgcatgatgacatgaaagtcaacagtgggtgacatataagacagtgattccacaggatcataacagagtgaaagattcctattgcctagtgacatctggatgatcctgaccctttgtaggcctaggctaacattcgtgcttattttattttttattttcttgagatggagtctcactctgtcacccaggctggagtgcagtggcgcgatctggctcaccgcaacctctacctcccaggttcaactgattctcatgcctcagcctcctgagtacctgggattacaggcgcccgccaccacacttggctaatttttgtaattttagtagagacaaggttttgccacgttggccaggctggtctctaagtcttgacctcaggtgatccacccaccttggcctcccaaagtgctgggattacaggtgtgagccaccacacccggcctaatgtttgcatttgtatcttcattttgtaccaaaaaaaaaaaaaaaaaattaagtaaaaaggaatttaaattttttaatagaaaaaagcttacagaacaaagatatcaaacaagaaaatacctttgtacagctacagctttacagtgtgttttaagctaagtgttattacaaaagagtcaaaacgtttttacaagctgataaggtaaaaatgttacagtaagttaaggccaatgtattattgtagaaaaatattttgattgctttagtgtagcttaagtatacagtgtttacaaagtctacggtagtgtatagtaatgtcctaggccttcacattcactcaccactcactcactgactcactgactcacccagagcaacttccagccctgcaagctccattcatgatgagtgccctagacaggtgtactacctcttatcttttataccatgtttttactgcacctcttctatgttcagatacacaaatacttgtcattgtgttacagttgtccacagcattcaacacagtaacatactatacaggtttgtagcctcggagcaataggctacaccctacagcctatgtgtgcagtaggctatcccatctttgtttgggtaagtacactctatgatgtttgaacaatgagacatttctcagcatgtatccccaccgttgagtaatgcatgactttattagaaggtagggcctttgggagatgattaggtccagggttagtgcccttataaagaggtcctagaccaggcggtggctcacacctggaatcctcacaatttgggaggccaaggcacatggatcacctaaggtcaggagtttgagaccagcctgaccaacatggtgaaaccctgtccctactaaatacaaaaaaattagccaggtgtggtggtgcatgcctataatcccagccactttggaggctgagccagaagaatcacttgaaccctggaggcagaggttgcagtgagccgagattgtgccattgcactccagcctgggcaacaaaagtgaaaacttcatctcaaaaaataaaataaattaaataaattttaaaaataaagaggtcttagagagctgcctcaccccttccgccatgtaaggacacagtgagaaggtgccctctatgaaccagaaagtgagcttttcacagacacaaatctgctgctgccttgaccttggacttcccagcctccagacctgtgagaaataaatgtctgttgtctataagctacccactttatactattttgttatagcagcccaaatggactaagacagtagggtatcagttcagctgctgtaacaaagatagaaagcgaacaatgactgaagtacaatagaccattatttcttagccagtattatttcttaggtaaaagtcctggtagtaaggctacagcaggtatggtgtatagagcaggtatcaagaaggactgaggctttgagaaaacaagaatgaaaatggcagataggccaggcgtggtggctcacacctgtaattccagcactttgggaggctgaggcgggtggatcacgaggtcaggagattgagactatcctggctgaaatggtgaaaccccgtctctactaaaaatacaaaaaattagccgggcgtggtggcgggcacctgtagtcccagctactcgggaggctgaggcaggagaatcacttgaacctgggaggaggaggttgcagtgagccgagatcatgccactgcactccagcctgagcgacagagcgcgactccatctcaaaaaaaaaaaaaaaaaaaaaaaggcaaataatgtcttagcattcttatgaaaattaatatttgaatttttaaattattattattattttaacctctcagctcccttgaaaggatcttgaggaaactctaggcagtcccccaaacacactttgagaactaccactttaagatcacacctctttaataaatgaacaaaaggataaagacatggcaaacaacaactcagtccctaggtctcacactcaccctccattccaattttccacttaaaaagaaaaagagtgataactgaaatgttagagaaagtatgaatcatcaatgggcaacaaccactgctgggaaaatgacaccgagggggaaaatcctcatttgcagaaaggcacagaaatgtctctgttggccgggcgcggtggctcacgcctgtaatcccaacactttgggaggccaaggcaggcggatcacgaggtcaggagatcgagaccatccaggccaacatggtgaaaccccaatctctactaaaaatacaaaaattagcctggcatggtggcacgtgcctataatcccagctcctcgggaggctgaggcaggagaatcacttgaacccgggaggcagaggttggagtgagctgagatcgtgccattgcactccagcctggcaacagagcaagactccgtctcaaaaaaaaaaagaaaaaagaaaaaaagaaatgtctctgttaggtctcaggattatatattgtaaccaatgttacaaagggacaggagtggtgggaatttctaacatggtgcccccaaagatgttttgcccttatccccaggacctatgactatgacacgccatcagtaccatgctgtggtgtgttgtgagtcacagcttgcgttaggataagattacccggttgggcctgacctagtcccaggagccctgaaaagcagaaagctgtgtccagtgaaggcagaaagggaagtcagagagattcgaaagtgagaaagtgcctgagccatgactggctgaagaagcagggagccacatgggaaggaatgtggacggccccaaggagtggagagaggccctggctaatagccagaaaggacatggggcctcactcccgcagccctgctgtatcctgccagcagacaggagcttggaagggactccgaaatccagatgagaacacgaccggctgacccacccacgtgctcccaaccctctgacctatggagttttgagctaacaaagggtgctgtttaaagctgttagacttataatcatttgtacacagcaagagaaaactaaaataccagggcaggaaaaggagcgtgtccccaggccctagttcatgcagataaaacctgtcttggatatcagaggcaaggggagaacacccccacccctggtgagatacaccagggacaagtttagatgaaccacctgaaaaagcatcagagaaagtgaaagagcaaagagcagagagagggactagggacatgtgggaaagaaccatgaagtgctagcaccttccataaaacacacaaacaaagggctggaacagaaacacccccacacagcaacaatgagtttggggaaacggtagtgatattatccaaagggtaacggctcccaaagtgaatgaatgcttcctattcaataaagcagtaaagtaccgaggtggcctggagagcacggccagccaccagctgcctgggagagcgaaggtgcccaggagaccgactgcatcggcacctgttcccaggagcctctcccacccacaaagccacaggaatagcaaccagcagtgagtcaccgggtcaccagagaaaaaccagcaaaatgtcagtctccgagcaagcttctctatcattggattcctagccagggtggtcgttgagaatcttccaggccgtcctccagcctgcgaacgcaggggaagtacggggaggttctagtgagaatctgggctgtcgtctgggccccatttgtaaaccccaaaccacagccctcttccctgcccttaggcgttccctgccttcctcttcctcttccttccttccttcctctttcccttctttcctcccttgctccctccctcccttcatcagatatttaccgagcattgttccctgtgagtcactgtgctggtgttggcgacacggccaagaacaagcctaacaaagtccctgtcctcaaggagcctacattgtggtggggaaaccgatgataaagaagtaaaaaatatacaaacgaacaaactggataaggaaggttgctgacaagttctaggaaggaaataaacagagaaagccacgcacattgtggggggtcagggaggagcttgggaggagacatttgcactgaggcagccacgcacagagcttcgggaactctgtttcagagaaaaggaatagcagatgcaaaggccgggaggtgggacagggcttggggagcttctaagaagggggtggggagactgtggggagcatggaagtggaggtgagggagtaagggggaccagtcaggaggccaggttctgggacagagacagtaatgccttaggctggggtggaaaggagtggacaggatgggtccacaagacctttttggaaaggtgccaacagcacttgttcatgagaacgaaaggaaacaacaaatcatctctgttatcattgaacacttagggcacgccaactctggtaaggccctgccttcagccctgggatacaaagaaggatgaggtctgggtcttgctttcaatgaggtgactgactagccagaaacataattttacaaagataaaaaagaaggcccttgctctggggctgacatggttaggttttgtgtctccacccaaatctcatcttgaattgtaaaccccataatcaccacgtgtcaagggagagaccacgcggaggcaactgaatcatgggggcagtttcccccatgctgttctcgtgatagtgagtgagttctcacgagatctgatggttttataaggggctcctcccccttcgcttgccacttctccttcctgccgccttgtgaagaagctactttttccccttcaccttccgccattattgtaactttcctgagggctccccagccacgcagaactgtgagtcaattaaacctccttcctttataaattacccagtcttgggcagttctttataatggtctgaaaacagactaatacaggggctatgtaagtgagacagataattctcactccagttatgctgagaggaacctggactccgagagcacatctgatccatggaaatactgtctgtcttcacctgtcttgagaagcagagcaggcaatgggatgagggacggatagagacattcccaaacattactggtgaaagtgtaaatcagtacaagctcaggagagggcaacttgagaatttctagaaaagggaaaatttgggtcctgatgtgtgaagcgccacagaaaatcgagccagttcaggcccctgccttgtccctacccagctgagctgcaaggaggctgctctgcagagctcacactaacccacctccctccaacacaggaccccaaaacaaatcttgcctataacaggtagcatgctggaaaaccaagacctcagatgatgcagctggcagagtctcaaacctatgctactgcccaaggtagatggaggcaaagcagcatgccctcctcccataacctgctccccaaagcggcaagcacccctcccatgacttgctccccaaagcagcacacccacttcccatgacctccccaaaatggtgcatccttctcccacgacttgctgctggatccactgattcctacaccagctctccagctgggacagccacccttcctgtccccagccaccctgctctgttaagaccatgacatcctatttgcatctataactcccaccaacaatagcgggacccaggtgcttatttatgaagatattactgtacatgtacaaatctcaaagaatcatctaaagaacgattattaacaaaaaaaggtattttgtttggtggctcaagacaaaattagtggtggctcaagacaaaatcaatagcttttctatgcaaaaacaacggccagatggaatatgtcatgaaataggagaccccgtctgtaatactcataaaaggaaatgaaatacccaggaatacattcaaccctaaacatgaaaagtccttatgaagaaaacttaaaatgctactgggagacgcgatgagtagcctggatagatggagtggtgagctttgttcttaggcagaaacgctcatcgtcataaacctgtcatttctgcctacgttaatgtagaaatttgaaacaaagcttgtaaaaaaaaatacctagacgatgttcttgaaattcgcaagctgatgctaaagttcacatgggaaaatatgctgtaagaataaccaagaaacttttgaaaaggaacgtaatacaagtaatacagaagacgaatagatgataagacgtgaagttgcagcaactgaaacagaatagtacctgaagaggcagagctgaaaagattaaagcggcaccatataataaaaatagaatgtgaggctgggcacggtggctcatgcctgtaatcccgacactttgggaggctgaggcgggtggatcaaagaggtcaggagtttgagaccagcctggccaagatggtgaaaccccgtctctactaaaaatacaaaaattagccaggcatgatggtgggtgcctataatcccagccactatggaggctgaggcagagaattacttgaacctagaaggcagaggttatagtgagctgagatcatgccactgcattccagcctgggtgacagagggagactccatctcaaaaaaaaaaaaaaaatagaatgtgagctacaaatataacattaaattttctggtaggcacaatcaccaaggggaaggaaacaggtgaaattaattgtaataacatattttattttatccaaatatatccaaaatagtttcacttcaataaggtaagcaatataaaaattggtaatgagatattttatacatatatatttttagtaagtcttcaaaatccactgtgtattttttatttatagcccatctcaatctggactagtcacacttcaagcactcaatacacacatatggctggctaaatggctagtttattattcaccttaggactacaaaaatccagaagcaaatacgtaaatacatcttctgatttagtaaattttatagctggcatttacattaacggagaaaagatggattattcaacaaatggtatcaagacttctgagagccatctggaaatacatacattttaatctctatctcactttttataccaaaatagattattttaatccctatctcactttgtataccaaaatagattctggatgaattaaatatttaaatgcaaaaaaaaaaaaaaaggaaaccaagttgtagaaaaaaaataggtatttttaatcctcttggaatgaggaagactttactaagtatgaatcaaaaaagactaagttcaaagaggtacaaattaaataaaaatctacatggttggaagcaccataaacagactcacaagtgaccaactgagaaaagaattataataatattgcagataattttctgaatacacaaggagctccaaaataatgagttaggaaagaccaaccatggaacagaaaagtaagagaaagacacagacacttcacagaaagggaaatacaaacagctttgaaacacgtggaaagatgctaagctgactaataagacaaagctgtaggccggagcagtggcacacatctgtaatcccagccacttgggaggccaaggcaagaggattgcttgaggccaggagtttgagaccagcctgggcagcatggtgagactccatctctaaaatttttttttttttttaaacaaagaagactccatgaaataccattttttacctattcctattaacaaaaaatcaaaaattttactaaaaccctatagggatggggtatggataaagacattctcaaacattgctggtaaaagtataaatcagtataagctcaaggaagggcaacttgagaatttctgtaaaagggaaaattcacaaatatccactgtataatcccactttcagaaacttagttttatagatatgttcacatggactcaaatacagacggtagctactttctatctgatgtggtccaaactggtcattaataggttaattttaaacatggaaaatgggaagaatctccccccaaaagtaattttaatttcaagcaaataaatgtgcattcacttgcaaatcttatgatgtaaatcagaggcctctttcgtccatatcggtcaactgataaaagttctgtttcgtctattttgcaaaaaccttgttcgtaatacttcatttacaatcttcagattttgtttctttaaagtggtggaaagacttaaagacacctggggagaaatctggaaatagaatctccatttttctaattcgttgccaagtcttttttttttttaacagctgtctctactatgccttatttgacagaaatttggtgattcaatgttagcaaatctcttcaaatctgaactttcattaaaattacataacatttgatgaaatcaaatgatggcagcaagtgcagctaaaataaatagttggattaatgaacaactgactcaggttgcactgacgacagggctgcaagtgtttggagtataatgggcagcagaaacacagagtgtctattatccatgcatctccatccaggcaaggtcaactcagagaacgtctattaaatatccaccaggatattcactgcatcactgttcctaagagtaaaggacatgaaacaatcaaaatgcccctcaacagggaactgattagataactcacagtaccttcatttgatggaatagtacccagggtgttttttgttgttgttttttgtttgtttatttgtttttgtttttttttttgagaccaagtctcactctgtagcccaggctggggtgcagtgccgcgatctcagctcactgcagcctccacctcccaggttcaagcgattctcctgtctcagcctcctgaggagctgggattacaggcaagcgccaccacaaccagctaattttgtatttttagtagagacgaggtttcaccatgttggccaggctggtctcaagctcctgacctcaagtgaaccacctgcctcggcctcccgaagtgctgggattacaggtatgagccactgtgcccagcctgttgttgttgttgtttgcttttgtttttaaataaagcaacatatatggatgtgctaagatggaactcctctgtccaagatgtggtgaaatcaggctatggaacagactaatatatctacacttacatgcttagggagacagaaagcacctctggaaaaatacagaaaacaacctggttacaagtggtcacctctgaggaaataaaataagtaaccagaagacagaggtgagagaaagacttttcaccacagatccctttgtaccttttgagtgatgggctgtgggcaattttctctttcaaatcagagccaggctcttcacccagactccataaagatgcccaacggtgagaacgaagtcggaagaaaagaggggttgctgagagctggtgagttactaaggaaaagggaaccctgggatctgccctcaccatctgggcaaggctccaagggaagtggggatctgtgaaatccccagatggatttgggaatctaagagcaggggccctctagacccctttcctgagtgctgttcaggggggtggcaagctccagagaagtgccagcagaggggtaaccaggcagagaggacctgggtagcctcaggtttctcatggctcagagtggggctggaatcgtggagtgattctgggagcctcagagccacattgaaatagagaaacaggaggcaggcccatcgaattgccactatcagcagcaaaaaaacccagctcttgcccctgttcttcccccatgaagcagaacggccttgaaagctgcttgtagcattgcattgcacagagcatgggcagaacaaactcagccaccccaggatgggcacagaagtagccatgagacctgaaggggcttggtcaaacccggcccacagtctgtttttgtaaataaagctttattggaactcagacatttaaaaaaaaaaaaaaagaaagaaaagaaaaagaaaattcaagaaataagattcctttcccttgggtgttgtgggatacatgtaaagcccaggcacactgaatccacaggcttcccaggagttcgagttttattcagcaaagcagctgttctcaaagtggggtccccaaggccagcagcatcagcaacacccaggaacttgttagcaaggcaagttatcaggccccattccaggcctctggtgggcccagcaacccgtgtttccgcaagacctccaggggattctcatgcactctcaaatgtgagaatcaccgcagtgaagcaacgccttttacaggggctgagaaaggtgaagtctcaccgcatctggttaccattcctgtgtgccacaaagtattttatcaggctctgagtcatctgacatttccttctggaagcagaatgttaaatgaataaggaggaaggccatttgtttatctgaaacataacaatatcccaaatctatttcatttacttctaaagctaatgattctgcaatccaataactctagagaattgcacacagcagcaataaccctcttatggaatcaattttctctggttaggaacaaagaattctcccctccaaaaatccaacctgcattgattagttcatcagagcacactaggaggcccagccgggctagaggcagggcaaacacagtaagttgtctggggccacacctccctaggaatgtgcacactccacgtggctgacgccactccacaaggcaccaggtacaaggcaatgatctgctcatgcttaagtggcctgggagggacatacaggggggaaaggacagaaagagctagctgagtgagggccacgcagacagcgcccacagaaggaggaacatgtcacagagtcgctctctgaatttttgcccacaactttgctgacgggactagccagctatatctgaccctatcaggtattacccacttgtgacattcatttccatgcaaaccttctttatttgcatggggcctgcctttttttttttttttttttttttgagacagagtctcactctctcacctaggctggagtgcaggggcgccatctcggctcactgcaacctccacctcccaggttcaagcaattctcctgcctcagcctcccgagtagctgggactacaggcatgcaccacaacaccgagctaattttggtatttttaggagagacagggtttcgccatgttggccaggctggtctcgaactcctgacctcaggtgatccacccacctcaaactcccaaagtgctgggattacaggcatgagccaccgcatctggccaggcctaactttttattactgtcttttatttattaatcttcctgcaatcgatgccctatctccctgtgatgggttgaactgcattcctgcaaaagatgttgtctataaatgtgaccttttttgcaaacagggtctttgtaaatgatcgaggtaagataaggtcattagggcaggtcccaattcaatatgattttttccttataaaaaggagaaatttggacacagagacaggcacacaaggaaaatactacgggaagactggagttatgctactagaagccaaggaaccaccaaaagctaggagaggggcttggagctcatccttccctggagccttgaggaggcacatggccctgctgacatcttgaggtcagaatcttagaactactttccagaaagttctagcctctagaactgagacaataaatgtctgttgtttaagctattcaaattgtgatatattgttcccacagccctaggaaaccagttcactccccagtaagactccagggtcccccagaagcctgacggctgtggagctagctttgaaagccaggacaccctagtcacaacacaaccactagggggagatgttgaggtgatgcaaaccacggctggggagctggacaaactggtggttgccaagcctggccatgcagacaaagccccggtgaagctttttagaaatacagacgtctaagctccacccaaagcctcctaaatcagaacatcagaaagtcgagtgtgacgcgccacctgccaggcactggcccacagaccctccaaggacccttccaactgtgaggtcccattactgccacactgctgcaccctccacccccagctagcccgagggggctccatggatcaggagcatcagccaccttgacagcttgggagacacatacagtcttgggccccaacccagacctgccaaatcatcatctgcattttaacaggctcccggggtgaaccgtgcacacattcaggtgtgagaagcacttgtagattggatataagacataatcacaggccgggcatggtggctcatgcctgtaatccaagcactttgggaggctgaggcaggcagattacttgaggtcaggagttcaagaccagcctcgccaacatgagggatgaactggttactgtcttcaactacaatgactagttttttataccagaagggaaagaataaaagcacagggtattgtccaataaaccacaaagctctgacatagtatggatgtgtgttccctccaaatctcatgttgaaatgtgagccccagtgctggaggagggcctggtaggaggggtttgggtcacgggagcagatccctcatgaatggtttgttgccctccccacagtaatgtgcgagttctcactctgttggttcaggagagcactggttgtttgaaagatcctgctagttcttttgctccttcgcttgtcacgtcacacatctgttcccccttcaccatctgccatgattggaagcttcttgaggccctccccagaagcagatgctggcactatgcttcttatacagtctgcagaactgagagccaaataaacctattgtctgtaaattacccagcctcaggtattcctttatggcaacacttaatggactaagacactccacaaggacctgaagtttgtctcttattaggtaatcaccaaatgtacttgtgtaaagtgtatccagtttgagtgaatggggcacttagcatacagttcctggatttgtgacagaaataagatggaatgaacaattaatcccacaatctactaaagaaatcagtaagaggtaccctgacactcccatggcaaattcagaaatgttaaaatatgctccccattccccaaaaaggggactgaatgggctattaggggaacagatggcttgcactagaattctttagcaatctctggaaaataagaaatgtttttttccttgcctaaagacaaagtcctgaatcagaataccccttcctcttccacaccaagtctttctccactccaaaacttcatgacacttacagagaaaggtgaagccccaacggttgttttgggaacaatctccctcatccactcacccatccaaaaatgacaccacttaaaaaaacaaacagccggtgggggctacttcttcccatgttctcgtcctgaatcgtaaaagagcaaagcctactttccattattactcttggcatgaatggtttaaaaagagcatctataaaccagaaaagagagccacgtaaaagtcagctctcttttttattatttttgtgagtacataggtgtgtatatttatggggtccatgagatgttttgacacagccatgcagtgtgaaataagcacatcatggagaatgcgacatccatcccctcaagcttttaccctttgaattacaaacaatccaattacactctttattttaaagtgtacaattaggctgggcacagtggctcacgcctgtaatcccaacactttggggggccaaggcgggaagatcacctgaggccaggagttcaaaaccagtccggccaacatggtgaaatcccgtctctgctaaaaacacacacacacacaaattggccgggtgcggtggtacatgcctgcaatcccagctactttggaggctgaggcatgagaattgcttgaacctgagaggcagaggctgcagtcagacaagatcacaccactgcactccagtctaggtgacagagcgagaacttgtctcaaacaaaacaaaacaaaacaaaacaaatgtacaattaagttattactgactctagtcaccctactgtgctatcaaatagtaggtcttactcattcttattccacttttttttttactttttcatgttgcaaatctgaaactcggtaccttttaaacaacaactccccttttctcagtgcccctagcccttggcaaccgcagttctactttctgtttctatgaattgtgttacttacttatttatttatttatttatttttatttttgagatggagtctcactctgttgcccagtctggagtgcagcggcatgatctcggatcactgcaacctccgcctcccaggttcaagtgatcctcccacctcagcctactgagtagctgggattacaggcgtgagccaccacgcccagctaatttttgtatttttagtagagacaggtttgctctttttaagattacaatatgcaggcagagcatggtggctcacgcctgtcatccgagcactttgggaagccgaggagggcacatcacttgaggtcaggagttcgagaccagcctggccaccacgataagacctcatcttcatctctactaaaaagatgaggaagttctagaaatctgcttcacaacaatgtgaacgtatttattaacactactgaactgtgcacgtaaaaatggttatgctggtcagttttctactacgtgtctttcaccacaataaaaagaaagataaaaataaaacaacaacaacaaagaaaacaattgtccatccttactcaatgccagaggctgcagtcccacagcacagccagatcttggctgtatttcacagagttctcctgactctagaatcatccttcctttaattgtttgatccttttatttgcaatgaaatgattttaccaagataacagtacaagtttctcttacatttcttggagctactatcatcccttataacataacagcgagggtataaatattccattacgtcaaatcattttgtttatactatcccaggatatgtcttaaagacatagattacctttaaatgatctagtcttgtatctgtttttgccttctaatagaatttttaaagggcatctaccgttccaagaaattatcattgtatttgggaagtatgttcatttataatgacaattctgtcatgcaccctcaccttccatagtttatcaagctggctttgagtgaagactgtttttcttattccactgtttcaagatgtggatttttgcatttgttaagagaaggtgataaactctcatcttgaaaatgaaacagatcattacgtaaagtctccaccagtatttgagccctggtataccactcttccagtgatgggcttcacatacagaaattacgaaacttatttagggacataactgtcacctaggataaaatgactgctctcgttagaggctcttcagtaaatttcttttgtcttcattatttcagtaatttattctttcgatgagacgtcatcctaaactacacagcctaaaaatggataatgctgcacgtagtatcagactatttgcagatgatgctgtaagtgacttacccatcttagtacatgaaaggcataacatcaaaaatattccatctcaaaagcaagcattaggctgcaaaattaattaaacaaaaattggtgacatgcactacccttaggtcctgcttggtcttacagttagaatgctgacattcaaaccgatgcagagccttgatggctgctacaaataaattattccaaccagttacaaaccctaagactgccgggttcagacagcttgatcctagtcactacaaaatgaccaagaaagaagaaaataaatgaataaatacaaaatgaccaagaaggaaaaaacccccaggaagggttcaagtataatagtgtgatatattaaagaaacacatttccttttcctatcaggattttttttctctctctttttcaagatggagtctccctctgttgcccaggctggagtgtagtggcgtgatctcgactcactgaaaccttggcttcccaggttcaagcgattctcctgcctcagccctcagcctcgcgaggagctggagctacaggtgcacgccaccaggtccagctaattttttttgtatttttagtagagacagggtttcaccatgttggccaggctggtctcaaactcctgacctcaagtgattcacctacctcggcctcccaaagtgctgggattacaggcgtgaagaaccgtgcctgtcccatatcaggattttctaataattctccccgaccaacacacacacatctacactaaaatcttacagtgtatatatatataacctagagactaaagtttaggctgcttaagttaatgactgtcaagaccagggaccattactgttatacaaagtacggaagaaatattttggtgactattacatgagacaaagtctgctgatctactgtcaaatacaattcgtttttcctttactttgaggtcatttagtcaatagtttttaagactccttcttaaggcaatctttcagaaatgtagaagagtacagagaataacaagatgtaagtccacgtaccaacgatctagatttaataaaggttaacctgttaccatatttgattcagattttttaagtaaactattacagaaagaattgcagctcttctctctccgcaccaattagaggtactcaatatctgaaaaattccatgggtatgctttataacgctatttttacacttttaataccatgctaatatatttttatatgtctacaaaaaattcacactattattttatacaatttcaaactttagttaaatagtattttactgtatgtagcattcggcaacttttgttatttttatttattttttaatttttttttttttgagatggagccttgctctgtcacccagactggggtgcagtggcgtgatctcggctcaccacaacctccacctcccgggttgaagcaattctcctgcctcagcctctcaaatagctgggattacaggcccacgccaccacacccggctaatttttgtatttttattagagatgggggtttcaccatgttggccaggctggtcttgaactcctgatctcagataatccccccgccttggcctcccaaagtgctgggattacaggtgtgagccactgggcccggccatgcaacttacttttttaaatggctacttagccatgctatcttaatgaatttaccacaatttaattattcattcttctactgactgataatgtattcatttccaatttttcaccattacaagaaatgctgcaatgaacattctcatgcagggttccctgtgtacattcgcaagaatgcctgaagaacatgtatctaaaactgaaactgctttgtcatgggatatgttatatcttcagttttaccagatattaacaaattactcaccaagatggttgtatcaatttgcactcccatcaacagtgcatgagagttcctatttatcaaaaatctcttttgtcaatactgaatattgtcaaaccttttctcattttttttggtcaaatacaaaaggtgagaatttaaatcgcagaggccaggagtggcggctcacacctgtaatcccagcactttgggaggctgaggcagatggatcacctgagttcaggagttccagaccagcctggccaacatagtgaaaccccatctctactaaaaatactaaaattactcgagcttggtggcaggcacttgtaatctcagctttacttgggagactgaggcaggagaattgcttgaacccaggaggtggaggtggcagtgagccgagatcacgccattgcactccagccagggtgacaagagtgaaacttcatctcaaaaaacgaacaaaaaaagaaaaacaaaataatttaaattgcattccctttattaccagtgaaactgggcatcttttcatgtgtttattggttctttagggctccttcctcataaattcctaatcaaatagtttgttcaatttttttactgtgcacggtttgccccttttcattgatttgtggaagacctttatatattctggacaccaatatttcatcagttgtgtgtattgcaaatatcttctcacaagccttggcttgaatttaactctataacgtcttttgtcacagagaagtttgtttttcttaatgttataaattgctttatcactagttggctactcattaaaatcacctggagagcttttaaaaaatactaatgctaaaaaataagttacagcgttagaaagcagatcagtggttacctgggttcagattggcacatgggggatgtattagtctgttctcatgctgctaataaagacacacccgagactgggtaatttataaagaaaaaagaggtttaatggactcacagttccacatggctggggaggcctcacagtcatggcagaaagcgaaaggcacatcttacatgctggcagacaagagagagcttgcacagggaaactcccccttataaaaccatcagatcttgtgagacttattcactatcatgagaacagcacaggaaacacccgcccccatgattcaattacctcccactaggtccctcccaggacatgtgggaattgtgggagccacaattcaagatgagatttgggtgggggacacagccaaaccatatcgggggtgctgactcagaaggggcagcaggcaccagggaatttcctacaagggtaggaaaaaatcttaaatttgattattgtaaagattacacaggtgtacacatttgtcaaaacacactaaactagaaagttaaaatgggagcgttttatgtaaattatacctcaatacagttgatttgaaaaaacagatgcctgggctctaccacgtacaattttagttagaatctgtaggagttgaaacccacaatctgtatttgttttaagtgtccacagatgattaaaatgtgcagccagggctgagaaccactgtcctaaatattgttgaagcattgctaacttcgcctgggagcatttttgcaaagggtatatggtagattacaattttggaggcgattccactggatcaacatttattgactaatcaatccttttcccactgaattataatggcaactctgccatgttccatacaccaagtttctatatattcatgagacttgccagtcttccccgttgattctgtacagctatggcacaatgtcacactgttgtaattaccaaaatgttctgctgtttgcaaggtcaaaatcctttctcttcctcctccctctcttactctccttccaaaatttaagattttttcctacccttgaaattccctggtgcctactgccccttccgagtcagcacccccaatatggtttggctgtgtcccccacccaaatctcatcttgaattgtagctcccacaattcccacatgtcctgggagggacctagtgggaggtaattgaatcatgggggcgggtgtttcccgtgctattctcatgatagcacctattcttggtcctgtatttttccatatgaactacatatttagcctcacgagtttcacccaagtttcacccgttacagtcatgaactgccacgcctggcctggtttctacttttcttcataaaaatcctgcagtatttcatttgcttcatatacagtagccaaaacccacaagcaattcaatgtccaccaacaataggatgaataaataaatatattcatatggtggagcattgtataacagtcaaaaggaattaacaagagctatagacaatgatgtggataaattttattcctatatttaatgaaagaagcaaaatacacaactaatatatatagaatgttttcatttatatacaattgaaatactaaatcatgttgtttagggatgtacatataagggttgaaactataaaaaagaggtaattataaaagtcagaatagtggtgacttagcagcaagtagcaacagggattgatcaagaggggaatacatggggagttagggggacttttgtttcttggcatggtggcggttacaaagatatttgctttagaattattcattacgtttgttgtataaagttttttacgtgtatcatatttcataataaagtgaaaaagcgcttttaattagaaatctgagctctggtactccacaaacaggatccagcctactttaagtagaaggttctctctagataggagctgaggatatggcctgacccgcttgatctctgtgcatcatttaactctaaatcatctctttagaaagaacaaacactccatgagactttcaaatcaaatgccctatacggactgggttcttgatgcttttagcttctccatgctttgaatatattatatgttggaggtgaaggagggggttatttgggctaattgaacatattacccgacaaagcatggtgctagtttccacctggatacagaggtgagttaggtaagaccctgccctaaaaagcttgcagtagccagttaggcagccaacagccattcccactagcatctatgtctcttcttcaacctggacagagagttagattatatatgatacagccctgccttcctgtcttgacctcatctctcaacactttcaagctctccatggcaggttgaatgactggccccagttctttagccctccctgcaaccatgcccttgtcatggccttatcatgagcacagtgtgtttccccaccccttgaccttgggcttggccatgtgatttgcctttcatccaaatagatgtgcaagtgactatgaattggccaagagattgtgagcaggtgtactaagcactacatcaggcctgacccataagaaatgaactcatcattttccccaatgccataaccagctccaaggagagggatcaaatccacctaactccctgtgatggttaatttcacatgtcaacttgactggactaagggatgcccagatagctgacaaaatactatttccaggtgtgtctgtgagggtggttccaaaagagattagcatttgaatcagtagactgagtaaggcagatggccctcccagcatgggtgagtatcatccagtccatggagggcctgaatagaacaaaaaggtggaagaaccatgaattcactctctctcggcttgagttgagacatccatctttcctgccctcagaaagtggcactcctggttcctgggctatcaaatttagactgaatgttttaccatgaattccccaagattttccagccttccgacttggatgaattacaccactggctttcctggttctccagctcacagacaacagatctcagcctccataactgtgcaaaccaatttctttaataaatcctccccccgcccaatgaatcctgactaatatactcctcaagccaaaaataatctcccacatccaattggttaccaagtctagctgtttcttctgaacatcttttttttagatctacccctaattgtcttccttaaatgccaccctaatccccacccttctgccttcccgcctagcctattgtagtagctggagtctagtccagcaccctccacactgccctccttcaccccagagccacctttctaaaatgcaaatctgaagatgtcactcccttgccccaaatccctcagtcccaccactgcctacaggataaaatctaaattctttgtataacatgtcacgcccctcctgatacagccctgcctggtgtctcggccccgtctcttaccgcagctgcaccctccgtggccgcttgaacgtttggcctcaggttttacctctatgtgcgtccacgttcttcccatggccttgtcatgggaatagtatgttttcctactttattggttttctagggctgccggaactaatcaccacaaactgggtggcttcaatgacataaatttatcctctaagagttctggaggccaaacgtctgaatcaaggtatcagcagggccattttctctccaaaggctttaaggaagaatccttcttgcatcttccagctgttggtggttctcagcaaccctcagcactccttggctcgtggcagcgttactcccatcttggcctccatctttgcatggccatctcctttgtgtctttgcttcccttgtctcttctctttttagaaggacatgagtcatattggatttatggcccaccctactctagtacgacctcatcttaactaattacatctgcaaagaccctttttccaagtaaagtcatgttccgaggttccaagaaacatatattttgggagacactattcaacccagtatacccaccctttgatgctggcttctaccatgtgacttgcttagccagtggtatgtggatggaagtatccatgggtcggttctgtgcctaggccttagggagccttgttactgctcttccttttgtgcctctgcccttgtcatgagaaaaacatgccctggtccaaggcagatggcagacacttggggcagagccaccctccccacgaccatctgcagtcttgcagcttaatgtagtcaagagcagctgacccccagctgatccacagatgcatgagaaagctctattatcaatagagttggtccagccaattcacagacaccaagaaaatcaatccttctagttgtataccgctgagattttggggttgtcatgcagcaatagttaacgaatgcatacactttgtgccacagcaacaatgaacgagccggcctgctgcaaggtctctttaacgtacagagtagctccctctttttttgagatggagtctcgctctgtcgcccaggctggaatgcagtggcatgatctcagctcactgcaacctccgcctcccaggttcaagcgattctcctgcctcagcctccagagaagctgggattataggtggccaccaccacgcccggctaattttatatttttaatggagatggggtttcgccatgttggccaggctggtcttgaactcctgacctcaagtgatcctcctgcctcggcctcccaaagtgctgggattacaggcgtgagccaccacgcccagccagagtagccccctcttatccatggttttgctttccacattcccaaactacccagtcaagtgtcaagtgtggtccaaaaatattaaatggaaaattccaaaaataattcataggttttaaattgcacactgttctgagtagcatgatgaaatctcactctgtcctgcgcagaatgtgaattattcctttgtccagagtacccgcattgtctacgctagccatccattagtcacttagtaaccgtcttggttatcagatcaactgtcacgacttcatggtgcttttgtggaagtaactcataatttactcagtaacggccccaagcacaagagtagtgatgctgggaatttgaatatgtcaaagagaagccataaaatgcttcctttagatgaaaaggtaaaagttcttgacttcagaagaaaatcatatgctgaggttgcaaagatctaaacaaatctgttatccatgaaattgtgaagaaggaaaataaattcatgccagttttgctgttgcaccacggggtatgtaactgctaagatgaaaaaggcgttaaatttacgagtggaagacatgaacagaaatgtgttttgattgacggccctcaggttcgatactatccaggatttgaggcatccactggaggtcttggaaagtatcccccatggataaggaccaccatcctccttttaacgaggataggatgtagagccgtgctatgtcacaaggaccactgtactgttcctttgtctgaaatgcatgccccaccatctcctgtcaagcccatctgcctgacaaattccaaattaatctttaagtccaaagtcatgcaccaattttaggaagccttttatgactctcccaagtagactgagtcactgttattcagtgctcccagcctatgctcacctccattatagacagtaattaccactctgtaattgcttgtttatataattacagggcttttgatccctgacacaagcaaaatgtctggcaccaaaagttggcactaaatgaatcacagaaaacaaagacgtgataggaatggggcagtaagtgggaatgaggaaaagggaagaagactggcagcctagaagggaacactgcaaaagtctgaaaaagtctcaagtccagactcacatctctatgtggttttgacacatgcagctgctttggggtacaccttgcagtatgaaactcatccaatcactgaatcacagaactgaactctgggggtccccgctgaaatgactcagtaaagttgcaaggaaagccagacagcagaggagtcccgttctgagaggtggaagggagatggcggcgttttccgcagccacagaggtggggtcagatgagaaaggcagcaattttaaagcagctattaggaagaactctctgactttaatgtggtgagagtgaagcacataccaagagtggtttcagagtctcactgagcagaacaatgaccaggacaaggacgatgacaatgaagatggtgatgattccaagagggcaacaggtctgatgtgacgtaagcacggccctacatcccatcctcaccaaaaggaggatggtggctcatttctcaaggcctagcatctcaaaatacatcccgttagaaaaaagatcataggttcctagcgcaacactaatatctctttctggagatttcaattatccaaattacattctttactttttaactgtctctcattctctcactgccatcctcaaaaatttacatctctccccagccatctctttgtctggaatgcaataatatttgatccttccactctgcaagcctgctggaaaattaattaaaaaccagactgggctcaaagaggccctttcagtccaggaatctcatagggcttagcactctgcagggaaagatccgctccaggctgctaatcattagcctacctgctgcacaccttggagcctaaaccatcaaacagttctcatcaccaagggtttattgagccttatatttggagataatttcatacacgtgttttgagtgctctccaaggagtaatccctagcagtttttagtgcactggggattgcagactcctctgaggagccacggaaggcaacaggtccatttcctgctgtggtgaacactgactgcctagggctgcagatggttttcttttattttagctatcctgtatctgtttttttgtttgtttgtttttttgagatgaagtttcactcttgttgcccaggctggagtgcagtggtgcgatctcagctcactgcaacctctgcctcccaagttcaagcgattctcctgcctcagtctcccgagtagctgggattacaggcacgcgccaccacacctggctaagttttgtatttttagtagagatgggggtttcgccatgttaccctggctggtctcgaactcctgagctcagctcatccacccacctcagcctcccaaagtgctgggattacaggcctgagccaccaccacacctggccggtatcctgtatctgaacccctttctgtgtctagggaattgcccactttatgagacaaggacaaagacctcttcccataacaggagctgccagatgaccgagttctgcctaccagatgcaccgggatagtcagactatctcagaaggcagcaaaatcagctgagggatccatttctcccctcccccattcccctcttcttctccttctccctctcctctcatctctcctttctcccctctctctctgccttctctctctctctctcaatccctctcctctcatctctcttctcccctctctctctgcctcctcctcatcctcctcctcctcctctctctctctctgatgctggctgacacaaaagtggcagcaattgcatccaacttatgttcccgacaaggatatgggaacaaggcacataggcctctggtgctgcatggccagtagcagtctgctcagcagaacagttcagcgacttggttttgggtgttactcttggaagctgagccttgagtgtggttctccttccctcctctcccatcaacattctgggagctacttggtatccttaataagctccattcctgtttcatcagccagggtcagtctctgttgcttgcaacccagaaccctgactgaggaacacactcattttcatatatcatatcacaaggtcagaggccaactgaagttttttaaaatcctacattgactctcagcccaaacataccttcctatagctccaagatattaaggctgaggctttgaaactacatttttgctttgctagttgttctttgttaggctctgcaagtcaaggatattagaagaaaactttagtgcttgaaaagggacacgttcctttctgtctgctgactattgttgtgagctttaccccagaaatgcttcttcactgtggcagccgtaattcattcctatagtatctgctgcatccagtttgaactttttccaatatttgcagaactgtcttcattgtgccctagcctaagacaccatcaccagcctgctggcccctcctcatggacatttgagtttcagctctgaagggcccttctctaagtttctaagttttaataattccaacttctttctctatttcctcatcccgagcagtggtagctgctttctatagttgctacctttgtgataccttagagttctctttttaccctagctaacaattttattccagttagttagccatttgttgtgttaaattctctctgttcaaataactgatatgctttctatctggaactagaacctgactgatagatatcagccttaagaaaaagttgtatacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaaaagaaagaaaaagttgtatgagtatcccatttgcaaccagagaaaacagaaacagagaaataggaaggaagaagagtttccagccaagtcaagatgtaaagtctcagactcagaggccatggaatgagttcaagccatacaagtccagcaagcaaggttatgtgtatacctgggtgatttctgcaatgtgaggaggcaaaagaaagacaagaccagacatactactcagagcccacaggtcccctgcaccaagtcctgcagagaggctgtaccagggcaatggaaagtatcacagacagaacaggtatgggaaaaaataataagttttctgagcatagtgggtgggaagcagggaatagactatcaggcttaggaaagaatggtgaaaacatgcctaaaaccctctgcttgtttgccacaactgaaataacaacagcatcattactaagatgctcttaggatattccaggccttgagctaagcatatctgcacagattgccacagtcatcaattacaaaatgcattctattgtaagacataccattacttgaggtatcactaagaaagaaaaatatgctgtcaattaaacaatgacccgccattgcctgtaagatgcatcccaattgtaaagatagtaaaatatgaaaaaaaatgcttcttacaatcaagggaacatggcagctcatttaatccttataacaattcctatgaagtaggtattggggcttaaaggggcaggggctgagtgactagttcgaagtcctacagtcagcaagtggcagagcatgcatctgatctcagtcggtgggatgccagagcctgcgctactggtaactctggtgcctcttaaaccatttagaagtcagggatcaaactcttacttaacatgtgcaaatgttactgttctattttgagcttttagatgaccaaaaggtattagccatgagcactgagctggtcagacagggtcagagaaagggctctcactaccaaatttccttcaatggcacagagcagagagcaatgccagctcccctgcaaggcaagaggaaaggcacactatggggagaactaaagatgcaaactgtgtgagttccctgcagctgctataacaagttatcacaaatgcaatggcttcaaacaacagaaattcattctctcataattctgaaggccagaaatgcaaaatcagtatcactgtactgaaatcaatgtgtcagcagggccatgctccctctggaggctctagggaagaatctgttccttgcctcctgtcagggcttcctccctccaattcagcctctatggtcatgttgcctcctcctctcctgttcaaatccccctctgcctccctcttataaggaggcttgagattgtatttagggcccaccctggagacaatccagcattacctccccatctccacatccttaacttaatcgcatctgtaaaggtccttctttcatataaggtaacatccacagactccagagattaggacctgagtatctctgatggcccttattcagctgaccacacaaaccaaaggtggaacctgctgctggggcttcccaagcccagacacctaagcaaatatacacaggttgttgaaatttgaaatgttagtttgatatttccatttttcaaaacttacagtggaagagaaactttacctgcaaatatctggaaatgtacagatcaccccagcttgacgggccgggaatcattacaacagaaattgagttgtgtgtgctaatgctgcaaagtactcatatgacaaatgaccttggaccggtctgattggatgttgggggcagagtcctgggtggagactgatggagaactagaaccctcacaaaggcactggtgggcagtagacagaaaagggatgagactagcacctgttttagagaggaggcagacaagaccccaggctaggatgagactggtgcctgtttcagagagcaggcagacaagaccccgggctgaacacggagagggcagagaaagcaatctgagtctacatgagaaaaggggaagggaacttcacagaggtgtgctgttgtgagtcctgggcaggacaatgactgagccaggggtgaggtggccacagagggcagcatcaaccaatgcaagggacaaagaaggcctgagtcaccaagatccgggataatcactatagatttcacaactctcttaccttggctgccactataaaatgccacaggccaggtacggtggctcatgcctataatctcagcactttgggaggctgaagcgggtggatcacccgaggtcaggagtttgagaccagcctggccaacatggtgaaaccccgtctctactaaaaatacagaaattagctgggcatggtggtgcatgcctgtaatcccagctactatggaggctgaggcaggagaatcacttaaacccaggaggcagaggttgcagtaagccaagatcgcaccactgccctccagcctgggcgacagagcaagactgtgtaaagaaagaaaggaagaaagaaagagagagagagagaaagaaagaaaggaaagaaaggaagaaagaaagaaagaaggaaaaaaagaaagaaagaaagaaagaaagaaagaaagaaagaaagaaagaaagaaagaaagaaagaaagaaagaaaagaaagaaagagaaaaagcaagcaagccacagactacagggcttccgcaacatttatttctcatagttctggaggctagaagtccgagatcagggtgccagcatcatcaggttctgacatggccttgctcctcggctcccagagggccgtcttcttgccgtgtcctcacagggtgaagtaagaaagacagcgagctctctggtgtctcttcttaaaaggacactaatcccatatgagggccccatcctcacgacatcatctaaacctaattacctcccaaaggttcccatcatactgagagttggggcttcaacatacgaatgtggaaggtttacaattctggccctggcaataacctaggtatcctgccaggttggcactccactagcaacttgctcagtgggtaaaataagtctcattatttgaagttaaagcgtaagacacctggaggtttctacttcacctggtcaagtcatttgatccttaactgttgctttcaacaatctctctgagaaaaagaggccacaggcaatggggcaaagatggactgtggtcctagggcacgatgttatgggcagagctttctggcccattcccttgggaatattggaaggaaaggggccatcggctcatggaatacccaaacagtccacgagaggcaggaccagcagacactgcaatgtggaccccacgaagatcacagcacataagcacaccgacctaaccccccaacacatatacacatgtcatgttttgtttgtttgtttgtttgtttgttttaaacagagtctcgctccttcccccaggctggaatgcagtggtgtgaactcagctcaactgcaacctccacctcccaggtttaagcgattctcctttctcagcctcccaagtagctgggattacaactaatttttgtattttttggtagagaagaggtttcaccgtattggccaggctagtctcgaactcctgacctcagacgatccgccaacctctgcctcgcaaagtgctaggattacaggcgtgagccaccgtgcccggcccacacacacaacgttttgttaagcctgaacccacaacttgtgcaaataagaaacaggaccaaaaagttatccccaggagcttccacagttcctgatataagggaactgacacgtatcaaatacctactgcatgcctgactgtgtgtctgatactctctgcgtgttattttatttaaccctcatggccaccctctcacaattaatttggaggctgctcaagtgtctctgcggtgcagggtgccagtcaggatgggctgggctctgctgcaacaacaaagcaccttcctgttctatatgcagaggctctgcccgctccagccacctagggacctgctcacagaggctccatctcaacacgtgagtctgtgatcacatcaccacctgagtgacctcagccatggtggctcacgcctgtaatcccaacactttggaaggccaaggcaagcggatcacgaagtcaggagatcaagaccagcttggccaacagggtgaacccacgtctctactaaaaataccaaaaaatattagccaggtgtggtggcgcaggtctgtagtcccagctactcgggagtctaaggcaagggaatcgcttgaacctgggaggtggaggttgcagtgagccgagatcacaccactgcactccagcctgggcaacagagcaagactccgactcaaaaaataaataaaaataaaataataataataaataaaattatcattagcacctacctcacaagacaatgcctatagagagcctggcaccgtgcctgagacaggacacacactccatgactgtgagtcattgtcacgacatgtcccgtacagaaaaaaaagctcagaaaatactcagacagccaatgttccaacacatggataagggtggcgtccatgagatgagattaaaagtgtattttccttacctgttggagtttttattctctacatttctttataaaatgagcatacataattttcatcatcaagaaaaagggcaacatataaataaatacatccaacatgagaacacaaaacaaagttttaaaagaactggccttaatggatcttctagatcagaggtttgtaaactatggattgtgggccaaatccagccagttttgtacagcccacgagctaaggatgtgttttacatttttaaagggtcttggagaagggaaaggaaggggaagggagaagaggatggggaggggagagacagcagcagatgctgtgtgtggctacaaagcctaaaatatttactatctgaccttttacagaaaaagtgtgttcaccctgctttagttcacccgaccacctgattcttcagacaataagtacccaaagccttgggtgctttacttagaattcagtttgtaaacacacacacacacacacacacacacatgcacacacgcacccctacaaaaattatcaggaacacaaagacccttgatataaaatgatgaatatacaattatctgtcatcacactgcagacagtacgtgattgagtctcctttccacccaaccgttcacacatttaggaagcgtttattgcggcgggagttgttaggggagagattaagggggcctcagcatctccatgtcccaggcactgttctaagcctcgaggattcaatgatgaataaagctccaggctgaacactcactctttcctgtagcaaatcagtttcagggcccctccgtgtcaggctctgtgccaggcgctggggatgcagaggcaaacaagaatgatgacgccactgcccaaggagcctacagcccatcagcgacatgggcagctaagcaaccacgcagcacggcgctcagtcaaggggccacagagagattcaaaaccaagacacagggccgggcgcagtggctcacacctgtaatcccagcactttcggaggccgaggtgagtggatcacgaggtcagaagttcaagaccagccctgtcaacatggtgaaatcccatctctactaaaatcacaaaaattagccaggcgtggtggcacatgcctataatcccagctactcaggaggctgaggagggagaataacttgaaaccggaaggcaaaggttgcagtgagccaagattatgccactgcactccagcctggtcagcaagagtgaaactctgtctcaaaaaaataaagcaagacacagcagacacagcctcagggcaacgccatcatcatcatggactaatgacaatggccaaaacctgaaaaggaaggacttggcctggtgaaagcaaaaggaggaaggtggttcctggcagagggagaacacgagaaaaggctcaaaaagacaaacagtgtgacgtgtgctgagaaccagctgcaggagctggtgggtggtttgggtggtggaggactggcctgagcccaagctaaggagggagggaaggagggaggggccaggaggagaacggtgaacgaagtccaagctaaagggaaaaagaggaaaaaggcctggacttgatgggaagatagcaaaggattttggacacggaatgacatcgtcagaaacatttgtggttgggccaggcacagtggctcacgcctataatcccaacactttgggaggccgaggcatgtggatcacctgaggtcaggagttcgagaccagcctgaccaacatggtgaaaccccatctcaaccataaatacaaaaattagcggggtgtggtggcgtgagcctgtagtcccagctactcaggaggctgagacaggagaatcacttgaacctaggaggtagaaggtgcagcaagccaagatcacaccactgcactccagcctgggtgacagagcgagactcagtctcaaaaaaaagaaaaagaaaaagaaaaagaaacatttgttgttggggtttgttgttttttttttgtttttttttttttgagatggggtcttactaaatggtccaggctagcctcaaactccttgctttaagcaatcctccagcctcacagcatccctagtagctgggactacaggcacctgtcactgcacccagcagaaacatatttttaataagattattctggctatttcctctgtagccttgcagagtgaaggcacttacaatgaaagctagcctgaagctctacccaaacaaccacactgccctgaccaggccgctccctctgcccgtgccgactgcccaagtgtccttccagctcctcccattcagagctgagcttcacacatgtggctccagcaagctgtgggccagatgagccaccagcctggctgcccaccaggttcaacctaatcaggtgctcctgattatagggacaccaggatatagacccaaaagaactgaaaacggtgctcaaacaaatccttggtcactcatcttactagcagcactattcacagtagccaaaaggcagaaccagcccaaatgtccagcaatggatgaatggaacacagtatggcacgcccaaacacagtggaatattcttcatccaaaaaaagcaatgacgttctcggccaggcacagtggctcacgcctgtaatcccagcactttgggaggctgatgtggaaggatcacttgggcccaggagttcaagaccagcctgggcaacatagtgagatgctgtcactacaaaaaaaaataaataaataaaataggcaggcgtggcagcacatgcctgtagtcccagctactcaggaggctaaggccggtggatcagttgagcctggggcccttaaggctgcagtgagctgccattgcaatgctgcactccagcctgggtgacagagagacctgcctcaaaaaaaaaaaaaaaaaaaaggcaggggggcggggtggctcacgcctgtaatttcagcactttgggaggccaaggcgggcggatcacaaggtcaggagatcgaacccatcctggctaacacggtgaaaccctgtctctactaaaaatatgaaaacgaaaaattagccaggtgtggtggcgggcatctgtagtccccgctacgggggaggctgaggcaggagaatggcgtgagcttgcagtgagccgagattgcgccactgcactccatcctgggggacagagcgagactccatctcaaaaaaaaaaaaaaaaaaagaaaagcaatgaagtttgatacatgctacaatatggatcaaccttgaaaacacaatgctaaatgaaagaaatcagacccaaaaggtcacatattataggattccagtaatatgaaatgtccagaatgggtaaatccacaaaaacaaagtggattagtgtttgccaggcggtggagagtaagcgaagaatggggagatggagagtgatggcttaataggcatggggtttccttgggggggtgatgaaaatgtgtggaatttagatagcagtattggttgcagaaaattatgaaggtactaaatgtcactgaagtgttccatttaaaattgttaattttatgctatgtgaatttcatctcaatacaacaaattttttttattatactttaagttctagggtacatgtgcacaacgtgcaggtttgttacatatgtatacatgtgccatgttggtgtgctgtacccattaactcgtcatttacattaggtgtagctcctaatgctatccctccccactccccccaccccacgacaggccccagtgtgtgatgttccctaccctgtgtccaagtgttctcatcgaatacaacaaattttttaaggagcccaggagatgagtaggttctggagccctctccactccaaggtttcggtactcttctcccagatgttacagctttccagactcctgctgtgctgctacctgcctttctggactgactgtggttctctgactagagggagcatctaagtcccctggagatctagttcaaaatgcaggtgcctgggcctcaccccaagagcttctgaggcacagagtctggggtggggtcccggcacctgcattttgttaggtgattctggtgtggtctgaagtttgcaatcaatacaaccagaccctttctcccttttcatcttcggactgttacttaatcaactgcaggacaattcttctttccctcttttcttagtcttttgcaataggagaagacttgggcttcaaaaagaaacaggaagatacttgaattatggagaatgaaacataacccagtaactaaacaaaagcgagttataggtagccttcaatcaatggtcactgaccttggctgaacgtcagagtccttacgggaacttttttaaaagtacctaggccgtaccatggacaccatcagtcagaacctccagagggaggtctagatgttaatattttttctaaagcaacacaggcaacttccctgctctccacctcaccctttactcaaaggtcgctcgaaaaatgcttgtagtaaatggcagtatgagtctctagcttcttaggcaaacataattatgaaagtaaataaggcatgaaaaatcaaatgacacaggcaaatttcagattaagcttttctttttgtctcctgcgtgtttaattatctgtgcttcatgtttgtagggccaaaaaagcggtcaattgcaacgggcatggatctgctccccaaaaataactcacatgtgtaaagcactttcaacttcgatgccgtaaggaagcgttttcctaacaatgatctcctctgatcttcacaacctctccaattattctttcattgattcattcatcaaatacctcctgagaacctactctgtgccgggcactgtgctagtgtacaggacactgcagagacatgacccatctgtgcccttgcccccaccttcaggcccccggtacacaggcacacaggtgatgacagcccagggaagggaagggccaggacgaggaaagtacaaaatgaaaccaagatatggggcaagtctggagagccttgtggggaagaaatgcacaagatgcaccccaaagggtaaggaagagagtctggcaaaacaccgcagaggcggtgccccaggcagagctggcgcaaaggcaggggggacaggaaggaaaccggaaggatggcaagagataagcagggagggaccaggctgcagacggcagttagggccagatcagaaggactctgggaagcactctatgaaaacagaactgcaaatggaaggtagaggagcccttgaaggggtttcagccagaaacacaatcagactcacaacctgcgtgggatactctgggggcctgtggaaaatgatctggagcggggagacgaaggtaccctgaacagagaggtcaccagggcacatagacaaaagatcattcgtacaaaaaaagtagaaagaatgaataagtcctgctatacgacagcataacagggtgactatagtcaaaataatttaattgtacctctggttttctggttttcttggtttttttttttttggatggagtttcactcttgttgcccaggctggagtgcagcggcgcgatcttggctcactgcaaccttcgcctcctaggttcaagcaattctcctgcctcagcttctcaagtagctggaactacgggcacccaccaccatgcccggctagtttttgtattttgggtagagatggggtttcaccatgttggccaggctggtctcgaactcctgacctcaggtgatccacacgcctcggcctcccaaagtgttgggattacaggtgtgagccactgcccctggccctagttgtacatttttaaatgactgaaagatggccaggtgcggtggttcactcctataatcccagctctttgggaggccgaggcgtgtagatcacccgaggtcaggagtttgagaccagcctggccaacatggtgaaaacccatctctaccaaaaaatagaaaaactagccgggcgtggtggcaggcgcctgtagtcccagctactggggagtttgaggcagaagaattgcttgaacccgggaagcagacgttgcagtgagccaagatcatgccactgcactccatcctgtgacagagcaagactctgtctcaaaaataaaataaaataactaaaagaatataattggattatttgtaacatagaggataaacgcttgagggaataccccattttccatgatgtgatcgttatacgtgactatatcaaaacatttaatgtgccccatatacacctactacgcagccacaaaaatttaaaaaactttttaaacaaaggatcgactgaataagtatttaaatcagggatcagcaaactgtttctgcaaagggtcagatagtatttcccagtttttttttttcttttttaacttttatcttagaatcagggggtacgtgtgcgggtttgttacaaaggtatattgtgtgatgctaaggttaggagtaggactgaacctgtcacccaggtagtcagcacagtacccagtaggtagttttgctgcccttgccccctgttctctcccctctctagtagtccccagtgactactgttcccatccttatgaccatgtgtacccaatgtttattttattttatttatttatttatttagagccacatatttatttatttatttagagacacagtctcactctgtcacccaggctggagggcagtggcacaatcttggctcactgcaatctccacctcccaggttcaagcgattctcctgtctcagcctctggagtagctgagactacaagtgcgagccaccaggcctgactaatttttatatttttagtagagatgggattttaccatgttggccaggctggtctcgaactcctgacctcaggtgatccacctgcctcggcctcccaaaatgctgggattacaggcgtgaaccactgtgcctggcccttattttatttttttgagacagtcttgctgtcatccaggctggagtgcagtgcacaatctcggctcactgcaatttccacctcctgggttcaaggaacctgcctcagcctcccgagtagctgggactacaggcgtgcaccatcacacctagctaatttttgtatctttaatagagatgaggtttcaccatattggtcaggctggtctcgaactcctgacctccggcgatccacccacctcagcctcccaaagtgtgaggattacaggcgtgagcctccgcacttggccctggtgtttagcttccacttataagtaagaacatgtgatacttggttttctatttctgtgttcaatcacaaccatcacagctactcatttctgctgctgtgttgcaaaagcagctgcaggggattccacagttcataaatgaacaggtgcagctgacttggccctcaggctgtactttgccagccctccctctaaagcaagcttgttcaacccacggcccacgggcagcaggtggcccaggacggctttgaatgtaacacaataaaaattcataaactttcttaaaacattatgaggttttgtgattttttttttttagctcatcagctatcgttagtatttgttcctgtattttatgtgtggcccagggaagccaaaagattggacacacttgctgtaaaggatcacatccacatggtttcaggaccaatgaggggataatgaaaggagacagcagggcatcagaggagatgaggaggaaagtaggcattgtcaccaatgactcctaaatcaggaatctgagacgcagaggcccagcgatttgatggagggcagtcacacccaagcctcagtgcaaattctcttagcagtgccccctgctgtgccttggcaatcgtaaataaatcagatgtgaacgcaccacacaccctcacatatctgagttgcttactttggccaccccagccttcaactagttcccttaacccatcctctgcagagcccactccctctcatataaacacagaatgcacctaaatcaacttcatgtctcctggggcctcagcctcctgcagagccagagtctcacactaccccgtcctgaagtcctttcagtttataatgagatgatcagttaacctcgacccagcatgtctggggaggaatatgttgctgggaacattcagttctcactccctatcccggtgcaattaacccatcagatctgtcctgttagaaatcaatcagctgagtaactatcaaaaactagatacgggcacagtgcctcatgcctgtaatccagcactttgagaggcccaggtggaagaactgcttgagtccaggagctcaagaccaacctgggcaacgtagcaagaccctgtctctacaaaaactgaaaaagaattagtcggtcatgttaacatgagctgtatcccagctattcaggagactgaggcaagaggatcgcgtgagcctggaagttcaaggctgcaatgaactgtgatcgtgccactgcactccaacttgggtgacagagcgaaaccctttcacaaaaaaccatgcggatgggcacatacaagcaaactggggcccacgttgcttcaccaagtcccagagggccagcttttgaggcccttgttctcttcgctcccagcgtcatctgaccctctggctgcacgtttctcttgcctctggactggacataagcccctggccggcctgcagcaatttcctatctcatgtattcgtgcgtgacatcttcctctcctgttcagagctctcccaatgctgtttctgtaactccagcctccatcccgcccctgagccactggttcatactcccaacttcctagagccatctcaactcaggtacctcactgtcaacctaaactcaacacatgcacagtctatcagtcagtgcttgttgaattcatgtttctccaattaactgtattcccttccacgcccatctatccctcccaaatactgagtttccatcctactctggtatggcctcacagccactgaagtctgaaacctcggtattgccctgtactgttttttcttcctccatataagcactcatctgatcttctgcacggttccttcttctaaatgtctctcaaacatgccttcctttccattttcatcatctcgggccctccctgcctttgggaatactgcattcatgtcatagttagtccctgggcctttggtttctcactcttccaaattattctattatctggtgccagattaatctacaaaaacaccactggataacgtcacgacctatgcaaaaatcccaaacttctctctgatcccaagctcaagggataacacctcacattagcatatacagtttataatttggagtatttcaatgtaccctgtatgccatccgattctccccaataactcgtccttaacaaactgccacgtggaacagcacttctacaacagggaggcgattatttttatttttattatttctttgagacagggtcttgctctgtcgcccaggctggagtgcagtggcgcgatcttggctcactgcaacccccacctccaggttcaagcaattctcgtgccttggcctcccaagtagctgggattacagatgcgcaccaccacgcccagctaatttttgtattttgactagagatgaggtttccccatattggccaggctggctggaactcctgacctcaggtgatctgcccgcttcggccttttaaagtgctgggattacaggtgtgagccaccgtgcccagccaagaaggagattagagcaaaatgaaaagaatgaggaatggcggtgctttctcatcttagactatgacatcattaactaaggtcaacgagtccaaagaggagaatatagccatcttggacagctgggctctgtccagctctaacaccaagatgctttcagaccctgggaaggttgtaacttcttcaggtctcagttttactatctgtatcatgggttaatagtcactattctgcctatatgcttttctgaagggaaaatacagtactagatatgacaatatgtccagttttagaatgaacactgttgtaaaaagccactatatcatgtttcttaaagggaggtccatggattacctacatcagaatctcctagacacctgataaaagtaaagattcctgggttccactccagttctcctaaatgagactctcagggtgaagaagtatcagaaagttgatttttttttttttttgacaaagtctcgctctgttgcccacactagagtgcagtggcatgatctcagctcactgcaacctccccctcccaagttcaagtgattctcctgcctcagcctcccgagtagctgggattacaggcatgtaccaccacactctgctaagttttgtatttttagtacagacagggtttcatcatgttagccagactggtctcgaactcctgacctcaggtgatccacctgcctcagcctcccaaagtgctggtattacaggcgtgagccaccacacctcactccaatgcacacaaaacctcccaaagagcacctaattgcattgttacaaagaagtgatttgctaaatgtaagcagtccccctgaagtggagaagagttaaggcagctgtggcaatatttcagaaccaatgaaccaaagctaaatctagtcaccttcccatgagggtcagccttcagttggttccctgaatcagccagtgtcctggctctctgtgtgtagggttttcatccaattatgcttattcctgccatctgaagcaacactccatttattatgatcaagagactctagctctccacttaagcgcctgttaattaaaagaaatgcctgtggccagaatgcagcaaaaattctagaagcaggtatcagtcaacttctgcaaggagaggtatagaaacttttgccagaaacacacatagcttcttcttaaaatgaccttacaagttaaatcaccttcatttagaaggcaaagtggattggagggcagagagaaacgagggggaaaaatgaggccaaaaacacctgcaaagaatctggagcaaatgtttccaattaattccactgtgacttcctattttagaataagtaaaatactatgaagttaagtaaaatatataaagcaactattttcagggactagacaataatagactatgcagggctgtgatcctagccagacggaaaacatgcaaagggtgcaccacgttcacctgaacactgggggcaggtagggactttccaaactgcagcataaagaaatgcagcagtatacagaaaaagattgaaattcaggatgctggccaggagtggtggctcacatctggaatctcagcactttgggaggctgacgcaggtggatcacctgaggttaggagttcgagaccagcctgagcatcatggtgaaacccccatctctactaaaaatacaaatttagctgggcgtggtggcacgtgcctgtaatcccagctacttgggaggctgaggaaggagaatcacttgaacctgggaggcggaggttgcggtgagctaagatcacgccactgcactccagcctgggcaatatagacttcgtctcaaaaataaaataaataaaaacaaaataataaaaaataaaattcaggactgctgacacagctgtaatttgcagagtaggataccacagaggaggatcatcacacaaacaagaaatctcagaaatatgcaaagggatatccatgagttgctgactaaatactaagctatgcatgtgcaaagtaaaatgctatgaggcctggaaaagagaattctttctaagggactgtgagatgaacggagattccagaggtcatatggtactagaagataaaattccaactagtcttagcaaggaaatctcactgtacaccccagtcattcagttgagaccctaaagatcctctttaagggcagagctattctaggcctcgagtaaaagctactctatacccatcctagcaaagctgaaaaccaagactttacaggatcaagttgaaccaccagtaaattatctgcctgtcagaataaaatccatcactctttaagatgactaaatctagtctcttaacaatagaccactgacaatgtccaatatacaataaaaaattactagacattcagccaggtgcagtggctcatggttgtaatccaggcactttgcgaggccaaggtgggaagattacctgaggtcaggagttcaagaccagcctggccaacatggaaaaaccctatctctactaaactacaaaaattatccacacgtgatggcaggctcctgtaatctcagctactcagaaagctgaggcaggagaatcacttgaacctaggcagcagaggttgaagtgagccaagatcacaccattgcactccagcctgggaaacacggcaagactccataacaaaaaaaaacaataaagtaaaaataaaataaatcaatctatagacccaagaagcacaattaaccacaaaaatagggctattgcagtcctcagataaagggtatccatcccaacaaagcctaaaaccaagacttgggagtatcaagcatattaactgcctgccatgacaacactcaaacttctttaagaaaagacaacaaaatagagatcctcaacaacacaggaattaccctgtccagcatacaataaaaaattactagacatgagaagaaacaagaaaatgttactaatcactgggagaaaaaaaaaaatcaagaaagataaacataaagaaaaccacacaaaggcataacagagtcaaaatgctaaaaactaatgataaagtcttaggagcagccatagaaaaagtcacattacatataggagaacaatgctgacttctcatcagaaacaacataagccagaggaccttagaatctcatcttcaacgtcctaaaagcaaaaaaactgttaacctagaattctatatccagtgaaaacattcttcaaataatgaaggcaaaataaaaatgtattcagataaataaaagctaagagaatttgtcactagcaggcctaagctataatgaatattaaaagtagttctccagatggaagaaaaataatattagataaaaatatgggtctactgaggactgtcactgaaaagcagtgaaaatgaaagtacatggaaaagtcaaggctgagaaaatatgaagactttttctcactttaaagtttcttttaaagacaaccgattgttaaagcaaatatagcaatgtactaaagatttatgacatgtgaagaaataaaatgtatgacaaaaatagtatgaaccaaagagggataaatagatgtatagtgctattaaggctcttatatcatacatgaagtgttaattcgaggtagactatgataagacaattacaaggtagactatgatggaccattacaatgttaattcaaggtagaccatgataagttaaggaaactgtaatccctacagcaacctgcaaacataacacaaagagatacatttttaaatccagtaaagaaactaaaatggaatactaaaaactattttattaacccaaaagaaggcaggaaagcaggtaccaaagagcaaaataaaatagatgggataaatagaaaataaatagtaagatggtagtcacggacccaatcacatcagtaattatattaaatataaattgactgaacattccaattaagagacggagatccttggactagatgaaaaagtaaaacacaatgttatgttgtttattaaatataaagactcaggtaaaggtacagaaatggaagaagatataccaaggaaacactaacaaaatgaaactggggtagaagtaactatattaatatcaggacaaagtagacttcaggacaaaaagtattataacttaatttcattgagaataaaactgaagaatcacactccttctccttctatctagaaaagtgtccatttcgagttatgtttggaaaattttcaccatattcagagccctttatgtactgaagatgacgggacagaatgtcctcgcattctttatatcaggtgttacaaacagaatatttgtgtcccctcgaaaaaaattcatttgttggagcactagccccagtgggatgggaagcttttggaggtaattagggttacatgaagtcatgaggatgggaccctcataataggattagtgtccttgtaagaagagacatcagagagctcgccctctctcattctctctaccatgtgagaacacaagaaggtggccatctgcaagacagaaagagagccctcaccaggaactgaatctgccagcaccttgatatttttctgttctttaagccagacttcagtatttttttatggcagcccaagccaatttagatagcaggaacccacttagctgatgtctgccttgacttttacatggagcagtatttctaaaggaaaccaagtgaaatctgaaaagaacttctgcttcagcttatactgttcatgacctccccaggggaccatgtgagagagaacaatgcttttgggtttttggggggtctttttgtttctttctttttttttttttttttttttgagacggagtctcactctatcacccaggctggagtcagtggtgcaatcttggcttactgcaacctccgcctcctgggttcaagcaattctcctgccccagcctcccgagtagctggggctacaggcgcgtgccaccacacccggctaatttttgtacttttagtagagacagggttttaccatattggccagtctggtctcgaactcctgaccttgtgatctacctgccttggcttcccaaagtgctgagattacaggcatgagccaccacgcccagcccggagagaacaatgctttggctttccagtgcttttcacagaactccctccctcccatgaattggccaaactacatctctacccccaaacttcacttctcatttcttccctgacaccagccagaactgtttatctaactctccaactttggttcctgagcctggggacctgcatcaacactaccagcaccacgatcaatcccagaggagatggaccacgcaggcatgaccaggacctgctctatggagcacccagctaggggtacggttataagcaagacagacacggtcccagtcacctttgccaagaagaagggatccagtgaagattagatgcatactcagttcccttactctttctttctttctttttttttttaagacatagtcttgctctgtcacccaggctggagtgtagtggtgcaatctcggctcactacaacctctgcctcctgggttcaagcaattcttgtgcctcagccctactcaagtagctgggattacaagcaggcaccaccatgcccggctaacttttgtatttttagtacagacggggtttcaccatgttggccaggctggtcatgaattcctgcccagctctgcctcccaaagtgctgggattaccaacgtgagccaccgctcccagcctctttccccttccatactcataatcatctttgccaccctcggctatcgactggttcaatatgcttccacggtggcttctgggcatttttcataaacatgtggctgagctcaagagacagcaagagaggacaggtatccagttacaactttatggcctaacaaatgaaaaggtgttctacccacggagaaggaaatctaagtcctagaaggttccaaccaagcctatctgcactcaagactccccaccactcttagaccaagaacaagaaccattccgtgcttaaggagttcccctcagcaagccagcccacgcagtgcgtgtgtgtgtgcgcgcgtgttcgtgccagacccacggggtcctccgggaatatatatcgacaacagaggtgggtttctgaaccctggtcaaaagccagagagcagacacgcttgaaatgctctgtgccactgactgcaaagccacagatatttttcctgcagcctcaatgagcaaggactgtgtacacagctaacacacatgggcatacaaatgcatagaacagtattcaccagctgccctagaaaaccaagagagcatatggcaagaaagagagagttcatggcatgcattcccatcacctaaatgcgcacttgcaggcatccacagaatggtcaaaactgctgtcttctctaagaatcagccagcaggccgagtgcagtggctcatgccagtaatcccagcactttgaggggccaaggcgggcaaatcacctgaggtcaggagttcgagaccagcctggccaacatggcgaaacctggtctctactaaaaatacaaaaactagctgggcatggtggtgcacacctataataccagctacccaggaggctgaggcaggagaatcgcttgaacctgggaggcgaaggatgcagtgagccaagatcccgccattgcactccagcctgggagacaagagcaaaactccatcttaaaaaaaaaaaaaaaaaaaaaaaaagaatcggccagcccaccatactaggaaattgccttcatccccttttcagcctgtctgcatgccagcaggacccaaaacaacatctgaacatcttcctaaaagtcacgggaggctgtggaatgcctccaaaggtggaagaaacaatgctaaccatggcttccagttgcccctgggaatacatttggtacccaggacagcctgaatgccagctctctccaaacttcacactatgaagggcctgtggcttcagtgtgtcaagagcaaccccaccctgtgaattaaaatatcctgtttcacaaagaaaaaaaaaaactcagttttcctttgccagtgaacccttctgaacaataagctttctcaaccctccccaagcccagaattatcaggcaccgcttccattactgcaagctcacaggtttcctcccttagaaactgaagtattaattagtactgtgtatttgtattccttagcctgccatgcccctcagggcatagccagccagcccactgttccagtgtcagggaagcgaccactggttcagaacgcccagtgcccaactaacagctgagctcctgccactctaccatctttcaatcacagtgcctaaaaaaaaaaaaagatgttaccctgggctgaattgtgccccccaaaatccatgtatcaaagctctaaccccctatactttataatgtgactgtatttagagatagggccagtagaaaatcaacgttttaaactgaagatgggccaggtgccatggttaatgcctgtaatcccaacactgtgggattccaaggtaggaggactgcttgagcccaagagttgaaaaggtgtccaatcaaaatggtgctggttttttttgttgttgtttgtttgttttgtgtttttgaggcagtgtctcactcttgcccaggctggagtgcagtggtgtgatctcggctcactgcaacctctgtctcctgggttcaagtgattctcctgcctcagcctcccaagtagctgggactacaggtgtgtgccaccacgcctggctaattttttgtatttttagtagatatggggtttcactgtgttagccaggctggtctcgatctcctgactgcgtgatccgcccaccttggcctcccaaagtgttgggattacaggtgtgagccaccacacccggtcccaaaatggtgctgtttgggtgggccttggtccaatgtggctggtgtcttcatggaaagaggaaagctgggcacgtaaagaaacaccagggatgtgagcacagaggcaagactgtgtgaggacacacaggaaaggcagccatctgcaagccaagtggagaggcctcaaaagaaaccaaccctgccggcaccttagccttggacttccagcctccagagctgtgagaaaataaatttctattgtttaagccaaccctgtatgtagtattttgctatggcagccccagcgaaataatacagatgtgtagacagtgaagtaaaaggtccgactgcagaactgccaccttctttggcctggggctgcccaatccacccaacatgccaccctcttcagatggcacaactgtgtccccacactggaaggatctgctattgccccagaggctttctacagccaggcagaaatttcaacaatagctcaaccccaggatgcagcatatagcttgaagtagaattgcccatctggagcctcaacagagtataagaaagcacaatcctaaaaatggggcaaagggctactgttcaatgtccccacgaaacgagtcgggcttacttgacgatatcaggcttattgtagagactctcaggtggctgctgctgaagtttgtcctttttgttttctgtgagatactcttttcatttctcctttttaattccctaagatattctttcgtgaactagaatcagaatgctaaagatgaaggaaatctacgaaggagaaataaatacatgcaaacacacctctgggaggaaaactgcctcttggaacatctgtcacttctaagacagttgtcatatttgttctctcaatagcagctccagccagccaaatattgataccagtaaaagttgtgtacatttttttttttagacaaagtcttgctatgccacccaggctggagtgcagcagcgtgatcccggctcactgaagcctccgcctcttaggttcaagggattctgctgccttagcctcctgagtacctgggattacagacacgcaacaccatgcccagctaatttttttttttttttttttttttgtatttttggtagagacagggtttcaccatgttggccaggctggtcttgaactcctgacctcaactgatccacccacctcggcctcccaaaatgctgagattataggcatgagctaccgcgcctggccaaaactgggtacatattcaaagtacacacgcacactgttcatttaagcttcactagaggcatcttctttgccatcacaatgagaactaaaataaactgaacatggttgaggactcagataaattaaggcaggagctgagaagagggtgatccctgcttgccagcctcccccaccctcctggagcccgtctgggcaggactgttggccaagtccacgtggaggagacagcctcagggtcacaggcacctgttacctacttgggcagcctcctcaagatactgaataccaagagagggagaggagggggaggggagcacacatctcccaggaaaaagtctgccaagatgcaaaccaagctgcgaaaagcaagcagcaacaacacagacagtatgttgccatttgtttttcagaaaacatgaaacaaaattccatctccagatgtacatgcaaacatatgtaaaagcacagagcagtctaactactcaaccacggagagatggctgagcaaatgaactggatgacagaatgttacgtaggtattaaaatatcatcaataaaaatcatttcaaatttaaaaataacacaaagagaatgcacagactgattccaactgtgtaaaaatgtatgcttgcacatatgcaagaaaagaagatcgaaatagagtcagaagaaaagaagatcgaaatggagtcagggttcctactgctataaagtcgatttaaagtatactcaaacaatacaagcaaattggaaaagtgtttatatttcaataattaaaaaacacagtatcattggttttctttaaaaaaggaaaaggggctgggcgtggtggctcacgcctgtaattccagcactttgggaggctgaggcaggcatccgcctgcctgaggtcaggagtttgagaccagcctggccaacatgctgaaactccgtctccactaaaaacacaaaaattagccaggtgcggtggcaggtgcctgtaatcccagctactcaagaggctgaggcgggagaacaacttgaacccgggaggcggaggtcgcaatgagccaagattgagcaactgcactccagcctgggccacagaggaagatccacctcggaagagagagaagagaagagaagagaaaagagagagcagaggagagaagagaggagaggagaaagagaagagagaagagaagggaagagaagagaagagaagagaagagaagagaaaagggaaaagccggctgtggtggctcacacttgtaacaccagcactgtgggaagctgaggtgagtagattacctgaggtcaggagttcgagaccagccatggtgaaaccccatctctactaaaagtacaaaattagccaggcatggtggcgcatgcctgtaatcccagatagttgggagactgaggcaggagaatcgcctgaacccgggagggaggcagaggttgcagtgagccaggatcgcaccattgtactccagcctgggcaacaagagcgaaactacatcaaaaaaaaaaaaaaaaagaaagaaagaaagaaaagagaagacaaaagaaaagaagagaaacactagaatgatacccgctaaactggtaacaatgtttgactggttggtctgggggaaaagataaaagtaggagaagggttttcacataaaatttttataaactgttttataacgagatttttgtactgtattgatgcgacgctaacatgactaaaaataaagaattgaccttggggacacacacacactaccctcctccccaccctacccatcaacccaccaggagaaaaatcactgttttaaactgaaggcgggccaggtgtggtagctcacacctataatcccaacactgaagagggggaggccaaagtaggaggattgcttgagctcaggagttcaagactagcccgggcaacatagggagactcctgtctctaccaaaaaaaaattaaaaattagccgggcatggtagcacacgcctgtggttccagctattcaggaggctgaggtgggaggatcactggatcccaggaggtcaaggctacagtaagccgcgatcatgccactgcactccagcctgggcaacagagcaagaccctgtctcaaataataacaataataaactgaagatgacagtttcccacatactgctataccttaacttcacatagaagcacaactgcaaaatcagaaacatgtcaatgtctccaaacagctgttcagtgtcctgtctgtttctgcctagaaccatcctaaggggagcatgggctccagctggcctcgaaagcatttcccatcatccgacccctcaccagcctcctcccaggcccagtaggctgcaccttccttgtccaccccctttttttctcccctttcattaagacgccatttggcaaagtctctgcaaatccctgtcagttcacttcccattaacagttaccgcagagcttctctactttattcccagataaataattgaaaacaaacacccagtttggagaggaacttgaggcatctgaagttaacaaagccacaacggcttcatcctgacaggctcttctgagtaatgccctttccatgagcaatattttgctttgcctccaacagagggacagataaatctgaaaggctgaaggaacagaaatggagttaaagaacacagtcatgtgttaaccattctcttcccaccaacccaagagtgtgatgcccttcacgtcccgaacacatataaccagggtgggtggctctgacgctcccaggcattggggcctgtgcctgaatggtcacgggcaagggtcaaatcagggcactgctgcagaatccttcaagccatatcgctgccttttccagacttccgcatctccttatttctccaggtgaaataacacagacactgacccacttcctttcaccccaacaaactccaagcagacgtgtccccaggggatagaaaggagaccctgaggttttctgcagacaggccccctacatcctggggcccgtcccaaagggtgagagccccttggtcggaaccgcagccaaaggcttttcctctgccttcattctgctcctggggccatccgctgaattgtgggactccatcatcaggggaatgaatcaggaactgaaatgatctggggctgaatttacccacaaaacttcccacagcctcaaaagccactggttcatagatcccaagaagggcaaacatcctgaacacaaattctagccctgctcctaccctgttagactataaacgcgtgggtgctcagtcgatgttggccaaccgcaacgactcaagatcaaaacccattaactccgaccccacagagcatcttcgatagatccaagctgctgcccttttcaggtctggtgagcaaattaatagtgaaaccaaaggaaacctttggccagcctcagagtgaaggtcaacagactgtttccaagcacaactctttcaacaacatttgtattcactgactgtagcaatcataagtaattctcatccatgtatgagaccttctaagacaaattccccctctcacatcgacagcaagaattcatttctttttaaatctcctagaacagatgtttactgtcaggctgacctttctgccaagtagtgaggttctgggcatttgtggtgatgatgtctgtttctgagctgctgcaatccctccccagacattcaccagctgctcccaaaccattactgattctatccagggcttccctctgggatctcctccatattcaaagcatatattagaacaaatatgaaccaaaaggtttaaaaaaaaaaaaaaaaacactgctgcagccgggcacggtggctcatgtctataatcccagcactttgggaggctaaggtgggaggatcacttgaggtcaggagttcaagaccagcctggccaacatggtgaaaccccatctcaactaaaaatacaaaaattagccaggcatggcagcaggtgcctgtaatcccagctactcaggaggctgaggcaggagaatcacttgaacccaggaggtggaggttgcggtgagccaagatcacgccattgcactccagcctgggtgacagagtgagacgccgtcacacacacacaaaaaaaaattactgctgcatagtgcaaattagccaatgactgtttacaccgcccagagaaaatccctacattcagacagctgaccaaatacatctgataccgccccaccacccctactccccagtaacatagtaagacccacaaggattgcagagtcctttccaagagactatcttggaagcccagttgggtgcaggagagaagagtagaatgggatccagcaggagccatgcagagccactgagccagatctctgcctgctgctcagggattgaagccactggtcacctgtcagggcaagcagaatacactccaacaacaagttcacacaaaaccagggtggccttgagatcagaatatggcagcctgcattgagggccactggacgccactaccacacatagtcggcagcaaggaagccacatgtccaggggacggagacagacacggccactcaatctttttttttttttgagacagggtcttgctctgttacctaggcaggagtgcagtggcaccatctcggctcactgcaacctccacctcccaggttcaagcgattctcatgcctcagcctcctgagtagctgggattacaggtgcgcaccaccacacccagctaatttttgtatttttagtaaagatggggtttctccacgttacccaggctggtctctaactcctggcctcaagtgatctgcccgcctcagactcccaaagtgttggaattacaggcatgaaccactgtgcccagccatgtcactcaatcttttaacaacaaaaaatgacacatggtctttaagacagtggtccccaacctttttggcaccaaggactggttttgtggaagacagtttttccatggacaggggccggggtagggggttggggatgaaactgttccacctcagatcatcaggcattagttagattctcttaaggagcacgcagcctggatccctcacatgcgcagctcgcagcagggtttgtgctccattgagaatctaatgccacggctgatctgacaggaggcggagctcagaagataaagctcacttggcagctggctgcccacctcctgctatgtggcccagctcctaacaagccattgaccagtagcggtccttggtctggggggttggggacctctgctttaagacagtatcacagccgtccaacatcacattcagctgtctgatccaaaggacagttcttctgtaacacaaggaatctgttttacattagcccaggacctagaggcatagttcctgggaatcgttatagttacagaatcacccatcattccttctctttctccacttgggaagttaaggaaaaaagaaagcaggaaggcagggaagagaacttcaacctacctacctcccggggtacatgaccactgactccagtgagtctgacttaatcctgtctcaccgtgatccagcaggagaaatggactttgacccatttctctccagagagttctccctgcaccacttccctttctaggggagcagggaactctggcaccagttcaggggtgcttctgccatctctagaacttgtcgggcccagtgtctggtaaggctgtctcatgctgttatgatcttggacccctttcctctactgacagtggtgcatgcagatgacagggctttagccaatggcttgcggttcccatcgcatgacctggccccagctctcttggctcggtgatcacagccacatgccaggctgcggtttgcacggtgcttccctgtaagcacatacatgctcattcccaaatccagctctcctgccatatgtcagtaaaaaagcctgaaatctctggcttatccccaattccagtgcatttttacatttttaaaattttactgtacagtccttcgggggagttatcctcaaattaaaggatggaaaactagagctcagggatatacaatcagtaaatggcaggtgtgagctccagcccagacccctgctgcacagagccctgcctcaccctcctgtcagccctcataatgtgatccatggtcaaaggcctaatgctacagattgtgggggtggggcgggagtatcatctccctgatgatgtcatactctcaataaaacccagcaccacagtgatcgttctaggtcctctcatatatatacagtgccacccagcacatcagctgtactctatatttttaatgaaatgtgacattcaaaatccgaacttactaaaatgtaaataagggggtaattaccaagacattactttaagaaagaaatcaccgatcagttcctctaatgccttgttctctgtttaaataccactggctacttaacagagacattaacaggtatgtcaggtttgatcagaaataaattcattgcacagagctggttgtatcccgatacgacagctaaaagtagagtggtactcaccaagtgaggcatcaggaggtcagccaagtagacaaaagccgctccaagggtgaagccaacagccacagggaagaaggcaaaggcaccgaagcccccagaggacgtggccatctcaactgctggggccagaagagaccaataggaagctgccaacatgacctacaaaaaccacaacgagagataaacgttaaagcaactgcagaaggctttccaggcaggacctcagttgctctctgtggcccagattgacccctacaatttcacatgagttcagtctttcgtcccaggttgggaggtactatcagaaaccaaaaagccatccccagaattcccggagcttactattgcaagaactcaattttgggtaggatagagttgaccttgggaggatgcagtccagttcgccatcatctagcctataattcagtggttctcaaccagcaatggttttgccctccacaggacatttggcaatgactagagacatttttagctgtcacactgggaggagcgtagggggaggttgctactggcatctaatgagtgaggccaagcatgctggtaaacaacctacaatgcacagcacacccctgacaacaaagaattatctggccccaaatgtcaatgagaatgctgttgcgaattcctattctttttttttttttttctgagatggagactttctctgtcacccaggctggagtgcagtggcacaatcttggctcactgcaacctccacctcccgggttcaagtgattttcctgcctcagcctcctgagtagctgggattatgggtgtgtgccaccacagccagctaatttttctgtattttttagagatgggattttgccatattggccaggctggtctcaaactcttgaactcaggtgacccacccacctcggcctcccaaagtgctgggattaaaggtgtgagccaccatgcccagcccaaaaaatcctattttaattaaattcttccaagacaaattgctcactacttcacgagttccactgtattgtaacacaggtctaattattacaaagttctttcttatgttgagctgaaatctgtctcctttccacttttaccttttagctgtggttttgctccctagaacaccaaaaactgtgtccctcctgtgtgatatgtgacagcctctgaaatatctgaagataaccagcaagtcaacgtcatattggtctcatcaattatctctaaaaaggacgaagggaactaatatttattgatcacttggtatttccaagggccaagatttacatttgatatcttatcttttcatcacaaccaccccagaggcagatgatgttttctattgcgatttgtagataaagaaattggatcttgaaataataaggtaatttgctcatggtcctacaggccagcggtccccaatcctttgggcaccaggggccagtttcatggaagaccatctttccacggaccaggcagtggttttgggatgaaacagttccacctcagatcatcgggcattagagtctcataaggagctcacaacctagatccgtggcatgtacagttcacaatagggttcacgttcctatgagaatctaatgtcgccactggtctgacaggaggcggagctcccgcggtaatcctcactcacttgtccgctgctcacctgctgtgcggcctggttcctaacaggccatggatcagcactggtccatggcccggggattggggacctctgccataggcagtaagtagcagatccagggaaatgaccaagcaggaccataaccaactcaatgacggtagaaacatgaaggagaagaaaaaaaattaggctagtctcaaatctcagcaaagtcaattcaataaaaggttctccagcagatgagctggcacagtggtgcatgactatagttgctggagatgagctggcgcagtggtgcatgactgtagtcctagctactggggagccttgagcccaggagttcaaggccagcctgggcaacatagcgagactctgcctcttaaaaataagaagctctccagcactgaccaaactaaacactcatccatggctgtttactcttacagatgctatgacatcttttggctagagtacacccaccacccatcgtaactatacggcagtcatcgccgacacagaaaatgttgaatgggtttctaaaaattacttaattatgccttgccttaaaaaatcatctgcatcacccatcttcaaaataacactcagagtgacagaagcaggtattacaacagcaacaataaagaacaaatccaagcataaatccataaattcccttcttccagctgtcaaacatgcacagtcacttgctctgggccaaattctcccagcaaaagtcttagtgccacccatggaaacctgcaaaagcctccaaaactctaagaatgaaaatgcctctgctcaacaggatgggagctgaggctgatccgttcaactccatgagccgggctgtcaataaagaccatcaaaggaaatgtgagggctccccctccctgctacagcctaatccaccccttttccagactttgtcttactagctttagaattcaacagccctcagtagctgccctgcatggtaaactccccatcgaagaggacctgcaacaagacacagagatggaaaggtgcccgttcttctttgcattttttgaaacagagtctctgtcacccaggctggagtgcagtggtgcaatctccgttcactgcaacctctgcctcccaggttcaagcaattctcctgccttagcctcccaagtagctgggattgcaggtacttgccaccacacctggctaattttgtatttttagtagagacagggttttgccgtgttggccaggctggtctcgaacttctgacctcaagtgatctgcctaccttggcctcccaaagtgctgggattaaaggcgtgagccactgctactggcccaattcttctttttaaacctgacctgtgcagcagcttctctggttctcccatacggtcccaccttcaacaactctaaaaccacatggcccaagtaagcccactcatctcaccctctaaatcctccccaccctgcactccgatgaaaaaacataacatcgctgtcagcatcacttgagagacgtccccaacctctgctctcatctccttttcaaccccaggtccaaactcttctgtccacatttccttccatccctctgcatcactgagtaccaaccttttttctgcccttacacatgagaagcacacaatccacaagctattcaaggagcaggagcagaagagaagtgtctctcaagggagggtgtgttggaatttgggatgcttgcaatgcaaacgcatcccagctgattcaggtaagcccccttcttgagaatcactgccctttatctttccagtcaaatttaggatccagctggatttccttcatttcttttccttgtgagcctccctgcctcacacacaaactggaaaaccaccaaagaacaatcgggaaattgaatagggttgcctgtctaaaatgaaaaaagcacccaaagcaaaattctttttgttttttgtttttgtttttgtttttgtttcgagacagagtctcgttctgtcacccaggctggagtacagcagcgtgacctgcaacctccatctccgcctcccaggtacaagagattcttgtgcctcagcttcccaaggagctgggattacaggcatgagccaccacgcccagctaatttttgtatttttagtacagacagggtttcaccatgttggctaggctggcctcgaactcctggcctcaagtgattgcccacctcagcctcccaaagtgctgggattacaggtgtgagccaccgcacccggccaaaaagttatttaaagggcgagtggggtagaaaagacgactgtatcctaatgcctaaaacctgtgaatatttcaccttacaagtaaaaaggactctgcacatgggattaaattaaggacctggagatggggagatgatactggcttatttgagtgggaccaatgtaaccacagggtccttacgaaggagtgagaagggtcagagtcgtgaggtcaggagtttgagaccagcctgaccaacatggtgaaatcctgtctctactaaaaatacaaaaattagccgggcatcgtggcaggcacctgtaatcccagctactcaggaggctgagaccagagaatcacttgaacccaggaggcggaggttgcagcgagccaagatcgcactactgcactccagcctgggtgacagagcgacactccatctcaaaaaaaaaaaaaaaaaaaaaaaagaagggtcagaatcagagagaaaatatgataacaaaagcagaggctatagtcagaaagagattgaaagatgccatgctgctggcttgaggatgaagaaaaggccatctgctagggaagggaggtggccccaagatgctgagaaggcagggaagcaacttctcctccaaatcctccaagaggaacccagccctgctgccaccttgactttgtcccagttaaaatcactgtggacttcagacctccagtactgtaagataataaatttgcactgttttaagccactacattcatggtagtttgttacaacagcaatagaaaattaatacaggcacatgttacttttcttaaactttattttttagagcacttttagattgatagcaaaattgagtggaaagtaccaagaattctgacataggcctacctgtccccacatacccaaaactttccccactatcaacatcacaccacagtggtacaattgatacagctgatgaacccacactgatatggcattaacaccgaagggccatcgtttttttgttttgttttttgttttttttctttgcttgttttgagacagggtctcactctgtcacccaggctggagtgcagtagcgtaatctcagctcactgcaaccgctgcctcccatgttcaagtaattctcttgcctcagcctcctgagcagctgggattacaggtgcccaccatgccgcccagctcatttttgtacttttagtagagatgggttttcaccatattggtcaggctggtctcgaactcccgaccttaggtgacccacctgcctcggcctcccaaagtgctaggattacaggcatgagccaccacgaccagctggtccatagtttccattagggtccactcttggtgctatacattccatggattttgacacatatataatatcatgtatccatcattactgtatcatatactttcactgccctaaaaagtccctgtgctccacctatttattcatccctccttccccgctattccctggaaatcccttttcactgtctctatagttttgccttttccagaatgtcctatagttgaaatcacacagcatggaacctttccagattggcttctttcacttggtttttaatgcatttaagattcctccatgtcttctcatgacttgataaagcatttccttttagcactggataatattctattgtctggatgtaccacagtttatctgttcacctattgaaggactttttggttgcttctgagttttgtcgattatgaataaagtggctataaacacccgtgtgcaggtattggtgtggactggaagttttccattcatttcggtaaataagggccaaggagtggaattgttggatcctatgataagcatcactttttaaataatcccccagcacaggtggggaggtgaaactctcaacatcagcaatgctcctttatatgttaggcatttttaaatctgggtgtagtgacatatgaactagctggtgcaggaatagaaagcagggtatctgattacctctcaactatccctaagaagcagggcctggaacgggcaggccacagaggagaaggtgctgagtaccaggcccaagacttcagggaatacttttgccagccagtcccttcatagccccggatggtagagaacaaaagtccttctgcagctgtgaccccgcctgtaaaggcaaacaagtgggctaacagggccatcgctgaagacaccaggtataaccgtaaggagctgatggttggcatcttccttttcctcacctttgtctataaaaggaatccataatcagcttcaacacacatggcaggggcctcgctgtacccccaaagtcttttttgcctctttattcctgaaatgaaaatgaaaagcccacccaatcgaatgaagccagggggaaggtttgggtggggcccatcctccaagttaaatgttgctaagaccaaagcagcccaatttcttttgctaaataatgaaagaagctcaaggatgagtatttcaatagcaaaagaaaactcgtggcagggcacaggggcttacgcccataatccaagcactttgggaggccgaggcaggcggatcacctgaggttaggagttcatgaccagcctggccaacatggcgaaaccccgtctctactaaaaaacacaaaaattagccagacatggtggcacacacctgtaatcccagctactcgggaggctgagacatgagaatcacttcaacccgggaggcggaggtggcagtgaactgagatcacaccatggtactccagcctgagtgacagaacaagaaactgtctcaaaaacaaacaaacaaaccaacaaaaacaactcttgcaaaagggctaaggaggaaatgaaaaaacaaaagagaatggattgaaagtctaacttcagtctttggctggtttggtaggtctaccacagggctcagaagtctcaatgctgaacaaagtgattcccaggcaaggtgatatttaagaagctgagtataggctgggcacagtggctcacgcctgtaatcctagcactttgagaagcctaggtgggcggatcacctgaggtcaggagttcaagaccagcctgaccaacatggtgaaacgctttctctactaaaaatacaaaaaaaaaaaaaatagccagacatggtggtgggtgcctgtaatcccagctatttgggaggctgagacaggagaatcacttgaacccaggaggcagagattgcagtgagctgggatggagccactgcactctagcctgggcgacagagcaatactctgttgaaaaagaaaaagagaaagagagagagagagaaagaaaggagggaggagggagggaggagggatggaggagggagggaggagggaggagggagggaggggaggggacgagttgaggttgagactactggcctacccaaccgttagggaccccatttgtactactgcccctggttgttgctgaactcttctgctccctcaccttggcctaagcagctcaatctgtgacaacaccaaaacgccaagacccatctcccatgccccttcttccgaacaccctcaactctttgcccaagtccatatttattatgggaaaatgcaggacttagaatcaagtccgagtttgaatcttggctcagctacttactggttaggtagccccagtcaaataacctaagctctcttctgcagctcagttttgtcacctgaaaatggtacatttcacaggattgtcctaagaatcctgagagtcaatgcaaataccaccccaacccgattcccagcaggaaatatgcaacgggtcagtgctgttttggattcatccctctccccgtatgccttctgcagacatcctctcttcctcctcccatcttgcgctataccccacttctaaggcggctcttttccataacactagattcatcactcgtgtccatgtcccccagaacgtcgcacatgcccaggagagtgctgtgccttaagcatctctgtacctggcacccccatcagagtagtcctggacagagcgactattcaacatttgttgcctaatcgcattctctgtcatccttgctaatgaaggggaggaacgagggtggagaaatgagaacgcatgatcaggaagtgattcaacacccattttttggtctaatgcctaatttttacagtaatttttagcttccaaattaagtattatacagactcatactcaaatgccttctgtcctttcacaaacatggggtgagtaattgtttaaaataattgagattttcatgggtgtggaaaagggccaacgcagaattttcgaagcttcacagataatctactgaagtctactgatagaatcacagactcacttagagtcaaaggggactttaggagaccatttaatctaaaaacctcacttaacagaagaaaaggctgacaccaaagagattcagtggctttcccaaagccccagagcaagctggtctgtcccaagttgactgtgctaccctctacccctacttgacaactcagaatcttgtaagaaattctgcgggctacagagtaaaggccaggtttaagttaccacctcccccattatcagggaaggaatcccaaagctgaagtccgagatgaatcagtgtcagcaataactgaatgcaatcgatcccatagcattccccgatattctgatagaaactactccaagaaaacccagcactagaaaatttgtggccactaatgaacagggctaataatcctgttaaatacttgcttcacaaagataaatcaaacctcacaaacttaaacccattaatatcccatgacttccttagaagtaggtagagaaacaagcaattttgtaagtcacactagaatcccctcccagcagcacagctaaagttggggatttcaaaacaaaacatacagatgttatacttttggtctaagtctctgaataaaaggtacgcctccctctgctgtaaattacactttaaaataggaacagtttaaaagcagtttgtatcctgattggtatctgagaacagaagaaggacattggtggggaaactggtgacatccaaataaagtctggagtttagggaatagtaacaaacaaatgttaattcttagctttgacaaatgtgtcatgattatttatgtaagatgttcacattgggggaaactggatgaagggcactattcagaaattccctgtattatttttgcaacatttcttaaaatctaaaatacttccaaataaagagcttattaaaagttaatgattataacatgcccaggcacggtggctcatgcctgaaatcccagcactttgggaggctgaggtgggcagatcacttgaggtcaagagtttgagaccagcctggtcaatatggtgaaaccctgtttctactaaaaatacaaaaattagccaggtgtggtgatgcactcctgtagtcccagctgctcggaaggctgaggtggaagaatcagtcaaacccaggaggcagaggttgcagtgagacaaaatcacaccactgtactccagcctgggcaacagagtcagactccatctcaaaaaaaaaacaaaaaacaaaaaacaaaaaaaaaaaacagtattaacagtatcacttactcagtatatccaatcagagaataattcccctctaaatctaattttcaaaggtttactacactaatgtgaaattcctagtccactttggaatatcacagaatgtacgttgtagggcttctaattaaacatggccaatggaacacaagcttccaaattctcactggagtaaaggtacagggatatgaaggatccaaaggccaaagtcagaaggaaaggaagaggacatggcagccacattttggaagcttgaagagagaagcaggtaatcgctgatggatgctcaagaaggctgccacctggggctgaaggaagagactagaaggaaggtgcttcatcccacaaagccccagaatagccagggagcctttgacaatgagtgtgcagatgggcctaaaagagacctgatggaagcctgggtaagaagcaagtaaactccagattcctcctgtaccccaggcagccaggcaactgtcccaccagacattgcaggacccccagcccagctaagggtggggataccaggctgaaaacaggagaaaaagtgatagtttatgtgctggaatgggggcacccagcatcttcccacatcttcaccctgatttcacaatgaaaatccaatgcgagtaaagaatcctatgtacaaaaactcaattttcagaaatgtttctgcatgataaccttaacacccacctggactgtgcatttgtggaaggcttgtaaatcacagccttaacagcagaaggctgaaagggactggagaaaacatttaaaatcaccagatatttacaagctcttcttcatagtccctgagaacaaaatccctgtttccctcctgtagttctcaaaacctagaaaggctcataatccgatctcttttctcaaaatatcatgcaaaatgccccagggatctgtactttataatgctattaatttccctctggtgtcagaggtaccagcatagaatgatttaaaaaaaaaatcaacttaacacctaccccacattaggcaaacctttccatttctgtgtaagtgttcattttgaaggaatttcagctctggcaatagaaatgaatttgtgaagagttaagggatacatcagaatattctggcacgatgggtacagttgagcatttcctttattatagtagtgacagtttcaataccaaaacaaaatccaagccacaaaacaaaatttttctcgtaacaaataggggaaagaaaattattgcacatagctcacttacaatgcactgaatgtgtcaactcttcacacctctaaaaaggtacacagaggtaggacaggaagacacagttcaaaagaacagcacccaactcagtgcctactatggagcagatcctccctcatgtttattgaaccaaaggaacatagactctaacctcaaggaggttactgtgtacttaaggaggacacacaaacttgcaatccatgtaggtcaaagcaataatcagaaagaggctgggcatggtagctcacgcctgtaatcccagtactttgggaagccaaggcaggcagatcgcctgaggtcaggagttcgagaccagcatggccaacgtggtgaaaccccatctctactaaaaatacaaaaatcagccgagcatgttggcgggcacctgtaatctcagctacttgggaggctgaggcagtaagaattgcttgaacctgggaggcggaggttgcagtgagccgagaacacgccattgcactgcagcctgggcaacaagagtgaaactccgtctcaaaatgaataataataataagaagaagaattacccagaaagtacagaagccaagagttgtctccaagttgttctccaaatcagatataaaattaacagttaaaagtcaatcagcaattcctaagcagagactgttacacggccaacactctgccagaccccagggggttgcaagagaggaagaaagagctagtgtggatctgggcgctgcctccaggagctggctctggactataataagagaggctacagaagacatatgataggataaattaagaaagtctgcagtcatgccaagaaaggggataccaatattgtttcaaaatttaaaaagcagaacatcaaagaacagggaggggctctggaaggctggacacaatttggaaaggaaatgaggttaggaactttctagctgggaagcgcagagtgggcagagtctggaggcaagtacacagaggcttatgttgtggagtccacaaggcgaaagaaggcagggaggagtttacaaccagacatttgggtataatgatgaaaccaggcagaatggtttggacttcacacaatgggtggcttgtttccaactctggttgtactataaaatcaacctggagttttcaagctacagatgtcagctcccctccacaacctacagaaacagatttgccagggcaggggtatggacactgtgttttaaagcctcacacgtgatgctgcagcagcttagccagcatggagcaggtcagcattaagtacccactgtcttcggcagggtaacggaggcattttggaagggtaacttggcatcagcaagcagaattgatttaagtggggagatgggacaccaacatccagctgttgggctctggacataatccagatgtgacacagggcaggagaccagagagcagacagagaaacttggaagaaggaaggaatctgcaggtaaccctccagaatgaggctgcccatgtctgttcaatatcaagtcagtcaatcagaaacccatgatgagcggccacatgaattttgcattgagtcagccttaaatttggcatgtcagttattaatcatgactcagtatgaatcaaatccatatgggagctatatctgtacttaatttgcttttatcaagaagccttcataatataccagctttaaataattttacagaattaaacccaacggctcaaaattataatcaattacattcagcttcaattacagttattaattaacgtagatgggcttgaatgacctgactcttcttagctacgcctacccagtgataatgatgggcaggagcttggcttacaatctccaaactaggaaaaagtacttttgcttaaataagaaaaaaaaaaaatctaccatatgacccagtcattcctctccttgttccccaagagaaatgaaaacatacgtccacacaaagacttgcacaagaatgttcacagcagctttattcacagtagccccaaactggaaataacccaaatgtccatcaacaggagaatgaataaacacattgtagtatatttatgaaatgaaatactccttagcaataaaagggaacaaactactatcatgccgacattggatgaatctcaaaatcattacacggagtgaaagaagacaaacaacaaaaactatatggatactacacgattccttttaagcacaagggtatgcaaaactactctgtggttagaagtcattagttggtggctgggagggagcctgacttagggactaggagctctttcagggatgttagaaatgttctctatctcagctggacatggtggctcatgcctgtaattccagcaatttgggaggccgaggcaggtggatcacttgaggccaggagttcaagaccagcctggccaatgtggtaaaacctcacctctacaaaaaatacaaaaattagctggggatggtggtgggtacctgtaatcccagctactcaggaggaggctgaggcaggagaatcacttgaacctgggaggtggaggttgcagtgagccaaaatcacgccactgcactccagcctgggtgatagagcaagactctgtctcagaaaaaaaaaaaaaaaaaagaaaagaaatgttctctcattttgggtggtggttatacagatacacaccactgaccaaactcactgggctgacactttaagatctgggcatattgtatatgtattagatctggtttttaagtctcaaaaaggctacctgctcccccaattctgatgagccacatttgctacacagacagcatgttgggtatccaggttctggggtctatcctaaaatggcctctctggggtagccttgggtacagtcactaagtacctgacaaggcccaggcccattctcaaactctaagtaccagcagtgttaaaccagcatggaagtcatacccaaagggacctcccagcatccattctcagtgactgtaggtcccccaggtgaagtcctagacagtaataagttccatacagcaaggcaaccatccaagacatacctgggtttcaaatttattgaccagtcacctaattctacctccagtgccatgaaaacagagttaaaaaaaaaaaaaaaaaaaaaaaaaagcctccatgcccagtcctgctccaaaactaagctcctatatttcttttttttccaagtgcaactcagctcagccaacatttactaagcaactaccatgagtgagatgcccagctggactggagctcccattggcaatgatctcagctacacctaatgtaagactgctgtgctccagtctaataacgcttaggcttttttgtttgagttcaatgttcctcttctacaaacccattactctgaataatagaaatggcaagtatactcattactttggtcctttcaaggcagatccagaccagccagatgagaaagactcccagaaaccttcagtttgccaaaattgttaactccatgcagacttaaaaaacaacagcaacaacaaaaaaacacagagtgatgtggggcatccttattaaaccttttcaccagctggtcatcaagagagtgagaacatgttgccccaagctgcctcccgtggcactcagccaccaacccatcagcactctctcagctcaggtctgttgatgggcatcgcaccagctgctcaagcctccccaaccccagcatcaccactcactcacactgatccaatctgttccagatctagctgctaagaaagcagcccctcctatgtttgaaggagaagagaagactcggcagtctggctccactgatacaaaacgcaaagatctataagagaggagtttctcccccttcactcatctccctcaagatggagatgacaaaccacccacctgctagcttcatgcctcttttcttggctcaaacgagccatgaggcttggaggcagatcttcaaggtcaagggaaaagaaagatgctcctccttgttctaaatagtattacatttcattccaccactcgtgaaaatacaggttctgaaagtgtattctgtcctaattcaccagagggatgcagcagtctcccatgcgtatggtggccatgattcctgggagatggaaggcaggaggtaaggagtgatggggcagaatcccaaaggagaactggatgtcctacgaaaaagccccctcctaggactgcccgatatagcaaataaaaatacaggatgaacagttacatgataatttcagataaagaataaatacttgttttagtataagcatgtccctaatactacatgtttttcctggctatactacccccaccagtaattatcgtcatcttctctctctgtctctgtctctctttctctctctaaggaaggtaatacaggcctagcacagtgactcacacccccagcacttcgggaggtcgaagtgggcagatcccttgagcccaggagttccagaccagcctgggcaacatggcaaaaccccatctccactaaaaggcaaaagttagccgggcgtggtggcgcatgtccatagtcccagctacttgggaggctgaagtgggggcatcgcttgagcccgggcggttgaggctgcagtgagctgtaatctcatcactgcactccagcctgagcaacagagtgtgacccagtctcaaaaagacaaaaacaaaaaataaaaaacgaaaggtaatgtagcctagtagaaagaagaaccaccttcttctttttttattttatttatttttttttttttttgagacggagtctcgctctgttgcccaggctggagtgcagtggcaccatctcggctcactgcaggctccacctcccaggttcacaccattctcccgcctcagcctcccgagtagctgggactacaggctcccgccaccacgcccggctaattttttgtgtttttagcacagatggggttgcaccgtgttagccaggatggtctcgatctcctgacctcgtgatccgcccgcctcggcctcccaaagtgctgggattacaggcgtgagccaccgcgcccggcaagaagaaccaccttctgtcagtcagactacctggattcaaatccaagctccaccattcaccagctgggggatgttgggtaagagattaacctctctggagctactatttattcctatgtaaaatggaaataataatagaaatagtaacactcgtaaataaaataacatttacatacagagaaactttcttaatcctcctaacactaagagttaggtattactgttattcctatttctcatatggggaaacagaggctggagaggttaaataattgaacaaggtcacagaattagtaagcagcagagccaagattcaggcccagccagtgtggcacttaaaaaaataaaaataaaaataaataggctgggcgaggtagcgcacatctgtaatcccagcactttggtaggctgaagcgggcagatcacttgaggtcaggagtttgagaccagcctggccaacatggtgaaaccccgtctctactaaaaatacaaaaattagctgggcgtggtggcatgtgcctgtaatcccagctactcaggaggctgaggcaggagaatcgcttgaacccaggaggcagaggttgcagtgaggcaagatcgtgccactgcactccaatctggcgacagagcaagactccatctcaaaaaaaaaaaaaaaaaaaaaaaaatatatatatatatatatatatatatatatatatatcatgtatagttaccctgtgccaacctttacatttagattcttttaatttcagcttttagtttggatatgagggtacaggtacagctttgttacatgggtatactgcacccaggtagtgaccacagcacccaatagtacttttccaaaccacatccccctccttctctcccctccttagagtcttcagtgcttctttttcccatctttatgtccatgtgtgctcaatgcttagctcccatttataagtgagaacaggcggtatttggttttctgtttctgtgttaattcgcttaggataatggcctccagctccatccatgttgctagaaagtacatgatcccattcttttttatgactgcatagtattccatggtgcacatgtaccacattttctccacccagtccaccacggatgggcacctaggttgactgcatgtctttgctgttgtgaataacgctgtgatgaacacatgagtgcctgtgtctttttaatataatcatctattttcatttgggtgtatacccagtaatgggattgctgggtcaaacggtagctctgttttaagctctttgagaaattgccaaactgctttccacagtggctgaactaattctagccctgcttgtgactataacaccatcctacctcctgaggtggagcttatctcctagggtggtggtaaggattaaatgagattatgtgtgccaaattctcagcacaaaaactggcctacaagcggatactacgtatgtttattatgtctctattcttactattattgcagccaatgacttgagaaaaggggttgaatcaaacccctatgatctaaatgctagagttcctggggaatttaagcccaatttacccatcctgaacatggtagatacaggtgtctgtgaatagataataacgcagatgtgctgcgtgaccagatggatacacacacacaacaaatgacaaaggggtgtcattcccagcagcccaggggtccctcggcgatgctgtaagtttcagtccaattcaatgctatgtataagtgagctgctatttgtacacaggtctgtagacaaagaactgtgccacccaactgcgagagtgagtcggcaagtagctgggattccagacagccaggagctcaaagtttcaagcagggcaggatctggcagaggatatatcataaggccaaaggcgctacagcactccaagagggtccagagagggactgggggcaggggcttcaactagatgcatccaggcaaggctgcacagagcgctatgcgaaaggatgcaggaaaggctgagaagcaggttagggttgggaccaggagcagctgggcggatgcgccttccagggcaggagcagctgggcggacgcgccttccaggagcagcagggcaggtttagggaacagaagaggtcaaggcagggcacaggtatatgtgaacatgtcctgggaggaagcctggaaaggggatggaaatatgccaaggagagtcaagaaccctgtgccaagatgcttacagcttattcagtaagaactaaggaaccaaggaaaacttcggggtaggggcagttaaagaatctcaaatatgatttaggaagatgatgctgagggcagcattaataaattctgcaatatttttcaagtgcctactctctgccgtgcactagggattgtaatgaacaagacaggcaaattccccgcctgagaggggcttccactccagtaagagcagactggccataaacaagaaagcaaacagacaagaaactcaagagaacgaggaatgacatgaaggaaatgaaatgaggtcccaggcacagtggctcacgcctataatcccagcacttcagcaggctgaggcaggcagatcacttgagtccaggactttgagaccagcttggccaacatggtgaaaccccatccctactaaaaatacaaaaattagccgggcggagtggcacgtctgtaatcccagctactcaggaggctgaggcacgagaatcacttgaacccgggaagaagaggttgcagtgagctgagattgcaccactgcactccagcttgggcaacagagtgagactgtctctatttaaaagcaaacaaacaaacaaacatgtccgggggtggagagtaacagtgtggactccatttgacttgggtagtcagggaaggcttctctgaggaggtgacatttgagctgagccctgaatggtgagaaggagccatatacaattctaaatagaaggcatatcaaattcttaaggtcagaacaagtttggtctgtttgtggcaaaaaaaaaaaaaaaaaaaagaccttggcagaagcagaatgaccaaagcaggaagggttatcagcggggaggagagtgggtcctcatgggccatgaggcagttaggatcttataggagcagggagccatgtgaactgactttttttttttttttttttgagacacagtttcactctgtcgcccaggctggagtgcagtggctcaatcttggctcactgcaacctctgcctcccgagttcaagtagttctcatgcctcagcctcccaagtagctgggactgcaggcacgcaccaccacacccagcgaatttttatattttttactagagacagggtttcaccatgttggccaggctggtcttgaactcttgacctcaagtgatccgcccatctcggcctcccaaagtgctgggattacaggcgtgagccaccatgcctggcctgacttgcatttttaaagctctcttctggggatgggggaggtgaaagggaagggatggagtgggcaagagcagagagaccagcagaaaggccccttgaggggcatggaccagtgtcatcagtgcaggtgaggaaagatgatccaattcgggatgtattttggagggagggattacagggcttgtcaatggaagaataaggcaagatccagtaaaagagaatgtattggtttcctggagctgctataacaaaagactgcaaactgagtggcttataacaacagaaattcattctctcacggttctagaagttagaaatgcaaaatcaaggtgtcagctgggccacgctccctctaaaggctcttgggaagaaagcttccctgcctctagtggctgccagaagccctcggtgttccttgacttgtggatacatcactccagtcacccggccaccctcacctgtctgtttgtctgtgtccctcttcttataaggacaccagtcctaatgtggtatgacctcatcttaacttgattaaatttccatgacagtaacttgtttatatccacaaagaccccatttccgagccctaaaaagacctgtgaaggtcacattcacaggttctgtgcagacaggaatttgcagggtgaggacattttccaacccaaggcagacaggaatccagatgactcaggtttggggactgtgcaacttggtagaaggtggcagccttgactgagaagagacacagtgaaggaggacaggttaggaggtgaggatggaataggaagtgagggggagccgtcaagagttcaggccagtcgccgtggttcaggcctgtaatcccggcactttgggaggccgaggcgggcggatcacctgaggtcaggagttcgagaccagcccggccaacatggtgaaaccctgtgtctacaaaaaatacaaaaattagccaggtgtggtggcatgtgcctataatcccaactactcaggtggctgagaccaaagaatcgcttgaacccaggaagtggaggttgcagtcagctgagatctcgccactgtactgcagcctgggtgacaaagcgagattccatctcaaaagcaaaaagcaaaaagtttgttggtgccagagggaatgtcgaaactcatctgtaatggaagaaaaatcaaagaaaatgtatcatcaggcttaggacactgattcagacccgtgtcacctctatgggcctcagttttgtcagctgtaaaattggaataaccatccccagctccatcaagtggtcgtgaagacaaaatgagctcatctgtgttctaggcactcaacatgttggctatttctaatacaaggtgccccgttttttaccgagtgttaagtgcaagccccccagtgttgctgacagagaccaaatcaaccccagaaaaaaaaaagaagaaagcctctcagagggaatctggagaatccagggggacaacatttataacaagaaaaacctctcattattatcagacagataaggatgcatgaaataaacccataaagacaggatgctagaggggaaaaaaaaaacaggaagactaagagagttttcaaaacctaaaactgcaaaaacaaccgaaaacactttgctctttttatggaatcaatgaaattttccaccacgcagaacaaagcagcaaacagatgataaaataaagagcgaaaagagaggagagtgagagattaagtccaggaaggccagtagccaactaataagactaataaagagaggacagaggaccagccaggggaactattaaaggcatataaaataacatttaccagaactcagggacactggcttccaaactgagaaactgcagaacacatttatttagaaatgtgggagaaaatgtctcaaaaagcagacaaaagtggttactactggaaaagagggcaggaccatggaaggtgaggtagagaattagtggttttattcctgcccaagctgcagtcacagtggcacaatcttggctcactgcaacctccacctcccgggttcaagcaattctcctgcctctgcctcccgagtagctggaattacaggagcgtgccatcatgcctggctaatttttgcatttttagtagagacaaggtttcaccatgttggccaggctggtctcgaactcctgacctcaggtgatcagcctgcctcagcctcccaaagtgctgggattataggcatgagccactgagcctggccaacctaatgtttaaaaacatgttctttcacttaatgtattctaatctttttcttgttatgttggtggttacatattactccatcacatgagctgagatgagttcactccagtgagacggaggctacagtgagccaagattgtgccaatgcattccagcctgggcaacagagcgcgaccccatctcaaacaaaacaacaacagaaacaaccattatgtatggtatgagcccatttgattttcttttttttttttaattatatatgaagaaaaaacgatagaagattgatactactgagaagaaagtttataggagtctgtatggagaagttaatcaactagggataaaagaggtaagtagtaaccctgagggccacatactagaggaaaactgatacccacagtcgcagacttacatcaaacccaaacagctcatgtgtctcccacccattttatatgaatagtcatcaacatgtattgatgagcatttgctatgtgtcaattactgtgttaaatgcttgaaatatacttactcatttcatctgtacagcaatcctatacaggagacagtactatcatctccattttacaaatggggaaactcaggcttacaaagtctagctaactagcccgagctcccacaactagtgattagcgaaaccaggatcaaacccaagcaaggtgaccccaggattctttataatgccagaatacatgtccactaataaaaaagggctccagcccatggtgccgaccgccccctgccctgagctcaccccacgcagctgatggtttgagacatttcctggcatgactgcatcctgagatgttcatcataattaaaacgtggggaaattttcaaactgcttcagagatgtaatgagtttacattcaattagtttcttccttcattgggagaatcagaaagactgatttccgtatagactcagcagggaggatttcttgctgcctattttgagatttcattctgatgttccagtaatataaatcagcacacatggggggtctggaaaaatcaagctgagctgagaggcagccaaccccaaagaaaatctctaatgcgggccaggtgtggtggctcatgcctgtaatcccagcactttgggaggccgaggtgggtggaccacacagtccggagttcgagaccagcctgaccacatggtgaaaccccgtgtctactaaaaatacaaaaattagctgggtttggtagcgcatgcctgtagtcccagctactcaggaggctgaggcaggagaatctcttgaacccgggaggcggaggttgcagtgagccaagatcgccactgcactccagcctgggagctggaccaagactccatctcgaaaaaaacaaaaaaacaaaaaaaaaaactctaatgcacacgccacatttattcaacattcactttaaaaatatttttggatgccaactatgttctaggccctgtaataaggaccaaggctcaacagtgaaagagaccgcctctgccctcaaggtgcttctagtttggggaggaaagaagacaaacaattagaatccagagacagtgggaggcccaggcaggtggatcacttgaggtcaggagttcgaaactggcctggccaacatggtgaaaccccatctctactaaaaacacaaaaattagtcaggtatggtggcatgtgcctataatcccaactactcaggaggctgaggcaagagaatcgcttgaacctgagaggcacaggttgcagtgagccaagatcgtgccattgcactccagcctgggtgacagagcaagattccgtctcaaaaaaaaaaaaaaaaagaatttagagacaagtgctggggagagctgcagatgcttatcaaggggcttatcaatcccatcgtggagggggctcagaaattaagaagcaaaaaaatctccttaagaaacaaagactcgatgacaaggatctggaagggatcagggtccagaagagaagggcagagcaagtgaaccccaagggctttgggagccaggtccatgatgaggtcatatgctggagtaaatgacaagcaaactctcccttcaccagctgtcaacaatgcacctcccaatccaacctgcatgatgccaggagtgtccctgtcccaagccagttggctgctggctgtctctggaagagaagggctcttctggggagtcgaggggggatatgaaatgaattcccgttagagtgctccacattcattcatgcgtgacattggggtggggcagaggggagttcatgcacatatttgggcacattaaggctctcaaaggaagcagaggtccacaggaggtaggacctgtttaagcctgaggatgtctgcacaattgagtctcacccggcaactgcaacctggcctgggacatagactaactgaaagcctagcttaggagtacacttttttttcttttttttttttagagagggtctcactcagttgcccaggctggagtgcagtggtacaatcacagctcactgcagcctcaacctcccgggctcaagcaatcctctcacctcaccctcccgattagctaggacgacaggcacattgccaccatggctggataatttgtgtatgtagaaatgagggaaggcgggtagggggcgaggggcaggggtggaggggagcggagacctccctatgttgcccaggttggtcttgaactcctgggctcaaacgattctcctgcctcaacctctgaaagtgctgggattagtaagccaccaaatcttaatcaatcatagcagctgagcgtcagtcaatcataggcagccagctggttcaaataaggcaaaacaccaggctgtaaccaattaggctatctctgtgcagcccttccatcttctgtccataaatgtcccctgaccacgttgcagccctgggcttctcaagccattccggttctgtgggctgcctgatttttgaatcgtaaataaaggtcaattaagatctttaaatttgctgtaattgtctttctgatacttttggtgcccactatggggcacagaggacactgctggcaactcccaaggcccctggagggcacaggagaggcaccgctggccccgtgaggtcccatcttccccacagagccccgagggtggtgaatgcctctcagattggactctggttttttgtttgtttgtttttttttgagacggagtctcgctctgtcacccaggctggagtacagtggaataatcttggctcaatgtaacctccacctccctggttcaagcaattctcctgcctcagcctcccgagtagctgggactataggcgccatccaccatgcctagctaatttttgtatttttagtggagacggggtttcaccatgttggccaggctggtctggaactcctgacctcaagtgatccacccgcctcggcctcccaaaatgctgagtttacaggcatgagccaccgcacccggctggactctgctctttttacattgagtccctgatctttttttggcttttgcatccaggattagattgtgctggatgagagcacgtgagcttctgggatctgtggtggctggcaagtcactggcaaaagtcaaagtcatgacaaagacgggactgagtcctgtagggaggcctcaggtgcctgcctgggtcaaacaagctggcttggatctggtaggtggggaaggttacgagaagacagggagtcatgggttcacctggatccaaggggtctccatgaatctatcctcctatctactcctctaactggaactcctgccaatttcatgtacaagaactatgaacccagaacctgtgcttttctagagaaagagagaactttaccaagaagacttacagtggccacagtggggaagctttaaactatatttaatttttatttgtgaggcacattagaaaaggaagaatcaaaacaccccaaaaaacaatgggatgcattttttttcttttcctgagacacagtcttgctctgtcaccaaggctggagtgcagcggtatgatttcaactcactgcaacctctgcctcctgagctcaattgatcctccctgcctcagcctcctgagtacaggcacctgcaaccatgcccagttaattttttgtgggagatgtatatacatgtatatcaagatggggtttcgccatgttgtccaggctggtcttgaactcctgggctcaagccacgcacccgccttgtcctcccaaagtgctgggattacagcaggggccgctgcacctggccaggatgcacttttaactggtttgcaggggcatctaaatgattaaatgaatcaaacattgcctcttttaatagattctttataaaaggcaaatagaaagcttaagtgactcattgatgagaaaaaatattttatgttgactgacaattctgaccgcaccttttctctatctttctatcctcctctgcctagtctgaatttactttttctcttagtaaccttccaatcttaaaaacaaaaacaaataaaagtgatttataaaagttaagctctcagatcaacgaggtctgcttctttagccacttttatggtttggtgaaaatcttaaattcagccctgttcataatgggtttccacctgaattcagtaatctagttagaaaatgcaggctgaggccaggcgcggtggctcacgcctgtaatcctagcactttgggaggccgaggcgggcagatcacttgaggtcaggagtacgagaccagcctggcgaacatggtgaaaccctgtctctacaaaaatacgaaaattagccgggaacattggtaggtgcctgtagtcccagctacttgggaggctgacgcacaagaatcgcttgaaccccagagatggaggttgcagtgagccaagatcgtgccactgcactccagcctgggggacagagcaagactctatctccaaaaaaagaaaacacaggctggcttgggaagctgcctatctttagttattttagttatttcgttttagactcttttttttttttttttttgtaaaagaaatttacttctgtgggaaaagtctccatttgtggggtgtgtccctctttgcaccctaaatcactagaaactttcaaaatggagaaggtcaagacttaactttgtttcacaggccttgcctttcaccattttgtcttcaccaggcttgcgtgtttgtttgtcttggcaaataatactattttggcctgaaatctggttatcaggctagctgacaatccctgggggcaataatgagtaatcgaagtgtcctctgatttaacccccttgctagaatgaaaacagtcgggggataaagaaaatatccgcagagtaaatgcggaaaagatagataggtccttggaagaatggatgatgggccagctggggtggccttctgatctcgtctcctgtgataggagttaatcttggccgggtgcagtggctgacatatgtaaccccagcacttttgcaggcccagacgggcagatcacctgaggtcaggagtttgagaccagcctggccaacatggcgaaaccccctctctactaaaaatacaacaattagccaggcatggtagcaggcacctgtaataccagctcctagggagaaagaggcaagagaattgcttgaacctgggaggtggaggttgcagtgagtcgagatcgcaccactgcactccagcctggctgacagagcgaaactctgtctcaaaaaaataaaaaagggttaatcttcagaagactgacgcagttgagttccttttgtaggatctgtcttttggcagatgaaagagaactcaggaggccttgccctgtgttttgccttcaactcaaagtaattaatataccaaaaatgtgactaccaaagcaacacattttggggtggcattccctgaatgctttcaatggctagttttgtttagtgagcaattaaataataactgttaaaaaaaaaagaataaattaggtgaatatggacagcataaaagtttataaatgaatttgtcattgtttcaaaaatcttttgcagcaatttggaattttaaagtaatagatatttataaaatgtctgagtcatttcttagttaaaatactagaacattaactgctaaacataagtttcaagtataaatactttggcatcttggttttgtacaatatagagaagctgaatatatttgggtttgttcataaacatgaaaacattgttctaggaggaagcacatatttctagaaattacaaatgtatattcatgaaatgttagtatataacagtttaaaattgttttacttcttatgttttcactagaaattgaggttagtaacagtttaaaattctaatcaatataagctagtgaaaactggaaataagcccaggcatagtggctcacgcctgtaatcccagcactttggggaggctgaggcaggcagatcacctgaggtcaggagttcgagaccagcctgaccaacacggtgaacccctgtctccacaaaaaatacaaaaattagccgggcatgggggcggctgccacctcaggaggctgagacaggagaatcacttgaacctgggaagctgaggttacagtaagccgagatcgcgccattgcactccagcctgggcgacaagactgaaactgtctccaaaaaaaaaaaaaaactggaaataatatgggaaacaactccatatgcaaggaaaaaaaagatatgtttttgttaagtgaagctatgaggtatgaaatatgtgtctttgttaaggaaaaaaagagtaattttcaccctaacgtagaatgacaggttgccccaaaatgagaaagagggaaggtatagataggataaataaaaaactgatggaatataagaaggttgtaggaggtttgtggacggtgaatcatgtgaaagaaattttattgtgatcagcagggcgtggtgactcacccctgtaatcccagcactttgggaggctgaggcaggtggatcacctgaggtcaggagttcaagaccagcctggccaacatggtgaaacctgtctgtactaaaaatacaaaaatcggccaagcatggtggtgggtgcctgtaatcccagctacctgggaggctaaggcaggagaattcgcctgaagccgggaggcagaagttgcagtgagccgagatcacgccactgcactccagcctgggcaacaagaatgaaactccatctcaaaaaaaaaaaaaaaaaaaagaaagaaaaaagaaaaaaaaagaaaacaaggtaaaaaaaaaaaagttggggggtttctttaccttttaggaaactggcaaaggaaatgaagactgcgttctaccaaaataactttttgtccttcacgttgtctttatcaggtttttgataactatagaaaactattaaagagctaaggtttttcctccaaatatgttgctttttatattcacctttgaagtctttatcactctggttaaattaatgactattatttcatagttacttgtgatcccattttgatgaaatgttttaaaccttggtgatatttaaaccaaaatcaaactctaaatttagtctttctgaccaagaattaactttgggattctcttgctgggccctgagaaagcctcaaaggatacatctctcaccttgtaaaggggagatattatacgaattaggcttatttagtatactaaattatatgggaagtactgtcaaataataagtaatgctgaaccttctttgaattttactcatatgtgttctagaaaattgtttacaatttttagaaatttgatacgtgatcagccataatttcagttattatgttaaatggttgtattccacagaaacaactaaatttccttgtcaattgtgtcattattgaatgaaatttcaacagctctttaaccatggacattttaagtcctgtcactcacagacggttgtttgctcggtactttcctaagcaactataagcctatatagttttgtcttcaaggaggctcacggaaaagattctgacaagtacaggtttgtgattactttaagatcgtatcattaaactgggtaagaattctcagaactcaccgagcgtggtggctcatgcctgtaatcccagcactttgggaggccaaggcaggcagatcccaaggtcaggagttcgagaccaacctggccaacatggtgaaaccccgtctctactgaaaatacaaaaattagccgggagtggtagcaggtacctgtagtcccagctactcaggagactgaggccagagaaccgtttcaacccagaaggcagaggttgcagtgagctgagattgcaccactgcactccagcttgggcaacagggcaagactctgtctcaaggaaaaaaaaattctcagaactcgtatgaagaaactcactggttcataaaactgttaacccaccatcaaaagaacaagaattacttaaatgctaagtcagattttcatgctaagtcagttgattgtgaaattgttaagatatagaagctgaatgaactccctaagatttatccaagtcaaatcacctatgatgacctattcattggacagggttatgcatcttaattggagaaataaaacttgtacttgaaaggatgtaaattcaacattaagcgtagactcatagagggcttagacaactacttggtcttttctgagtccttaaagcttccattattaaaagttctgtgcaggctgggcaagtggctcatgcctacaatctcagcactttgggaggccaaggcgagtgaattgcttctgctcaggagttcaagactagcctaggcaacatggtgaaaccccatctctacaaaaaaacacgaaaattagccgggtgtagtggcccaagcctgtggtcccagctactcagggggctaaggtgggaggatcacttgagaccaagaggtcaatgctgcagtgacctcgtgtgatcacgtcactgcactccagcctgggtgacagactgaaaccctgcctcaaaacaaaacaaaaaaaatcctctgttccatgactcttcataccacagacaaaatgaaacaaattatggaaaaataatggtgtggcgactgttctagaattactaggatggtttgtaaccagtgagtgcttagtttgtcaaactcataatcctggaaagacaatcaaaacttcagatgaggccgggcgcagtagttcatacctgtaatcccagcactttgggaggcttaggcaggcagatcacatgagctcacaagttcgagaccaccctgggcaacatagcaaaaccccatctctataaaaaaaaatacaaaaattgggtgtagtgatgcatgcctgtagtcccagctacttgggaggcagaggtaggaggatggcttccacttgggaggcagaggaggttacagtgagctaagattgcaccactgcactctagcctgggtgatagtgccagagcttgtctcaaaaaaaaaaaaaaaaactttaggtgatacacttctgctacctgataggccatttgaacatctacagagggatttcattaaattgccaccttcaataggatatcagtatgtcttgcaacagtttgcatgtttcctggttggatagaaactttccatgtagaaaagctaatgctatgacagtagcaaggaagttattacaaaatttatttcctttatggcagtggtctccaacctttttggcaccagggactggtttcgtggaagacagtttttccacggattgggggtgggggatggttttgggatgacactgttccacctcaaatcatcaggcgttagagtctcataaggagaccgtaacctagatcccttgcacgtgcagttcaccataggagttgtgctcctgtgagaatctaattctgctgctgatctgacaggaggagttcaggaggtaatgagagcaatggagagtggctgcaaatacagatgaagctttgctcactcacccgccactcacctcctgctgtgtggcccagttcctaacaggccacagaccagtaagtcttgggggcctgctgggggttgggggcccctgcttgaggagacatccctgtcaaaatctctagtgacacaggaatccatttggacaaattataaaagagttaaaatgttagaagcacaaggtactagcattgtctctatcaccctcagtcttttggaaagataaaaatgacaaaaggcatttttaaaaatgaatttgacgaaggtaactgaatcaattggattgacttggccaaaggtactaccgttagcactaatggcaatcagatccattctcactgggatatacagattgaccccttatgaaataattactggaaggcctacgctgctaatagaacctcatgtatctttcactcttataaactctaatataattaaatgctgcaagactttaacgaattgtgtcaaaatgtattttcagagggtaaaagaagcttttcaaggccaggtgcagtggcgcgtgcctgtaatcccagctactctaaaggctgaggcaggagaatcacttgaacccgggaggcagaggttgcaatgagccgagatcgtgtcactgcactccagcctgggtaacagagcaaggctcatctcaaaaaaaaaattaaaattaaaattaaaaataaaacctatggccacaagattattgcaagggtcagatgaggtaacggatgagaaagtgcttcaaaaagtataaagcaataaaccaatgtcacataataatatttggggctcctgagcccataagatgcaagtgttcgctgccatcagcccatggatactctcccccacacagaaatcttcatgcataattacaaagtgttcagcaaattcacgtctgtaatctgtttaaagtttatgcacaggcaatgaccgtgtgtcccttcctccatcttaaatacaatactaatctggtttccccttgtttatgcatttaacaggtatctaatttttccacactcctggagaactaactcatttagctccagggctgtcttggttgatttctctacaagaagaccagcgcctcagaaattgacagaggtttccaaagaaatgctacagcaaaaaaaaaaggaaataaaaaaaagaaagaaaacctacgcactggtcggtgtgaagcctccccttcatctgtgtgtcagacacacaattctcaccatcgggcctgatggttccatttggtttgctgttcagtgagtctgcagaaaccaagcactgtggctcatggccctgagccaaagtcagatgtgggattagaagccagggcacagtggcagcaaagatcagcttccaccaacaagctattaaaaaagtttctctccctggtattttgttctttcttttctccggagggcacagaagcattaaacagtcatgactgaatttatcctcccaccatttgcacaaaatgggagggaaaggatttcagtctctgtggagccttgagatgcctggaggttaaaggacttgtggctaatcctgaggactctaagcagctcagctagaaatacaacctagggctccagactccccatctgtgctgaaacactctctttattactgtgtaggatggagttctgcttcctggcctcagctgcccagagaggaggtcccccctctaaggaaagcagcagtattgcaaaggtgctcacagggactcctaaggtcatattccttagggtgggagccaccagggaagggaagtggaatgaggccaagaaaactccttgatccatccggcatccaaccctgtagccagcaaacctctccaggccctgggaaaagcagagagcaaggattctcagcccataatgtcagctcctctggtctccgtgcttctcttctcaccatacttggcagaggggggataggggaaaaaacacagtttggcactgtatccccctactctgccccatacccctgcctgaggaacaccaagacagggcttcccctttctccctcctgctctcagtcaaagtgtctttatagccataaattaaatttataaaatgagacagagtctccccagcaaagggggaaagagattgattcctgattgtggaagagaattattattgggtccttaaaaaaacaaaaagaggccaggctcagtggctcacgtctgtaatcccagcactttgggaggctgaggctggcagatcacttgaggtcaggagttcgagaccagcctggccaaaatggtgaaacctcgtctctactaaaaatacaaaaattagttgggcgtggtggcaggcgcctgtgatcccagctactcgggaggctgaggcaggagaatcgcttgaacctgggaggcagaggttgcagtgagctgagatcgcaccactacattccagcctgggcaacagagcgagactccagctcaaaaaataaaataaaaataaaccaataaaggtaatacaagagcaggttaacaaaatcaagtcatgctgaagcttagaatataaaaaagttctctcttccctgcctcttccaattccacagcctggacacacctgttctcaggaggtcaggaatccttcccccgagcaaaaagattctgaagatattaagttactgtcagccatagaatgtcacctcacccaacagctaattcttgcttccagaataacacagcccttggactgagagtttagctcaaatcctttcctctcagcagatccagaacacctacaactgatctgggcccacaaaggttttacttctctgccgcttacaaacagagaacacattaggcttaactggggcttcaaattttttccaccaatgtttaagttagtaaactgaatagacacttagaaagccagcatttcttctcactggatgggagttggtgcccaaagggaggctcagaggcaggacggagaaaacaagacaaaggggaagcccagtgtcgggatcaagtgacagctgagaatggccacaatgaaggcacctggcaccaaaaaaggaatactgattctggaaggatggactgtgaacaggtgtcatctctccaaaggagaggtggtagacagcaaagcatggccatgatattttgtaagctccgcctactgagaactagagactagagaaacagactctccggtttccaccttcaccttcttggagctcttccactgccatgtaaagaagcctaggctacactactgaaccatgagcaaccacatggagaggcccaggcaaaaggcaacaaacaccaaggccccagacctgagtgaggcccttatactctccagtctagtggaactgccaaatgaccgcggcctcatgagtgaccccaggcaagaccagcagaagaagcacccagctgagcccagcaacctagaaccaggggaaataaattgttgtcttaagctactaagttttgaggtgttttctaaccatactccacatttacagtctgttaactacccaacatccattacacctccttggcaaaaacaccttaatttgcttttgaggaatcacttttccctccattattcatccttattatctttgttatttactctaatggtgggaggagggagaacaggacacatggcccaggcttggccattaatacactacatcccctggcaacatacattagtattcagggatgagcacacatcctgctcaagtttcatgggccaggagtaactggcctgtcatgggaaacagcctgaaagtggagccacacagggaaaagcaggaccaggagatggagaaaaaccaggtgctggtgacatcctttgatccacagagtctagcagtgcccagacaccagttctactcctggatattttaattgcatagaccaatacattttatttcttctttatgccagattgagttaggttttctatcattcatgatcccaaaagtcctagctaatacaaagagactaagggacttatttttatcgtatatcctttgtactacttgaatttcttaccaagttcatgtattacttcttcctttcaaatgaaactaaagaaagaaagaactcattttaaaagcaacatacaaaatatacaccaagaaggtaaatcaataacagaatgaagactaaaagttctctccgcactaggctgtgtggccacaagagtgctgagtgcctgctccagtttccgtctgccctctctttcagtaatagaatatcaacatttagctgggcaagctgctgcatagctaaaagaacatgtgtcgcagcattccttgcagctaccttaggtcatatgaataagttgtggccaatgaaatgtaagtggacctgctgtgcaggactttcagggaatctacctccctcctgccactttgtagcatggaaggcagatgtgatgacttgagctccagcaactaccttgggtcagaaagacaaaggctgccctcttgggcaaagcagtgagccaaaaaggagtctagatccctgctgactccatgaacctattttcccagccatggtctctagatttcttctacagaagaggggtctttcttgttttttgttttttcttttttttgagaactggcaatgaagacgcttatacagtcttagtctccttttcaaccttggaagcagatctgcagcaataatagtaacaagcaggagcaatgggggtactataatgaccatcttttatgatgactggcgtattaatacaaatcacatttttttgagtccattcatgctatggatgttttcttatgcataaacatagagtagacacgtactgaatagatcacatctgttaagtctcttgccacaagcatcacaacttttcagagctgtctcttctgtgaaaatccatttaatgtagcaagttgattttctttgtggttcatccccatgcctgagacttgcagtaatgtaaaaccagtttaccatcactgccaaaacactcagagagagttccaacttcttggtctggggaaggagcaaaggactgattcacataaataaacaactgttctgaggccacaagtttaagaaactttttgatgaagtcaatgagtccttggatggttcatgttcgctctactgcccacttctttgttttcataataggagtatctcccacagcctttagcaaaatgtcaatttttttcttggtgtcgccagcaggttcctctgttcccggagaaactgcagtggaagacgggggctccagagtggttgtttctggggagacctccgtaagtccttcccctccagtagcacttgagggaggaagctgcaacatggactgcggctcctccaccatcttgcttggagagactccggggtctttcttgttttagccactatgtttcaggtctcaattattctcagtcaaatctaatcctcatagatatggatcaccaaaagcagagaagcaggaaacatcaccaccagtacaactagctgtaggtgtctggttgccatggagaccaccccaacacatgcagattccaaagtacaaactcactcaaacaagacagacctgatgtaagtaagcctaagagacccctggcctcctcatttccggtagagtccccctcagtccataaggcagaacggtgatgccaaaccctttaacagccccagggcagttggccccagacacacagttcctgttgtaagcttgaacagctttgcttgactactttcacaatcaaaggactgccaagtcctctagactctccagcaggactgtctctcacacttcctatctcctatgcctctgtccaaagtcaaaacctcattattacctttcacctaagtgcaagaacctccatcctgtttctcaactgccagcctccccctgtgcacacgcatggccagtccatctgctaccaacagaatgtatttcttaaaagcacagctctgatcctgtccccttctcaaaaacgtctccagaaacttccccatcaacctagagaacagagcacaactcctttctaaggaactataggttgatcacgtacgggcctcaacctacctctctggcatcacctcccaaccaaacgaataactatgttgccaacagccctgtattttccactcttatgcttccaattttctgttccctctgcctgtaacgcatttccttcccctaccccgtcttccccactcccatccttacttgtcaaaactcaacctatccctcccacccaagctcatccatgaagaagtcctaattccccaactagaagtaacctccctgtcactgagtttccagcaccttttgttcattacgttcttaacaaccacatgctgacccgcctcataatgacaggcaaatgtgacttctctccccagccgaccttgagctccttgcagggagggattatatcttgcttctttgcctgctctcccacaatgccttacacatagtaagtgctcactaaatggttgagggcttggcctgaagacaattctctccctgctcccacattctgagcagctgttctccaaagaaagaaacaaatggttattctgcaaacagaacacgtttgggccaactctaaaattacacaggcccttgacaaagctttgattactggctcttctccccttttatgagcaagccactgctaaaaagcaataatatgcaatccaaccgcagcctctccacaaagcacttgtgttaataatctgtgtatggatttggtcttgacatgcaagggctaaaggacaaaacttaaccaatattaactttgatcctttgcactcagggtatctttcaaaagaattgatactcagtaagtgctttttcatgtggttggtactaagatgcataagaaaaatgatgtcagctactccctattatttaaattgcagcagaagacatttagatcagataagtttctaacaagctagctaaacactcaattaggttacaaaaaaaaagtataaagtcttgcttcacaaatatctttgggaacaatctctactcctaccatctgtctggattcaatgaagtattggcccgtctgatggcagagggctgcctgagatgactcccacaagtctctgccagcctgagatttttcagacatagtatgtgatccaacaggcactgtgcatcaagagagaattcaaactcaagctcaaactttccaagcaggaaagatcctgcctgccctctttcttttatgagagccaaggagccaggcccagaggacaggcccgagttcccagctgcaggctgaccagtatcccatgaccgactggaaaatgaacctgaaagtatgacaaatgcccccaacccaggctggtaacaagatcagcagtcttgagaaccaacactaatgtcaagtatgagccttccatagacagggctgcagctagacaccagaggtgacagcctcctcccaggcttccctcatccaagctccagggccccattctttatgtccagagctcttctgactgtgacctgaaccctaagcattaactcagttgaattcttagcctcaaagttacatggagcctttgaagggagtctgctttttccaaacaccagctcatccttcattaaaccatgatcccgattagaacaggggttcccggctttggctgcacatcacagtcacctggtgatatggtttggctgtgtccccacccaaaccttatcttcaattgtagcttccacaattcccacatgttgtgggagggacccggtgggaggtaattaaatcatgagggcgggcctttcccatgctcttctcatgatagtaagtctcatgagatctgatggttttataaaggagagtttccctgcacaagctctcttctcttgtctgccgccatgtcagacatgcctttcactttctgccatgattgtgaggcccctccaggcacgtggaattgtgagtccattacatctcttttgtaaattgcccagtctcccgtatgtctttatcagcagcatgaaaatgaactaatacacctagggagctctaaaaattactggtgccttatcctagggtccctccaccccccaacctcagagattctggggtagttaatccagggtatgttcaaggcattggggttttttaaagctctctaggtgattctaatgtgcagccagggtggagaaacaatgcaacagaatgaagagaacttccccaaagccagagaactctttggaagtgaaccatcaaggacatgaggccaagttagcttactctgctagactacagatgctagcgactgttacaaatttgagtgctgcttgagctagctttccctcacaatctcaaattgcacacttttggcttggccatctgtcttgaaacctgtttcctttgtgacaagaagaatggagcaaaagggcccagataactcatcacacttcacttgcaaagccagcccctgaagattcttcaaaggcaaaagttgagcaaaggaagagctgctgcagcacagagctcctaaatgaagagcaagccctgtttgggagggtccaccacaaagtggtgatgtggtgatcccctggaaatcagccagttgggaacactggacattccagagagcattcctccagcacagtggtcccgatggttcttgctcaagcagtccactgtcaccagacctcagaaaaccgtgtcataaacattgcatcaggggccagcagacttcttctctacagggccagatagtaaatattttaggctttggggccacagagtcctgttgaagctattcaactctgccactgtagtccaaaagcaatcacatgcaatatttctgcaaataggaatggctgtgttccaacaaatctttatttacaaaaacaggcagcaggccgaatttaaggcacccatgtactttgcccacctctccgctaaaacacaacttccttacacacacaggccatctcccatcacttcttcaaacccctggcactcggcacagtgactgcaatagagcaagttctcaataaatgctaaacaaacgaaagaacgaatgaataaaaaatgagccgactaccctaaaggaatatctattaaacatctaccttttcctatagagcaactaataagagtcactgcaacttcagagcacttacccctgactatttaaactgaatctctaggcccttattaaccttctgcccatcaatcacatatactcattcccgccctctccttcataggaacagggaaggatgcccccaaacaaagaggaagatcttcccgggggaatgctgtggccctatcaatacagaggcccaggcctgcagggaaacacagaagggtaggaggggaggcaggggcgccagatactcactcacgcagtcagagtatgaacgtggggaggaagggggaaagggatggggacagacagggactgtttgcagggctctgggcaggcctcagagccacaccaccccagatgctcaacagagcaacagcatacacgtgggctcatgcgtcaagacaaaggctgttacttcccatcacggcacagagaaggtgatgtgtatcacttcctcccccacactgtggataatgacattggaaatctgaagcatgaaaccgaaaagaaaaaatacaaaaataatcatcatcatccgtctccttcctgagtgttttgctaccctttcttcttccttccttccccactttgtgccaccccctcttcttgaagcaagactttgtcttcctcccagaggaatcgggagtcagggagcctcaagcccacaaaaaccactagtgtttgggggctgggagtgccaggccaacagtcaggcttgtctcccaaaatatgttcacggtctcctgtccgtgcctcatgtggtttgagaatgttcacctttgccaatgcacagcggttttcttgttggaaactgaccatctgaggtctttaaaaataaaatgctggctgggcgcagtggcccacgcctgtaatcccagcactttgggaggccaaggtgggtggatcacttgtggtcaggagttcaagaccagcctggccaacatggtgaaactccatctctactaaaaatacaaaaattagctggacgtggtggcaggcgtctgtaagcccagctactcgggaggccaaggcacaagaatttcttgaacccaggaggtggaggctgcagtgagccaagattgtgccactgcactccagcctgggtgacggagtgggactccaccccaaaaataaaataaaataaaatgccaactcctcatcacataaactctaagggtcccaataccccaattatgagagtgtggagtgccagtgtcttgtagcattgctatgcaggaagcaacacgtcagaaggcagtgggtgccccatagcacctgtgccatggacccggcaaccacgctgtgaataatggttagagagggaccctcccccatgtcctcttcaggcaccaggccacactgggcttgtcaaatggggcatctggggcaggtagctcaaggtcctaccaaaccaaccctgttacactgtctcacctctttgttgagtgcccacccagaaggcagccgtagccctaagatagacaaaaggcacctcccttgttattgcgtaccagtgcagaacaagcaaacctgcaaagaatagaaccttggaggccctggggctccccaactccctaaatccttaaaaagcaaatttaagagaggagcttcaccgtagacaactgtcccaaaacttccaaggtcaggcctaggaagtcaggcctgagtgatgctggggacggatctgctcttggtccaagcactctctggctctctcctttatccctgggaggtcaccatcccagggaggtcatctcagggtctttcatttctcccagcctcctaaagagaaaaaccatagctcagagtgacagcaatgatctttgcaggagcctcctcagagtccatgagcctattccttgcatatggtcttgtggtgctttggttgtggcccagcccatctcagtgtggtccaacacccctcacattccaattccataaaatatctccaagaaaacatatcaggcttccctacctctcaggcagtaagatggaaaaaaaaaaaaaggtagcagcaattattaatttctcaatccaggatctatagaggatttaattattgagaaatattaataattgagaaattattaatttctcaatccaggatctaaaagctaggatttccaaagaccctgaattcaatgactgctccctcccctggactttccctcaatcatatttactctagaataaacctttccaggggccctcctgaaatatccctgacttcatgctacaattattccccccaccccccgccccaagacagagtcttgctctgtcacccaggctggagtgcagtggtgcaatcttggctcactgcaacttccgcctcctgggttcaagcaattctcctgcctcagcctcccgagtagctgggattaaatgcgcccaccaccacgcccggctaattttttgtatttttagtagagacagggtttcaccatgttggccaggctggtctcgaactcctggcctcgtgatccacccacctcggcttcccaaagtgccgggattacaggtgtgagccaccgtacccagccatgctacaatttaagtccatttctttccatccagctctctttggaaatagagaacagctggtcactatcattcctccagactcaagccatcactggagagcatcattaacttccaacagtgagccagttatttggaaaaaacattatgcaccacttgctgcacaaaagcagacttagccaaaacctccttaataaaatcatgtctttcataagaaaccagctccctaagggatgaaataatagatattaaattgccttttcacgcctagaagtaagtttcttgattggtaagactgtctttctcttctgcagcttcatgatcctattattccttataagtgcttcttccttgatagaatatgcactgatacagagattcctagttggttcaagacttgccaaagagacacagcagacccacagcaaataaaattaaaatggtgatccccgatgtttcagccactccaaattcatccagatgtcttttgggacaatgactgccttctcactcacatgaaaaggatattcaactgcatgcttaattttaccactgaatcatatccctaagcaggtgaactaaaatccaactgaaacacttcacaattacaatgaaaagatgtttgccaacctgtgctgcaacttgtccctttaaacatgcagaaacaagaagctcttaatgaaccatccgttccaacgtcctcatttctcagcagagtcaactgaggcccaggaagaccaatgagcttgcccgaggtcactctgccaaatactggcagcccctgacatcttatctgggtttcatcctacctccgccattatctagcaattttcaattctaaataagacatttactctccccagacttgtttcttgtctgtaaacaaaggcagctggaccagacatcagctcagaggcattgtggtataagagtgtaaattctacagtcagactatgggttcaaatcctggatatgaggccgggcgcagtggctcacgcctataatctcagcactttgggaggccaaggtgggtggatcacctgaggtaaggagtttgagaccagcctggccaacatggcgaaactccatctctactaaaaatacaaacattagctaggcgtggtggtgggtgcctgtaatcacagctactagggaggctgaggcaggagaatcacttgagccctggaggcagaggttgcagtcagctgacatcacgccactgtactctagcctgggtgacagagtgagactctatctcaaaaaaatcccagatctgctcaccatgtgatactgaatttatttaaactcactgtccctgtaaagtggggaggaataatagtaactggtatatacctcaaagagtcattcttataaaattaaattagttgatctaggtagagtgtttggcagaacaccttgtacacagtaaggactcaataaatattaggtattctaatcacctaaaatcttttccaccctttaagttatattactctaggatcctgagagggaataatgactttttttaatggtaaccactctcctattaagttcatgcctcaggcaaaaaaaaaaaaagtcaaggctagacacaagtgctgatgagagaaagacaatgattactagagacttggagagtaatttaaggagtcaggagaaaaataggcaaataaattccaaaatgagacattaagaaaaaatgattaacacttccagggccctgctaatgagaaaaaacaacttgcgaaatatatttttgctaagcatatttaaaatacacatgtcctctgtccctggaatctcttacagaaacacctattttggtgaacaattatatattgtataaatatgtcactgcagcattatattacagatgtattgcaatgtacgcacaacaaatacataaatgtatacaaaccaactgtaacagcatgctacagtgctgtgtagacatctgtgcaaggtacaatgggaccccggtcaactatcttatagccagttttgtctttttcaagacatatattcaaagcatctcagaactgggctgagggagcaaagcctttacgataccacacaggatggcacatttcactgacctgacactcactacgtgtgcctaatacaatttctccaaggatacagactcaggattgacagtagtgacctaggagaagtaaggggaagaggcaaggggactttctttttttcttttttttttttttttacatctgaatttttccacattctactctctggctgatacaacaaattctctagacccgggtttctcagccttggcatgactggcacttggggctggagagtcctttgtagttgtgatgcctcgtgccctgtgtgttgcaggatgttaagtagcatccctggcctctacccactagatacccacgtggcaaatgtgctaaatgccacctggagggcaacattgccctcggttaagagttactgccccagccaatgtgttggccttattaaatgtaatttattccatgatataagcacaagccactgtgactgcccaggccacctgggccatactgcctttccctagttcagggaaacatgtatgagaatccactttgagttgttaaaatcccctgggtttgagtcccaactgtctcccatatgatgttctgacattccctatgcatctggggacccaccaggagtttctttgtgcaactacctcatattcaagaacaatgtttgttattgttgttttgggagtgggtttcactcctattgcccaggctggagtgcaatggcacgatcttggctcactgcagcctctgcctcccaggctcgagcaattctcctgccttagcctctcaactagctgagattacaggcgcatgccaccatgcctggctaatttttggttttcttttgttttttgacagagacagggtttctccatgttgtccagactggtctcaaactcctgagctcaagtgatccgcctgcctccgcctcccaaagtgctgggattataggtgtgagatatcgcatctggctcaaggacaattttagaaaagtaaatcatttctttctgataaatacacacacataatctttagagtctctttctttctaccgactactttaaaagtcagaagtacaactatctgagctcctcattcgtgataacacactggccttgtgattttttttaaggaaattacatcttaaatgttcatgttttcatgctcccaaattcattcttcatgtcctgaaaacttcttacactctatctggttttgttggtttgtttcctttcttgttttattttggtttttgtcttttgctatgtgaatcttacaatagcttctgatctaaaagagtaacctagggcacagtggctcacgcctgtaatcccagcactttgggaggctgaggtgggtggatcacaaggtcaggagatcgagaccatcctggctaacatggtgaaaccccgtctctactaaaaatacaaaaaattagccgggtgtggtggcgtgcacctgtagtcccagctactcgggaggctgaggcaggagaatggcatgaacccgggaggcggaggttgtagtgagccaagaccacacctttgcagtccagcctaggtgacagagcaagactccgtctcaggaaaaaaaaaaaaaaaaagaactttgaaaaactaggtgccccatcactcatttgtaagttgacatttaaaacatttttgtctccagtttaaatagttgcagaagatatcattttaggcatgtaaatatgcagacagatagatcagatatagatagataggtaggtaggtaagtaaggaggtaggtaggtagctaggtagatagatttgtttaaataaaactgtttcattagtcttttgtttgtttgttttttgttgtttttttttttgagacggtctcactctgttgcccaggctggagtgcaatggcgcaatctcggctcactgcaacctccaccttccgggttcaagcgattctcctgtttcagcctcccaagtagctaggattacaggtgcccgccaccatgcctggctaatttttgttttttgtcttttttttaatagagacggggtttcgccatgttggccaggctggtgttcagctcctgacctcaggtgatccacttgcctcagcctcccaaagtgctgggattagcaggtgtgagccaccatgcccggcctatctcatcagtcttttaagtgaatccagtaggtcctaaatagaatagagattttattcccatcattatccacttaaaaacagaatacataaacaagcctatgtttctttgtttgatgcacttttgtttgcatgttacattttacacacacacacacacaaatgcaccataagcaaactctttttcaaaagccaaaaaatttacatcattgctttttctgcttgacttgtatttcaattctatttcaccacagaatatatcctaaagcaacttatatttatactagaaaatctattgattttgtttgtttgtttttgatgaagtctcactctattgcccaggctggagtgcaagggtgcatgcaatcttggctcactgcaacctctgcctccccggttcaagcaattctcctgcctcggcttcccaagtagctgggattagaggcatgtgacaccatgcccagctaactttgtatttttagcagagacggggtttcaccatgttggtcacgctggtctcaaacttctgaccttaggtgatccacccacctcagcctcccaaagtgctgggattacaggcataagccaccgcacccagccatattattgatttctttatcatgcttccctgccataaaaatatctgcatacattttagattaaaaccctcagtaaaatcagcatagaagagacataccttaaggtaataaaagtcatccaggacaaacccacaaccaacattatactgaaaggggaaaagttgaaagcattccccctgggaaatggaacaagacaaggatacccactttcaccacttctattcaacatagtactagaagtcccagccacagcaatcagacaagagaaagaaagaaagggcatccaaatcagtaaagaggaagtcaaacatcgctgtttgccgacgatatgatcgtatacctagaaaaccctgaagactcatccaaaaacctcctagaactgatacataaattcagcaaagtttcaggatacaagattaatgtatacatatcagtagctctgctatacaccaacagcaataaagctgagaatcaaagcaaaaactcaaccccttttacaatagctgcaaaataataataataatacttaggaatacacctaaccaaggaggtgaaagacctctacaaggactgctgaaaagaagtcataaatgacacaaacacatggaaacacctcccatgcacacagatgggtagaatcaatatggtaaaaatgaccacactgccaaaagcaatctacaaattcaacgcaattcccatcaaaacaccaccatcattcttcacagaactagaaaaaataatcctaaaattcgtatggaaccaaaaaagagcccacatagccaaagcaagactaagcaaacagaacaaatctggaggcatcacactacccaacttgaaactatactttaagactacagtcaccaaaacagcatggtactggtataaaaatagacatgtagaccaatggaatagaatagagaacccagaaataaaggtaaatacttacagccaactgatcttctacaaagcaaacaaaaacaaagtggagaaaggacgtcctattcaacaaatggtgctgggatcattggaaagccacatatagaagaacaaaactggatcctcatctctcaccttatacaaaaatcaacttaagatggatcaaagacttaaatgtaagacctgaaaccataaaaattctagaagataacactggaaaaacccttctagacattgacttaggcaaagatttcatgaccaagaacccaaaagcaaatgcaacaaaaacaacgataaacagataagacttttaaactaaaaagcttctgtaggtcaggcacagtggctcacacctgtggtcccagcactctgggaggctgagacaggcagataatttgaggtccagcgtttaagaccagcctggccaacatggtgaaactccgtctctactgaaaatacaaaaaatagccaggcatggtggtgggcgcctgtagtcccagctacttgggaggctgaggcaggagaatcgcttgaaccctggtgacagaggatgcagtgagctgagaccgcaccaccacactccagcctgggcgacagagtgaggctccatgtcaaaaaacaataaaataaataaataaataaataaataaataaataataaaaagcttcttcacagcaaaagaaataatcagcaaacaggcaacccacagagtgggagaaaacctttgcaacctatacatctgacaaaggaccaatatccagaatctacaaggaactcaaacaaatcagcaagaaaaaaacaaacaatcccatcaacaagtggcctaaggacatgaatggacaattctcaaatgaagatatacaaatggccaacaaacataagaaaaaacgctcaacatcactaatgatcagggaaatgcaaatcaaaaccacaatgcaacaccccttactcctgcaagaatgaccataatgaaaaaatcagaatataatagctgttggtgtggatgtggtgaaaagggaacacttttacactgccagtgggaatgtaaactaacacaaccactgtggaaaacagtgtggaagttccttttaaagaactaaaagtagatctaccattggatccagcaatcccactactaggtatctactcagaggaaaagaagtcattacacaaaaaacatacttgcacacacgtgtttatagcaacacaattcacaattgcaaaaatatggaaccagcccaaatgcccaccaatcaaggagtggataaagaaaatgtgatatatatatatatatatacatacacacacacacacacacacacacacacacacacacacatatatatacacatatatgtatatatgtatgtatatatatacacatatatgtatatatgtatgtatatatatatacatatatgtgtgtgggtatatacatatatatatcatggactactactcacccataaaaaggaatgaaataatggtactcgcagcaatctggatggaattcattattctatgtgaagtaactcaggaatggaaaaccaaacatcacatcttcactcataagcgggagctaagctaggcataagaatgatacaatggactctgggaatctggtggaaagggtaggggggctaggggtgagcgataaaagactacatattggggacagtgtacattgcttgggtgatgggtacaccaaaatctcagaaattaccgctaaagaacttatccttttaaccaaacatcacctgttccccccaaaacctactgaaactaaaaaaaaagaaaaaaaaaaaaaaaagggcaaaaataaataaatacctacatacattttaatttaattttttaaattttcctatgagcctagggctctaaatgcttacataacaatttcttggatttaataatgataactattagtgataggaaagagatacataagaataaataatatataagaaaccattttataattattaaacattacaaagcaaaatgttatttgaaatgtatatgttagtgaatggggctttattcttgttttttcaattcattcatctatatgaggatagttattaagtagtcattactagaataagacagagttcatcaattttatttttatttgatttttttcttttttgttttgtttttttctttttcataacataaggaaagagaaaatgtgttcatataaatgagaggatgggggaaaaaaagagatgttgtgttataatactggcattctgttctttgtactattttcaagttacagatccaaaatccctccatcatggaaaattactttcaaggacctctctgttgacaatttgattagatccaccttcaaaggacaggatcacatcagaactgctaaaggaattgtgggccgggcatggtggctcacacctgtaatcccagcactttggaaggccgagttgggtagaccacctgaggtcaggagttcgagaccagcctggccaacacggcaaaaccccatctctactaaaaccacaaaaaaaaaattagccaggcgtggtggtgcacacctgtaatcccagttactcgggagcctgcagcaggggaattgtttgaactcgggaggcggaggttgcagtgagccaagatccagccactgcactccagcctggacaacagagggagactccatttcaaaaaaaaaaaaaaaaaaaatggacttatgcccagtgattagagacaaggcccttcactttctccgtgccagcaccaacattccaaggggccctccatgtctgcctgaagaccatgccacccagagacaaggttataaggcaagagcatctttcttgtgtaaggtgggaaagggaagctgtgccaaggaaggaaagaaagtagggctggcttccccggcattctcaggcacagcagttatagggaagagaacgtatggaagctgaggacctagaaactaattttctcaacactctctgtgcacctgtgtatggctcagaaaggacagtgtttttgacggaacagtggctccagtctaacagctactgactcagatggcctctggcaggctccacctccaggctagtttttccagatcgcagggctataaaaactgaagaaagaaaccaaaccctgatcaactaaaagggaaacccacatattacacgccttttgatatgggtaatacatctgcaatacacagcaccatgacatcttcatgcctgaaaaatggaatctgaactaatcaagactccaggtctaactctcagcttacaggaaatacaggggactgaggaacaagttaggcagcaccacgaggaagtaatcagccaacattctagagacaaatgacccagtttctccaacaaattactagcatgaaaaaaaaaatgaactgttaaaaaattaaagagacttaaaagatataacaagcaaatgcaatatagaaaccttgtttggaccccaattataacaaaacaatattagatgacacctttagaaagatgaagaaaatctgaatatggactggatgttagatcataaaaaggaattattaatttggtaggtataatggccatgtgattatgtttatttttaaaaagtcattcagttagacatgtgtgttgaatttacaggtggaattacatgtcatctgggattagcttttataaaatattctaacctcccaagaagttttggggaggacaggtgaactgagattagcaaaatgtcaataatgattgaagttgggagatgggtgtctgggatgcattacaggcttctatccacaatttttacatgtttaacaatgtctataatatgctgggttccataactcacgcctgtaatcccagcacttttggaggcctaggcaggtggatcacttgagcccaggagttcaagaccagcctgggcaacatggtgaaaccccatctctgcaaaaactcaaaaatcagccaggcacgttggcacatgcctgtagtcccagctacttgggaggctgagttgggaggatcacctgagtccagagaagttgaagctgcagtgaaccatgactgtgccactgtactctagcctgggtgacagggtaaggctctgtctcaaaaaaaaaaaaaaaaaaaaaaaaaaggcctataaaaaagatcttttaagggagaaggggaggaaaaagtatatttagttagagccaactatgtattaggctaggcctgtgctaggcccttaccaaataagatcttatttccctagtcctgaggcagctgtcaaataaacctcgattgctgtctaaagagaaatgggcatttgataagctgggaaataaatatggcaggtgataagagggaggtgttagtgcctgaggaacacagagatgcatctaggtcgcaaggggagggactgaagacagcccttggcagacacatgtcagaatcagtatgcctcaatttccatttctcctactacatgctacttacccctgcagcaaagccaagacttccatctaagatccgcctctgaaaatcaaaacaagatgtttcagtttccaagagacaataagatgatgtttcctgggacaagaagaaaccataaggcccaaaagagccacgcaaataaagactggccgactcctgagctcgtgagctactcagtttataccatgggccaagaaccacggggaaagtctttggttaactttccacccaccccatagccaatcagaagcgttctttcaagtggtgcttggcttgtcttggcccttgtgttgtctcttactcagctttccctgtgaattacaactgtaaacctttagtaagtagcctgtctacaagttgggaattactgagcgttggtgaggagcagaggagcaggtggaacaatcaaaaccctcacacaggccgggcacagtgctcacatgtgtaatcccagcactgtgggaggctgaggcgggcagatcacctgaggtcaggagttcaagaccagcctagccaacatgatgaaaccccatctctactaaaaatacaaaaaaaaataggctgggtgcaagggttcatgcctataatcccagcactttgcgaggccaaggcaggtggatcacctgaggtcaggaatctgaggtcagcctggctaacgtggtgaaactccatctctactaaaaatacaaaaattagtcaagcacggtaatgcatgcctgtaatcgcagctacttggctgagacaggagaatcccttgaactcgggaggcagacattgcagtgagccaagatcatgccattgcactctagcctaggcaacaagagcaaaactccgcctcaaaaaaaaaaaaaaaaaaaaccctcacacaatggcggtgcaaacgggtaccaccattttggcaaactatttggcagcaccgatgagaggtgaacactatgtgtgccactcctgagtaatcccatgacaggaatgcacttgtattcaacaaacccatgaagaaaaatgttcggcagtgctaagagcccaaaactagaaactacccaaactctcaccaacagtaggatggatatgttaactaggatacactcatacaacaggtaccataatggcgatgggaacgcacacacatactacagttacatcttacaaacagacagggacattaaagaaactggaaaacaagtagggtaaaatcagccagatgcagaacagtacgtactatatgattactccatctaaataaagcacagaaacagggaaaatatccgtgctgttagagatcacatgggagatgacccttggagtaaaggttggggatggtgagattggaagggagactgaaggctcctgattggaaggggctgtgaggtgaggagctggtactgttttgtttcttgatctgggctctagtttcatgagcacttgtggaaagttatcaagctgcatacttatattaggttggtgcaaacctaataaaatgcaccagcctaataaaatgtgcatttttccataagcatcttctatttcaatacagatttttttttttttgctatctatccatagatgaatggataaacaaaatgtggtatgtacatacaatggaatagtcttcagccttaaaaacaaaagaaattctggcacatgttataacgtggatgagctctatggacattctttgaagtgaaagaagccatgtggtctacagaacttttcaccttacaaaattaaaactcagctgggcatgatggtgcacacctgtaatcccagcagtctgggaggccgaggcaggcagatcacttgaggtcaggagctcaaaacctgcctgagcaacatagtgaaaccccatctccactacaaatacaaaaattagctgggcatggtggtgcacacccgtagtctcagctacttgggaggctgaggtgggacgatcacttgaacccaggaggtggaggttgcagtgagctgagatcatgccactgaaccccagcctgggtgacagggcaagactctagctcaaaaaaaataaaaaataaataaataaaacagcctggccggatggggttaccagcgaaaccccgtctctactaaaactacaaaaaaaattagctgagcgtggtggtgtatgcatgtaatcccagctactcgggaggctgaggcagaagaaccttttgaacctgggaagcagaggttgcagtgaaccaagatcacgccactgcactccagcctgggtgacagagcaagactctgtctaaagaaaaaaaaaacaaacaaaaacaaaaaaccctgaaactctgtactcattcaagaataacttatttctgccctcctctgtggcccctggcaatcaccattctacaatgtgtctctgtgaatttgacttatcttggcatcttatatacctaggttccagataaaccatgtttctggattgtgtgttttctgatttccagtctccaacccatcagctcccgggggcagtgcagcgcagcaagggaggtcgggattttattgttgaaatcaaggcctgctgtactggtctctaacacaagagtgcctgacttgtgaacttcctaaaggtgttttcatttccagatctccctcacaacatgttgaactagatcttaagtcacttattcatttgccgtttctacaatgtctcaggctaccgaggtgatcgatgcagggattgtgcattcatcaagatacccatggatggctccagggctgcggactgagggtgatctgggttggagaaaagaatgcaatttcaggtatatgaggtgagtgtgggttgtgcagaggtgtggggagggcatatgggtatgggtatgtgtgcaagtgtgggtatgtgggactataggtagagcgtgtagaaggggtgtaaggatggggttgtgggaggagggagagataggctgtggggccatgacagtgagtgagggcactgggagtaggatacaaggaagatgtaggagaaagaagtaagagtttgcagggggccagggacatgggtctgtctatattcatcccaaggggaaaggaaacaacctggagatgggttgaaaaaaaagggaacagatgccccttcttctcccaaggtctttccaaccatcccacccaactcaagtccacaggggaggacagttacacctgaaatctaatgttcttcggtcacgcatagtaccacttgctccaggcctgaaagaaattacatggcaggccaggcacggtggctcacacctgcaatcccagcactgtgggaggccgaggtgggtggatcatctgaggtcaggagtttgagaccagtggtgaaatcccacctctactaaaaatacaaaaattagccaggcgtggtggcacatgcctgtaatcccagctactctggaggctgaggcaggagaatcacttgaacccgggaggtggaggttgcagagagctgagatcctgccactgcacgccaggctgggcaacagagcaagattctgtctcaaaaaaaaaaagaaaaaagaaaaaagaaaagaaattacatggcaggtagaaattaggcagcgggctaacgaagcctcaataactgggcttctcacttcctattcccttcaagtcaggctgtcaagggtcaagaggggagatgatggtgcatgaaggtgtctacagcaagcagacatctgttctcccggcctggcagggagaaggtgagaaaataagaagacagcgaacaaaccccagtacacaatgcctgggggtgtggccaggggcactgaaaagtctacaaacctgctccatggagtgggacagtgcccctttaccaacgggctccccaccaacatccagaaccaaagcaaggcaactcacctgtccactagagaatacgaacacgagagctgccccagctgctgtcatcccccaggtgaagaaggtccccagcaaggcctggaacacagagctgtggccttggagcatgctggatacagctgtgcaagaggagcgagagggtcagccaccggtggtccgtttcagtgacaggcgcatattctgacgggtcctaacaccctgtgtgggagctggcctccctccaggttgaccgtatgcacccttccaccacgccatctgtgtccctcagccacccagcacacaggtcaggcttctctatccaggtcccccaggaactggaaatcgtcttaatctgaaagaaggcacagggagatgccaggggaatccacaaaaaaggctgcaacattgaaaagtggtttcaaagagaagcacaaagaatgtggtttattccagaagaagggggcataggagggtctgatgcagcctcccccacataatctgcctcttctaccgtctcttgcccaccatccgcactcagcctccaccaaagacaggtgactagctcaggtgatgtcaacacgcttccaatcttaatccccatcacatctgcaacagcgcacctgcccagccaaagggtaaactccaccaaccaacttttgatacccaccaacccccgactctccaatcccgttctccatcatgcctgcacgagcacccaactccagctcaactgaattatttatggcaccttccacaagccccagacaatcctgcctccaagtccctgttcatgcagttccctcctggaataccttccttgcacatttccagccatcagaacccggagcaccctctgcagcccacataatgccaacctcacgaccaaggcttttctggccttccccagccctgtcctagcatgcagctttggtcctctctcagtgtggctttgcctccatcttttacagccttagttgcttgaggacggggacggtgctttttcacatttggcacccctgtaaaatagggctttgtaacccctgaaaaatatgtgctggatggaaaagggccagcttacctgcacaggacagtcagcaaggacaagcaaaaggacccaggaatggaatgtcccctggtcaactcagcaccctgctgctgaagctgaagttacaccaccgcccaccaaggaaaggaagggaagtaccactccctctcatttcagtccagagaacctcctccagactttaacatgcttaaaattctggatctgagatgacaatcagatctctccctgtggaaagttacaaggcagagaaacccatttgttgaaaagccctgtgttctggtacacaaacactgggctcagggcctcatatcaaagcctcattcatctccctgatggtctgccagcacccagagggctggctggacacaaccacactgggctcagccctgccagttcccggtgctctgtgaggagccagcagccctgagcctgcagatcaagagctgaagacgctgcctcgattgaccctggaaggaaaccatggcagagtgtggacgcagcccttatgccaagcggctcagcaacacacccaggctcaaacctaggaagggtataggtccaggtgagcccaggtgagccctggctcagcccctgtgccagaaactctgagataaatagcatctatggaatcagactctagttcccgcactctaaacgaactgcaccaactgtgaaaactgtgaccacgccaattaaagaaaaaaaaaatcattttcaaaaaactactaccctttacatccgtcatcttgctaagccaccctaaaaagaggggttggtctttgtttttaaaccaagccatctggaccattacaccaatcatctattccgagttgctgtggacaaaatttcaaacagcatttacaaagaacagcacaaagggatcatcctcttagtacttatcatccaagacagggcataacaaaaacacctttctttcctgtatttgaatgtgcctcttgacagctacagaagagagcaaacaatttacatttgccaacaggccaaagtcaatgtggatcttgtgggctggtgaacagaacagagggagctcgtgggtgttcctggtggttagtgggatagggaaacacccgtctaagcctgtccccatgtatatctgagcaccctcctgagtaagaaaaagggacacagagggaagaccgaggccaccatcctttccatcccaacaggagcagcattgatcacgggcaatgcaagcccagtgcccctcggagaagtttcttctctatttgctgttttaaatcctcgctacaagggtggtcagagaaccagcagcactggtccggcttgggagctagttaggaatgcagaaactcaggtctcaccccagactttctgaatcagggtctgcattttgtggaattccatgggggattcttatgcacattaaactgtggaaagcaaaagattaaaactggtaaaacttggccaggcgcagtggctcatgcctgtaatcccagcaccttgggaggccaagacgggcagatcacctgaggtcaggagttcgagaccagcctggccaacacggtgaaaccccatctctactaaaaacacaaaaattacttgggcgtcgtggtgtgtgcctgtagtcccagtgcctgtagtcccagctactcgggaggctgaggcaggagtaatcgcttgaacccgggaggcggaggttgcagtgagccgagatcgcgccactgcactccagtccgggtgacagagcaaggctctgtctcaaaaaaaaataaaaataaataaataaataaaactggtaaaacttctacaataccaagagcttagaaaatgagttctcctgccccatgtgggattggcaagagcaaagaagagtcccaaaagaacagaaagttttctgcagagtctcaagagaagaaaaagtttctggcagagtcccaagagaacaagaagttttctctaaccggcagaccagtaacaactttaggacacagcatctccatcacagcttacacaatggggctcagaattcctcacgatggggatattaattccatcaaccctgattcgttagcagcagggagaatcattctctgaccgttccaacttttaacatgccaacagcctgtagacttgtacacacctgccacagcagcacatgggcattcccggctgattgatacaggtttgttttctttatttcctttctcccccttttaaacctgttgttccgcttccaagagtcagttcaagaggctggtgaagttgcagaagtggaaacagcactagggctgctgggccttagtggagctgcacacacatgccctaactccacgagggggaatccagcagaaggattcaggtctgggcggagaggactgtggaaaagttctctaatgcctcgctactcaaagcgtggtccgcggaccacccaacctgggaattagttagaaatgcacactgtcacgccccacccagacctgctgcaagttaaccagattcccagtcaagttccagaggtccagctaacagccagagcaagtgggaggggcctgggagcagctggatttgtagctgcctctgctcccaggaatcccgggtacccccacacaccgcctaggaagggacgaacgaagaggatttgggttaggactgtaaaaggaaggcatgtcattgccttccagatcaccctggagagggacatagccggggtccggggacttccttcccaccgcccctcaccctcccaccccgccccgacacctgccaaagcctccaatttctcctccaaacccctcctctctccaggcgtacccccttccaagctccaggtggctgcccttccaagtcccacactcttgtcctgatggcctccgaccccgggcctcgagcccaaccaaaggcaccgaaggagagaaaagccaactcactagggtgccctctccagcccccactgcacttccatcagcccccgctgccactctctcgccggctccactcccgcagtcacttcctgcttccctcccgcacacgt

SEQ ID NO: 1014 - DNA, 446769 bp, Homo sapiens; identical to SEQ ID NO: 1013

SEQ ID NO: 1015 - DNA, 90138 bp, Homo sapiens
caaacaaaactgactacaaccagtgtttattcttgatttgtcaccactcttttcatgtcttgttttcttccacatgttaaatatataataaccaaaactttactaacatacgaatgaagaaaacatgcgcagcatgtatgcatggcaggtagtgaggaaatctggccagctgactggttcctttaccaaggtttgcagagtaggttgtgtttgaacaccttctgtgggtctgtgtcatttccaagttgaagaatttcagccaaagagcaacatgtcacattgattaaagatggttaatgacacagaaacatttctgttaatactaagggaaaaggctgttcttttatttatttatttttcctgagtcctcacgtttttcttctctgacaaatgtttgaaattcagtgaaataccaaaggagtcaaggatgaaggggacacaggatggaatcagaaaaaacataaatggaatccaggcagttctatgagacaacactgatatatctccttgataaagaaaaaatgtacagaatatttaatgagtctgtcttgccccaaaagggaaaaacacaagtagctaagccatttgcagagaggaaaaatgtcatggaaaaatgaaaaatctctctaatgtctatagcacatgaaatatctaagtaggtgggtgcagtggttcatgcctgtattgggagaccaaggcaggcagatcacttgacgtcaggagttcaagaccagcctggccaaatggcgaaaccccgtctctattaaaaatacaaaaattagctgggcatggtggtgggtgcctgtaaacccagctacttaggaagctgaggcaggagaatcatgtgaacccaggaggcggaggttgcagtgagctgggatcacaccactgtactccagcctgggcgacagagcaagactccacctcaaaaaagaaatatttagcaaatattaaaggacaagagggaatatctgtttaaaaaattataatgcacgttagatgaaaagtaataggatgagatggttgttgctgaaatagcacttgctatataaattcaaacattccttttcaaattcagcttctcagaggtttgacttcagatgcttgagcactttcaacattatctttgcctttatccttctttatgcggataaacacaactgctaaaattatacctaaaagaaaaaacccagggtcaaataaatgggaccttttaaaatgtactgtcacattcagttataaagtagtattgtggtaggaaaaaaatgactcaacttcatttttgtatgtgattcaacaaaatttcactgtcctagtgaataagggactctagtcgttggccttcttggagaaatgagcttatcatttatcctgttgtatgtatgtatcaagtcccaaatcatagctgacttggtggctctcactggatctcgctgtaagaatataggacctaatgttccacactatggagtgtatatgtcccacactatagagtgtataagcacctgacaaagttcctgaactttatatatacttaatattgattctattcttcccctttcctagagaaaacaatccaattagcacaactagaaagctgttctctgacctgttcacctccctgaagctgattttcatcgtgtccataccaactatcgcatttccttgggcgccttcctcctggatcctgcctatgttgttgtgggaccctgggtagactacttaaccttcttggtttctcccacctgatacatcaaaattacactgtgcagctcagcactgattgtgtactgtcagagtccactatgaagaaggagttgttttaaggaaattaacctgctagtaagtttataggaggaatcatggcagaaaagtctggatgctcagaaacttataattccaaccctatcttgaaaataaggtcatgaaactgtaaaatcctattacttctatttctggatgtccccaaactcaagcagtctttaacttgtggtaagattatggaattaaattgatacgttaagaaaattgctatctgatttgtaaattcaaaaatcctttcaaggtgggagggcaaatagaataagaaaaggcacagaggcagaagggacctatgtaagtgagtgggacctcaaaaagacagctcaattaccatgaaaagtgtgcagtagatagtggttctcagggaggaaagatgatcaccatgcacacattaggatgggaagtggccatgacatgaaggccctcccatgccatagggagtccagactgaagggtataaagaagtgagaccccctttagatgcatgaatcagagtccagtgtgacacactggatcatgggagaaaagatcagatgctgagagaacaatcaataatacttagaataatcctagtccttcttttaaaagaaaaaggatatgaaaccataaaccccttcactcaggtacacatgaaataatgaagtatctattcctaatgtttaacttgtggtggggacaacagttgaaagagggcaattactatataggttgagtatccttaatctgaaaatctcaaatctgaaacttttggggtaccaacttgatgtcacaagcataaaattctacacctgacctcatgtgacaggttgcaggcaaaactttgtttcatacacaatattatttaaaatattgtatgaaataccttcagactacgtgtataaaatgtttatgaatcacgtgaattttgtgttgagacttgggtctcatccccaagatatctcatcgtgtatttgcaaatgttcaaaaatctggaaaaaacccaaaatctgaaacacttctgctctcaagcattttgggtaaggaaacacttggaataggcactgagttgtttgcaaaaaagaaaaagacagctagatcaggggactgtactgtctagccaagcaaggggctatggcagaggctgtggtcatgatgcaatgggttattctgggtagtaaagaatcagggttctatgcatagggaagttctgcactacacatttcagatatctcagcatcgccactggaaggctaacttctgcctgtaacaacaatggcaggtgagaccataaactctggtgtaggatctgtgtatgtcactctttccccatcaagcacagtgcctgacacatggcacagctactgcatttcttccctctttatcacaaaagctttgtaactaggcataatatatgacaattgatgaccataaagccccttatatttctaaactaataaggcaatagagacagagggtagtactaaagctgtaactccaatcaagaaagtctgatgtaatttgctggtgatctaccttctgggctattgcctgagttgccatttgagcagccaccagaccagtccaggaagacaggccctgagatgagctcacatttctgaggcccaggataagactctttgaattaagaaattacactcaccaatcaccagaagggtggtcagcagtataccaactgccatgcccacagtgggtatcccagtctggtgacctgctggccggaaacaacttccttccacacaactgcagaatgtaactgaaaagcaggacagtatttggtaggataaattctcaagtgaatagttgcagaatcccatatcaaagacaagaatctcctcaaacggcccatggtgacagatactagcctgagttgcctatagcagaatatctacctggtaaagaaacaatgccttccaagggtggccgacccccatcattgatgcggatcaagacgacatactccctctcctcaaactctgtgtgcctggtagacagtcgggcatgagtacctgccaggacaggaaaaaaaaatgaaaatacaacttcagaccctggattagcaggaataaagctcattttgtatcacatactaaggttgactggaacatggctagatatgagttaaactgcccaaagtatcatccacatcattccacatgtatcttcccataaggtaagaaagggctaaagcatcctttaagttcttaattcatgatttctctgtagaaatttatactaaatatagtcaattatcatttgtagcacttatgctctataaagttgccccaaacactgaattaatgaatgctgaaccattgctcctagaggaaagacagggttaggtttctgtgagcttctagtcatattttccccaactgatcaatacataaccttgctttttgtgtgttgctgttcaaagatatcttatttaacatatattgttcattctaacatttaactcacatctaacagcactagaacttcctgaacaaagcttatcaaacacacatatttaggttggtggaaaataattgcagttttggacattacttttaatttgtgtcccaaaccacaatttttccctgtaaggcacacatcacagccttcctgtgcttaggaattctagatagcacttcagcactatagttcaaagccatttttttttttatcatgggtcatcttttaggtttgaccctgtgtggttttttttaatactttgtgcacatgtaccctagaacttaatgtgcaggtttgatacgtaggtatacatgtgtcatgttgatttgctgtactcatcaactcgtcatttacattaggtatttctcctaatgctatcctcccccagacccccaccccctgacaggctctggtgtgtgatgttccccgccctgtgaccaagtgttctcattgttcaattcccacctatgagtgagaacatgcagtgtttggtgttatgtccttgtgatagtttgctgagaatgatggtttccagcttcatccatgtccctgcaaaggacatggactcatccttttttatggctgcataatattccatggtgtatatgtgccacattttcttaatccagtctatcattgatggacattttggttggttccaagtctttgctcttgtgaatagtgccacaataaacatacgtgtgcacgtgtctttatagtagcatggtttataatcctttgggtatatacccagtaatggaattgctgggtcaaatggtctttcaggttctgtatccttgaggaatcaccacactgtcttccacaatggttgaactaatttacactcccaccaacagtgtaaaagtgttcctatttctccacatcctctcctgcaactgttgtttcctgactttttaatgatcacccttctaactggtgtgagatggtatctcattgtggttttgatttgcatttctctgatgaccagtgatgatcatgttgatgtgtctgttagctgcataaatgtcttttgagaagtgtctgttcatatctgttgcccactttttgatggggtcgtttttttcttgtaaatttgtttgagttctttgtagattctggatattagccctttgtcagatgggtagattgcagaaatgttcttccattctgtatgttgcctgttcactctgatggtagtttcttttgctgtgcagaagctctttagtttaattagatcccatttgtcaagtttgtcttttgttgccattgcttttggtgttttagtcatgaagtccttgcccacgcctgtcttctgaatggtattgcctcggttttcttctagggattttatggttttaggtctaacatttaagtctttaatccatcttgaattaatttttgtgtaaggtgtaaggaatggatccagtttcagctttctacatatgcctagccagttttcccagcaccatttattaaatagggaatcctttccccattgcttgtttttctccggtttgtcaaagatcacatgattgtacatgtgtggtgttatttctgaggtctctgttctgttccattggtctatatatctgttttggtaccagtaccatgctgttttggttactgtagccttgtagtatagtttgaagtcaggtagtgtgacacctccagcattgttctttttgcttaggattgtcttggcaatgcgggctcttttttggttccatatgaactttacagttttttctaattctgtgaagaaggtcattggtagcttgaaggggatggcattgaatctatgaattaccttgggcagtatggccattttcacgacattgattcttcctgtccacgagcatggaatgttcttccatttgtttgtgtcctccgttacttcgttgagcagtggtttatagttctccttgaagaggtccttcacatcccttgtaagttggattcctaggtattttattctctttgcagcaattgtgaatgggacttcactcatgttttggctctctttgttttggtgtataggaacgcttgtaatttttgcacattgattttgtaccctgagattttgctgaagttgcttatcagcttaaggagattttgggctgagacaatagggttttctaaatatacaatcatgtcatgtgcaaacagggacaatttgacttcctcttttcctaattgaataccctttatttctttctcttgcctgattgccctggccagaacttccaacactgtgttgaataggagtggtgagagagggcatccttgtcttctgccggttttcaaagagaagacttccagtttttacccattcaatatgatattggctgtgggtttatcataaatagctcttattattttgagatatgttccatcaatacctactttattgagagtttttagcatgaagggctgaattttgtcaaaggccttttctgcatctattgagataatcatgtgatttttgtcattggtttttcttatgtgatggattatgtttattgatttgtgtatgttgaaccagccttgcatcccagggatgaagccaacttgattgtgttggataagctttttgatgtgctgctggattcagtttgccagtattttactgaggattttcacatcgatgttcatcaaggatactggtctaaaattctctgtttttgttgtgtctctgccagactttggcatcaggatgaagctggcctcataaaatgagttagggaggattccctctttttctattgattgaaatagtttcagaaggaatgataccagctcttcttgtacctctggtagaattcagctgtgaatccatctgatcctggacttttttttgttggtaggctattaattattgcctcaatttcagagcctgttattggtctattcagagattcaacttcttcctggttcagtcttgggaagggtgtatgtgtccaggaatttatccatttcttctagattttctagtttatttgtgtagaggtgtttatagtattctctgattgtagtttgtatttctgtgggaccagtggtgatattccctttatcatttttttattgcgtctatttgattcttctctcttttcttctttattagtcttgctagcagtctatcaattttgttgatcttttcaaaaaaccagctcctggattcattgtttttttgaggggttttttgtgtctctatcatctccttcagttctgttctgatcttagttatttcctgccttctgctagcttttgaatgtgtttgctctttcttctctagttcttttcattgtgatgttagggtgtcaattttagatctttcctgctttctcatgtgggcatttaatgctataaatttccctctacacactgctttaaatgtgtcccagagattctggtacgttgtgtgtttgttctcattggtttcaaaaaacatctttattttctgccttcatttcgttatttatccagtagtcattcaggagcagcttgttcagtttccatgtagttgtgtggttttgagtgagtttttgtcctgagttctaatttgattgcactgtggtctgagagacagtttgttgtgatttctgttcttttacatttgctgaggagtgcttaacttccaattatatggtcaattttggcataagtgctatgtggcactgagaagaatgtatattctgttgatttggggtggagagttctgtagatgtctattaggtctgattggtgcagagctgagttcaagtcctggatatccttgttaaccttctgtctcattgatatgtctaatattgacagtggggtgttaaagtctcccatgattattgtgtgggagtctaagtctttgtaggtctctaaggacttgctttatgaatctgggtgctcctgtattaggtgcatatatatttaggatagttagctcttcttgttgaattgatccctttaccattatgtaatggcctcctttgtctcttttcatctttgttggtttaaagtctgttttatcagagactaggattgcgatccctgctttttttgctttccatttgcttggtagatcttcctccatccttttattttgagtctatgtgtttctctgcacgtgagatgggtctcccaacagcacactgatgggtcttgactctttatccaatttgccagtctgtgtcttttaattggggcatttagcccatttacatttaaggttaatattgttatgtgtgaatttgatcctgtcattatgatgttagctggttattttgcctgttaattgatatagtttcttcctagcatcgatggtctttacaatttggcatgtttttgcagtggctggtactggttgttcctttccatgtttagtgcttccttcaagagctcttgtaaggcaggcctggtggtgacaaaatctctcagcatttgcttgtctgtaaaggattttatttctccttcacttatgaagcttagtttggctggatatgaaattctgggttgtaaattcttttctttaagaacgttgaatattggcccccactctcttctggcttgtagggtttctgtagagagatccactgttagtctgatgggcttccctttgtgggtaacccgacctttctctctggctgcccttaacatttttcccttcatttcaaccttggtgaatctgacaattatgtgtcttggggttgctcttctcgaggagtatctttgtggtggtctctgtatttcctgaatttgaatgttggcctgccttgctagattggggaagttctcctggataatatcctgaagagtgttttccaacttggtttcattctccccgtcactttcaggtacaccaattagacatagatttggtcttttcacatagtcccatatttcttggaggctttgtttctttttactctttttttctccttgctttatttcattaatttgatcttcaatcactgatacactttcttccacttgattgaatcagctactgaagcttgtgcatgcatcacgaagttctcctgccatggttttcagctctatcaggtcatttaaggtcttctctacactgtttattctagttagccattcatctaaccctttttcaaggtttttagcttccttgcgttgggttcaaatgtgctcctttagctcagagaagtttgttattaccaaccttctgaagcctgcttctgtcaactcgtcaaagtcattctccatccagctttgttccgttgctggcaaggagctgcaatcctttggaggagaagaggcattctggtttttagaattttcagcttttctgctctggtttctctccacctttggtctttgatgttggtgacctacagttggggttttggtgtagatgtcctttttgctgatgttgatgctattcctttctgtttgttagttttccttctaacaggtccctcagctgcaggtctgttggagtttgctggaggtccactccagaccctgtttgcctgggtatcaccagtggaggctgcagaacagcaaatattgcagaacagcaaatattgctgcctgatccttcctctgggagctttgtcccagagtgctacccacctatatgaagtatcagtcagcccctactgggaggtgtctcccaattaggctacatgggggtttgggacccacttgaggaggcagtgtgtctgttctcagaggtgaaatgtcatgctgggagaaccgctgctctctccagagctgtcagacagggatgtttaagtctgcagaagttatctgctaccttttgttcagctatgccctgtccatagaaatggagtctatagaggcagtaggccttgttgagctgctgtagcctccaccccatttgagcttcccagccgctttacctactgaagcctcagcaatggtggatgcccctctcctagccaggctgccaccttgcaatttgatctcagactgctgtgctaacagtgaacaaggctctgtgggcacgggacctgccaagccaggcacgggagagaatctccttctctgccagttgctaagatcttggaaaaagtgcagtatttgggtgggagtgtcctgtttttccaggtacagtctgtcatggcttcccttgactaggaaagggaaatcacctcacccttgtgcttcctaggtgaggcgacaccccacccagttcagagccattttaaacaatgaaatcaccaatgaaaagcacagaaacgtgaaaaacagcgcactacataaactgcaaaaagtaaaaaaaaacctaactaacttaacaatgtgagagctgggaatatgtgtgtccagtatttttcaccaccctgccagtgtccatgaaagcaaaagcgaaagctcctgtaagtactgacttttgggttacaaattttatcatgtagattattttataaacacaatctgcaaataatggggatcgactgtatgtgtcagaagattggagagtacctgggactgagcttctgtagacctgattctgggtttcaaatctgctgcttgttagctatgtaattgggtaagtcataacatttataggcctcaaaatccctctgagtccagaaataagggtatgcatgatattatacctggttttcagggcatttaccaccttttttaaaatagaaaattgagagtacaaaaacactaaacttcaaatttctaaacaaaaatttgattttgctacaattcacacttatgccctccctattcatatctgccaagaaattttcccaaatttgggaagatttaaatatgcatatttaaaaattattatggcccacctagataagatatagtaacagggaccagagttaccattccaccaaaaacaactaaaagaacaaaaaatatgtgaaaccatgggtttaaagatttatatattaggcaatggacagtgatttctgaaagaaggaaagcaaatgaggtaaattttataattgcctcagcttaccacccaaagcaaatatccaggtatcagttgcagggagcaggagctcagacagagcccagtgatgtccctgagttgaggtgatggagcacaggagtaaggcaaagttaagaaactagagtttacagagcagagtcccagagagagctgcaaagagaatgcacactaaagagatttatagaggggtctcttaaggctttagctgagtactgatcagtgtatttatatgaaggaactactcaaggctggggaaagaaccacctaaaaagattagagaacacagcgctcacaaagagccaggaatcattcctggtccctagagctaaaaatctcataattcatgtgctaccaggtagaatacatagaaggcttcacctcacaagtttgaaaacattagccctagaataaatgctgccctggccctatctaagaaaatttaaaagcaacacatgaaagcatcaaactttttccaaatgatctaactgtatttcacaataaagttcaagaatatttatgggaatacaaaatattcagcatctaaatgtctggcatttaataaaaaattgccagacattcagtaaaagagaaaaatatgacctatgagagaaaagatcaattgacgcctacccagaaattatacatattacataaatagtgggaaaagacatgaaaacagttataattatattctatatgttcaagaagctacaagactgagaagtgtagatagatacagaacattttaaaaacccaagttaatttatagaagaaaactacaaagtttgatataaaaatagactaggttggatgaatggctataatatagccattgaatatagcaggaaaaaacagtaaacttgaagatatagaaataaagctatccaaaaagaaatagaaaaaaaataagctttgagacaacttcaagtggcctaatacatgtgtaatcgaattcctgaaagccaagaaagatagtggagagaaaaacatttttgataagacaatggctaatattttttccatgttagatgaaaactccaaatcctcagatccaagatgatcatcaaacttcaggaataagaaaaatgaataaaatgccatcaaggcaatatgaacatcaaattacttaaaagtaataagagaatatcttaaaagcacccagagaaaaaagaatacaaacattcaatggaacaaggaagaaccatagtgggcagggcacccccggtggctcatgcctataatcccagcactttgggaggctggggcaggcagattacttgaagccaggagtttgagaccagtctggccaacatggaaaaaccctgtctctactaaaaatacaaaaagtagctgggcatcatggtgtgcacctgtaatcccagctactagggagactgaggcacaagaatcatttgaacctgggaggctgagattgtgccactgcactccagcctgggcaacagagtaagactgtctccaaaaaataaaaaataaataaaaaaaaagggggggtggtgaaataccttcaaagtactgaaagaaaaaatgtctaaataaatttaaaagtattctagtcatgttttctggttatgatgtaattaaattagaagttagaaaggtataaggtataggaaatattcccagaatatttggaaactaaataacacacttctaaataacacataatcacaaaagaaatctaaagggaaaacacaatgtatcaaattttgtgggcctggcatggtggttcacacctgtaatcccagcattttgggaggctgaggtgggaggctcacttgaacccaggagtttgagacaagccagagcaacatagtgtgacccccatctctacaaaaaatttaaaaataaaaaattagccaagtgtggtagctcatacgtgtagtcccagctacttgggaggctgaagcaggaggatcgtctgagcccaggaattcaaggctgcagtaagccatgatcacaccactgcactgcagcctgggtgactgaggccctgtctattaaaaaaaaaatgcagctaatgtgacacctaagataaatttatagctctaaatgcctgtttaacaaaaagatctcaaattaatggcatcagcttccaccttaatgaaaacagaacacgaacaaaaacacagtgtaggaagaataaaggaaacaataaagatctagccagtgaaatataaaacaaaaacagaaaaaaaatcaatgaaaccaaaagctggttctttgaaaatatcaataaaacttctagccagattatcaggaaaaaagataatttgccaatatcagaatgaggtgatatcactacatattctacagatattaataaaatatgaactatatcaatacattagattaatgaaatagatgaattatttgaaaggtacaagctcaaccaaaaagaaatatataaattgaatttttctatatctataaaattgaatttgtagttaaaacttcttaaaaagaaaatacaccaggcccagatagctttactggcaaattctttcaaactttaagaagaagtaataccaattttatgcaaacttgtccagataattgaagataaagaggtggaatgcttcctcattatacaaggcaaaatatagagagagaccaacatccctcatgaatatagatgcaaaaattaagttttagcaaatccaacaatacataaacatggtaatatttcatcactaagtaggctttatcccaggaataaggtgatttttagattcaaaagttgataataatgcatcaattaataggcccaaaaaatcaaatcagccacatagtcaatacatggagaaaaagcacttgaaaaatttaatatccatttccaatttaggaaaaaaaaaaccctcacaaataggaataaaaggcaaagtcctaaatctaataaagacgacctacaataaaaaacctacagctaacatcatatttaatggtgaaaggctaaatgctttcttcctaagatcatgaacaagtcaagtatttctgctcttactacctctatttgacatttcactgaaggtttcagccagtaataaacaaaaggcatacagactgaaaaggaagaagtcattattcacagacaacatgattgtctatgtagaaaatctatgaaatctaaataaggtcagcaagcctctagaatacagatcagtatacagaaatcattatattcctatatctagaaatatttagaaattgaaatatttaaaatatcaaaaatatgaaatgcttagggaaaattttgtaagaactatacactgaaaactaaaacacattgctgaacgaaattaaagagctaaataaatggagacatataccatgttcatgaattggaagacttaatatatcaattctcctccagattccccagtagattcaatacaatctcaacaggatttttttggtagaaaggaacaggctacattctaaaatttatacagaaatgaaaaagacatagaatgaaggaattttgaaaaagaacaaagtcggaaaaattaatctacctgatttcaagccttatacagctacagcaatcaagacaatgtgttattggtataaaaatagaaacagattgatgaaacagaaaaattcagaaatagatttatgtataggtggtcacttgatttttgccaaagttgttaagataattcaatgtaaaaaaaggatgttttaaacaaatggtgttagaacagttagatagctatgttaaaaacaataaactttggtctttaccacaccccctatgcaagcatatctcagcgatatgggtttggttccagaccactgcaataaagcaaatagctcagtgaagcaagtcacacagattttttgtttttctactgaaataacagcttatactatactctagactgttaatagcattatacctaaaaataaaaaacccctaaatgtccataccttaatttaaaagtactttgttgccaaaaaatgctaatgattatctgacccttcaatgagtcataatctttttgctgcaaatcatttcctgtctcaatgttggtggttgctgaaggctgggatggctgtggcaatttctgaaaataagacaacaatgaagtttgttgcacttattgactcttcctttcatgagagagccctctgtatagcatgtgatgctggttgatggcattttacccacaagacaacatctctcaaaaattggagtaagtcttctcaaacactgccactgttttatcaactatgtttatggaatattctaaatccttgcttgttatttcaacaatgttcatggcatcttcaccagaagcagattccattgttcaaaaacaaacaaacaaacaaaacacattgttcagttgtaagaagcaactctcattcattccagtttgatcatgagagtgcagcaattcagttacatcatcaaggctccacttctaattcgagctctattgttattttcaccacgttttcagtgattcctccactgaagtcttgaacccctcaaagtcatccatgagggttggaatcaatttcttccaaactcctactaatgtgtatatttcaacctcctcccatgaatcacaaatgttcttgatgatatctaaactggtgaatcatttccagaaggttttcaatttactttgcccagatccatcagaggaattactatctaatagcagctataacctgatgaaatgtatatcttaaataatttgaaagtcagaattactccttgatctggggcctgcagaatggatgctgtgttagcaggcatgaaaacaacattcatttccttgtacatctccaccagagctcttgagtaaccaggtgcattgtcaatgagcagtaatatgttgagaggaatcttttttgggggacagtaggtctcaacagtggccttaaagtattcagtaaactatgctgtaaacagatgtgctgtcatctgggctttgttgttccattgacagagcacagacaaagtagatttagcataattcttaaggaccctagtattttaggaatgctaaattagggttggctttaacttaaagtcaccagctgcattagccctaacaagagccagcctgtcctttgaggctttgaagccaggcatttacttctctagctatggatgtctaagatggcattgtctcccaaaagaaggctgtttcatctacattgaaaagtttgtttagtgtagccactttcattaaggatctcagatcttctggattacttgcttctgcatcaatttgctgcatcactttgcactttgttatggaaatagcttctttccttaaacatcataaatcaacctctgctagcttcaaacttattctgcagtttcctcacctctgtcagcctttacagaattgaagagttaaggccttgttctaggttagattttggtttaaaggactattgttgctgttttaatcttctatccagaccactcaaactttctcccttaatggcaataaggctattttgcttttttattatttgtgttcactgtaggttcacttttaatttccctcaataacttttgccttcacaacttggctaagcatttcatgcaagaggcctagtttttggccaatcttggctatcaacataacatcctcactaagctaaatcacgtctaacttttgatttaaagtgagagatgtgtgactcttcctttcacctgaacacttacatgccattttaaggttattaattggcctaatttcaatattgtgtctcaggcaatagggaggcccaaggagagagagagacatggggaaacagccagtctgtggagcgtcagaacgtacgtcgacgtcgcactgacagattaagtttgtcgtcttatgtgagtatggctccgggtgtcccaaaataattataataataacatcaaagatcactgatcagcataacagatataataatgaaaaagtttaagaattacctaaatgtgacagacatacaaagtgagcacatgctgttggaaaaatggcaccaagagactttgttgccacaaaccttcattttataaaaaaatggaagatccattgggcacgataaagcaaagtgcaataagatgaggtatgcctatacaaaaattaccttaaaaaggcatagagctaaatgcaaaagctaaaactataaaatttgggaaatgaaaaaaacagaaaactttagggaccctaagtttggcaaaaatttaagcatcacaacatacaaatcatgaataaaacatgaaaaaaatagataccaaaatttttaaatttgctctttaaaagacttgcaaaatgaaaagacaagccatggcctgggagaaaatatttacaaaagatatatatctaacaaagcacatcatctatgtatattaaaaatgcttgcaactcagcaatagaatccaaacagcctaatttttaaaaaatgaatatctaacaagacacttcaccagtgaagatggatggcaaattgcatatgaaaagatgctcaacaccgctagtcattagagaaatacaaataaaaccattatgagatactactccactcccactggaatggctaaaattaaagaggctgagcacagcaagtgctgggagaatgctgagcaactggacctctcacacactggtgggaatgtaaaatgttaagaacaatttggaaagtagttcaacctttccttaacaactgaatcatataactcccatatgacccagccattccactcctcagtatttaaccaagaaaactgcaaatctttgtccctacaaaatatttgttcacaaatcctcacagcagctttgtaatagcaaaagttggagttacaatcaacaggtgaacaggtatagtcattcaatggaatactacccctcaataatcaggaatgaagtactgatgcatgtaacaacaccgatacatctcaaaatactgagatgaaagaagccagaccaaaaaaaatatacatactatactattctatttagatgaaattattgaaaatgaaaactatagtaatggaaagcacttcaatggttgcctggggagaggggatgggtgggaagcagagattataatagggcatgaaatatcttctggaggtggtggaaatgttcattgtcttgattgtgctgatggcttcagtggtatttacatgtaatcaattctcataaaattgtatactttgaatatatatatctatctcaaagttttaaaaaatttctataaaatctgctttccatctgtcattgaaaattttgcaaatgatgcttaggtcatccaactgttcatctacaccaagagaatgctgtgtggtcataatctttcctcccttgaaatcctggggctttttcccctctggagtccttccctgtacaagcttccaaagcatgaacttccttcctgaagcatgaaagaaagctctttgctgagtacagcaaacccaccaagttaaataaaacctactttcatcatccatctatgtttttttccatgtatttctgacaactcaccattgattttggaaacttcccagtcgttttgtaagcttccactgccgagggaaaatgtaaaatggggaccccgaaataagtgctgatcatcatcagtagcctcgaaaatgagacttccaggtgcactgaggggatggcagaagaacaagcccgtgtagtccttggctagcctgggagggttgtcattcacatccataaggatcaggtggaactctgacacagagctcaaggaagacccccctaaggaattgaatgattgaaacatgggatcagttcactcattttcctcttaataagaaagatttccctttctttaaaattcaaggagttaggtacactgagatgctagaaagacgacaagcttttagaatcaaagacctagtttcattactggtgaaaaagtcttactgaccatcataataataactaagagatatgtgctaatattttacatatattacttcaaaataattgtgaaaactgagctcagaagttgtgtaacttgcccaaggcagagaggttttcaatccaagaggtctaactctagcactcacaccttcacttgctctttagcaggccttaggcatgttagtagagttttctaagcttattttcttcagctgtgtggctttgcaagaatcccacatatgagtgaatgttctggaaaatagtaaaaggctccacagacattatttactatatgataggagtaaaaaacttggatctgcagcataactggttggtagctatgtaatcttgggcaagttacttaatttctcagtgctttggtttccttgttcacagtatgtggtcaataatagcacctacgttatagtgttgtatgaggagtaagttattacactaagtgctcagtatggggctgtcagtgcaacataaacactgactgttatcatgtcctcctcaacaccaatcacagacattgtttctacaacttctgactctgaccttgtttgattccagtaatgttttcttgctcatttctagtaaaccctgttttcttgattttcttctcaacatcgtctatgtccatggctatacttaaccaaagaagaaaaggccactgtgttctcgaagttattgtatctatttatatcatgtcagtgccagaaactaaaaacagaacagggttttggaccctggttttgatttctgaaacttctagaatgtgagaaactcttgggacacatccagagtgaagttctgatccccatggtatgagaaaggggtgtgcacagcataaaggctcagccagaacctgcctgctgcttcactgggaggttttaaatcaagagttaaatgtatacaatgtgatagtggaatgtgctgcactcaagcaagagacagaagcagagggcctgtccattcacacacacccctcccaagctggcacaccgttctgcattctaccctttttggtttgacttgactgaagtaattttgtttttcttaatctttccacatgcaggggccgtttttatgattcctgtctctcttctccaattcagctctcaaccctggccctcacattttgaaagtttttttccggggctgtggtgggggagtctaaaaacatatttattgagtaatttgtttaattctcttttttggtaaacctgccagatacatttactagctaattagagactggtcaacattggatcaacagatttcctacttgtatgtctgaaaattccatgaaaatgcaaagaaactcttttttagttgccaggcttattattgggtaaacatactattcctatgtgtttatttttattttaaaaaagttctctggaactccacagttggagccagcaggcaatatatatcagcacaactaaaataaataagatacaaagattacacaggaatggctcaaacatcctgggcttttctgtctttcctttcaaaagttcacctgatttcgtcaaaacacagataccccttgttcacccaaacctatggaatcagaaactccaggggtggactcctagtgttattcaacaagctccccggggattctcacacacatcaaagtagagaacatttcataaaacattttctgcttcaaaaaggatgagagttacaatttaaggctgaaggagcaagtggtggtctacgtgaacaggtcagtggtttgattccactcagagctcctgggggaaacccacaaccacattggaagaagggaggtagttcagccagggacacagaactctctagaagaggccatagcccctacaggaaaccacagagtgagcagcagccctgctgggggcacaggtgtttttcacctttaacaaaaccacaaaggggctgggcgtggtggctcacacctgtaatcccagcactttgggaggtggaggcaggcagatcacctgaggtcggaagtttgagaccaggctggccaacatggtgaaaccctgtctctactaaaaatacaaaaattagccaggcatggtggtgggtgcctgtaatcccagctactcggaaggctgaggtaggagaattgcttgaacccaggaggtggaggttgcagtgagtggagatcgcaccactgcactccagcctgggcaacagagcaagactccatctcaaaaaaaaaaaaaaaaaaaaaaaaaaaaggaagatatgagcactcccttatattttgtacccttctcatccttccactttaaggttgtgatattctggtgttttggccctgtcagttttcttatcctccctcccatttcaacccatgtatcttctgataatctgtgttcctttttttttgttttttttttttttttgcttacctacttctgtggccaccacttgtacccgatatggacttccggcttctctgtccaatggagccacactaaagatctcaccagtcacgtggtcaattttaagccaacctcttgtgtctcccctcagtgaatagcttcatcaaatgaaaagagcaaaagaaagcctgcattactttgcatgaaaatgtgaagctagtttgtgcgtcaactaaatatgtttgtgcatccttgaaatatgttgtaaataatatacaaatgataatgctgagattatcattatcagcattacttgtatattatttaaaacatatttaaaggatctattatctcatattattaatgctttatttgcatttcatctgtcttcaaaaggatttgttcatccttacaatgtggtgtttgtgcttgtattaggaagggtatagttcacaacttctggggaaagtagttaaacttttctggcaatcaaaaactcaaattaaagtaacctggaagtatcttttaaaacctcttagcaaaccacccacctagaaaatttgaacacccagtggtggaaacgttgggcgagatgggtggatactcatagaccctggtaacacagtgaattcctcatccaacaaacatctattgagtgctgaggaagatcaggcagtgggccaagggaagagatcacaaaaaggtgttcttaggcaagtgagatagacagataaacagttgattccaataaaatgtggtaaacacaacagagggggccctatggaatccaagagaagtttacaggaatcagcaaagtctttctgaagtagtagatgtttaaggcaagaagaagacgcttcaagtagaaggaagagtgtgagataaagcaccaagggccaaggaacagcatggtgagtgtggggtcaggcatttcagcagtgctggggtatacttgggaagcagaaggtggcaaaaggtgaagccacagagatttgaagagccagatcacaagaagcaatgggcagccagccaatgatttaagcaagaaggtgacctggccatatttgtgctttcaacggagctcattggtaggtgtttggaagatgaagttgagacagacaagactagaaccacaggaaaaccaatggtagtcctttaaaaagcaacacatcatagtcatgaggatgtccatatctttagaccaaataatttcactcctggaaatgctacctaaaaaaacccaatttaatcaaagtttaaaaagaattacatgcatacatctatttaaaacattttctataataaaaaatactggaagcaacctacatatcaaaggacaagagaatcattaaaaaagtatgatgtgttaatttcccacaatgtatttttttagtatattccatatgccaaacactgtgttaggttatatacatgggtaatgagtatgaaaccctttatacttgggatttcatcctgaaagagatggaatgctttggagggttttgaaagaggagtcagatgatctgattgacttttttaaaaggtcactgactgcaattcagtgagtagattcagagtggggtgggggacggcaggggcaaggacgaatccagaacagacatggtggtgccttggagcaggctggaagcagggagaagcaggtggattctgaatatatttcaataaaagaatctataatatttgctgaaggattggattcaaatccattgggtgctaacagattttaagtttgtggagctggagaattaaattactcagaccaacactggagtcatccttaattcttaacagacttattactcatgtctgaactattgattattccttactcctgaaacactttcttcatttgtcttctggaattgtaccttacagaacacctcttctcagtctcccttgctaacctcctcttcctgacctcaacttaatggtatatgtatcctttccttgtttcatcacagtaattttcttacatgcctttatttttcccactgataaactttttattcacgtctttgaccaatggtttttatagcattttcatgaagaagataggaacttttgttaaataaatggtataaagattaaaaacattttgtgtcttctcataatttttgacccagtagtatctacactaaaccatacagtatatcccctactgttctttcttctctgtaaaactacagaagtagttagagtaaaactgcaggtggtaactttgcttctcaatgatcagataaaggtcttagaagtgaatccaagtgcctgaaggacagctcaatgggaggcaagactccctccagatgtttagagaaacttaaggaattgtctgccattcatagccacacgcgtgatttaagtcatgctgaaatatttcctatgccatagacaggaggtgtaatgtacaacagcagcgaaagatctgagttcaagtcttaactacatgatcttaaagattttatagatattatacagatatatacaaacatatatttcttaagttaatcatcattgtactttttaaggcaaatctgtgtgggtcttactgaactgaaaaaaaggaattgctaagatggaaatatttacacattttgtttagccacctcagccagagcaccagcttctccaggggtgccctagatcagctctttggagccaaggaacctatgtatcctacatccagaagattccctcagccctgtaagttggcatggtctgtccaattgggctttggtctctgtctagaactccaatacacctttagggctggaaccctttcctaaaccctagcctagataacaggcttagacacagggcctggttattctagtctctcagaggtgaacctcacttcctgaaccatccagctctcagctgggacctgaagctcatgggctggaatggaacctcatgctgcttcccacttgtctgagcctagatggttattgatgaaccaccatcccttggaatgcccccagggtgttgacagcttcctaaaccaaagccaatttcatcattgctgggtatgctgtgagggtcagccctggagtcagtgcaggccagctcctcctcctccccattggctttggtgaccacgcagccaggcctgcccagcactgttgccctttaccttatgtccagaccttctggatccttggcagtcacattgcccactttagtgcctatagctacatcctcactgactttcgcttggaatacgtgttgggaaaattgaggtgcttcattcacatctgtcacaataagcgtgaacttggcaaaagaacttgcattgtacttcacaccaaacactagaggctcaggattttctgctttgaacacaatgttggaaacagctgctgtttcaaaatcaagaggctgtgtaggagaaagagagaaaattaattttggggtgattagctcccttaaaagattcattccctatccttcttaaactctcatatattcgatatataatattggaaaaactggatatccacatgtgggagaatgaaattagactatttcataccatatatgaaaatccgttaaaaatagattacagacaaaatataagacctgaaactataacaccactagaataaaacatagaagaaaactctgacattggtcttggcaatgatctttttttattattttttatttttgagatggagcctcatgctctgtcacccagccttgagccttgagtgcagtggcgcaatcttggctcactgcaagctccgcctcccaggtttgttcaagtgattctcctgcctcagtctcccaagtggctgggattataggcacccaccaccacacccagctaatttttgtatttttaatagagacagggtttcaccatgttggccaggctggtcacaaattccttacctcaagtgatctgcccaccttggcctcccaaagggctgggattacaggtatgagccaccatgcctggctggaatagaagtttatctgactctcagttctagaggctggaaagcctaagaacatggcaccagcatctgttgaggactttgtgctgtgttatcctatgacagaagggcaaaccatctcacgagatagaggaaactcacccttttatttttagtagagaagggggttttgccatgttggccaggctggtctcaaattcctgacctcaagtgacccacccacctcagcctcccaaaatgctgggattataggcgtgagccactatgcccagcctagcaatgatcttttaggtgtgaccccaaaaacacagactacaaaagcaaaaatagacaaatgggattgcatcaaactaagaagcttctacatagcaaaggaaacagtgaagcagcaacttacagatcaggagaaaatatttgcaaatacacattagaaaaaggattaatataaaaaatttataaggaactcaaacaactcagtagcaagaaaacaacctgtttaaaacctaggcaaaggacctgaatagtcatttctcaaaagaagacatacaaatagccaacaagtatatggaaaaaaatgctcattactaatcatcagagaaatgcaaattaaaaccccaatgagatattacctcacacctgttagaatgacttatcaaaaagacaaaaaacaaacattggtgaggatgtggagaaaagggaaccctgtacactgttggtaagaatgtaaattacaatagccattgtggaaaacagtatggaggaaactcaaacaattaaaaatagaactaccatacgatccagaaatcccactactgggtatataaagtcagtatgtcaaagagatatctgcactcctatgttccctgcagcatcattcacaatagccaagacatggaatcagcctaagtgtcgaacaacaaacaactggataaacaaaatgcagtatatatatgcatacatacacatacatacacacgcacacacatatatatatacacacacacaatgaaatactgttcagctttaaaaaggaaggaagttccatcatttgtgataacacggatgaacctagaagatattacggtaagtgaaataagccaggcatgaaaagacaaataccacatgttctcacttgtatgtggaatctaaaggtgttgaacttggagagtagaatgttggttaccaggagctggggcatgaggagattggggaggtgctggtaaaagcatgcaaaatttcagttagaaggaatgagtttaaaatatctattttacaacgtggtactatagttaacaacaatatagtgtatactttaaaatcacagaagagtagatcttaagtgttttcatcacaaaaaatgataagtgaggtaattcagatgctagttagctctaattagtcattctacaatgtatgtatatttcaaaacatgttgtcctcctatacaatttttgtcaattataaacaagacaaactttcatagcagtggttctcaatcgagtgtcagcaaaaaccttctcagaatgattacagagccatgaaagagtcttttctgcaggtcttaccagagcttgcactacgctaatatgtcttagaagaggaactggaacacggaagtcctcaaatttatttaactgtgggacacttcatttattcaacagaaatgtattgattctcccaagacattctcaggtgacagcttgagaaatgcttacatagagatttccattttttatgggaaatgattttccaagggcctcaaaactcaagcccccaaatcaaagattttaaactcatggaggatgggaaagggaaacagagatgacagatgatctgctgaggacatgccagatggaaccaggaatgaacatcaagaaaccaattttggtttaatatgaggcagaatttaacagggctacccaagagtactccccctcttcaggagtgggcttactgctgtcttctccgtgtcggcttcctgatccctacattccatcctcaaactgacaagctgcacatcctgtgcagtctcatagcacctaatagatctaagtgttgatgtattttagatcttcactgaccctaagctccatgagaagaagaactgcatcatattcatctttgcttctcatctcttccctgacacatagtgcccacagtgggctggtcaggaactacaaagaccaggaaggcctggtccttgagggcctccatggagaggagattctggagaacatccccaccttccagaatcccctttcccgcatgcatgcaccaacacacaccatcatgactcactctctagttcataagtgctgtgggacaatttttcacgtagaagggtgggaactgtgtgtgaagactcggggttgagaaagaagaatcaattgaaatttgttcaaatatataagagataaaatcatgtaagccagctaagtgtgaaaaaagaggttgttcatagtgataagcacccactgtctgcagggcctggccctcgtcgacctcgtgacgtggtccaatacacgtcacgtggtccacggttcaattagggcttctccccctgaagtagaggtggggagaacaagctggagtttctcactcacaggacccactcccagtctcaggggatgacagaactgtccagttgagataaaagcctagtagaccaagcaggaaggcagcagcccccagaatgagcctgtgatggggacaaaggacacagctctctgttcctatccagtccagcaaagtccgggcccaggcaggcagcacagttgtccatatgctcagacagagcacatgcatccatcctcaccaccaagcaggtcctaagcaccctccctggcttttcctcatcccatcactgtggccccagaggcaatggtttaaagaaatgagacactgtgtgtgcaaatgagaagcagcctgtattaccagaagagaacgtgcaaggctgacagtggaaagacaagactgtacggcgagctgaggagttggaacttcatccttgactaacaaggtcagatgtgtgtcttagaaagataactccaggagcagctacatgggggatggattcgaggtgatccacactggggcgggaagactagctagaaggcagtgtcagtgttccctaaacactggatggaagaacaaatgaaaagcagcagcctgccattgaggattctatccgcataacttccacacctggaaaaacatcaaaccaaatcttctggagaaatcattataaacggaagatgctaaattagcacatggtaataagcagagctgagccaagaacaagccttgtccggccacgtgcattgtgtttcatgacctggggatatgactgtgaggccaagtcaagagacccgtcactgcctcttggaatggcctcagtcccatctggcaagacatattcaagttaactgaaaaaacctgctcataccacgattccttttgtgcacaaaaccgcctgaaaggtcaaacctagagatttagattcaacctggaggcaaagaaaatgctgaaggagaggggttgagactgggatatttacaattttcactagcgatcactgatgatatcaaagtgtgcacattagttttccagatgacatttggtctggttaaaaatagctagtgaactgagaattcaaaaggatcagccatagtagagaagtgacaaaatttgcaagttaaaataaggcagaaccctgaatttcaagaaacaggatctcaggagagttattgttgagccaggcagggctcaaagaaatagctttcctgctcatgacacacgtttggccccaagagcatgataaccaagcacacgagaggctggagcttgggcagaagtaaatacagagcagggagcatttctgacagttgtttaatctgaaggattgctttgggcacttgccaaaattactcatttccaggctttccccttgagaggctgaggccgcagtcctcagtatgcaccatctgactcttgaattaggcaagtttggcccccttaggcaacaggggaaagcatacctgtccgcaggtagaatcctagctctaattaattagaatcaagtgatgccacgtgtttaagtctgcaagctgctggatgctgtgttaggaactatacacatacttttgcatttaattcttcaacatccttactagaaaggtgctaccattttacccatttttacagattggaaaactggggcctgagaggttacatcatttggtcaaggccacaagctagtaagtggcaacaccaggactcacagaaattatttcctgagaggaggtggaggcctggagtcaagttcccggctctgccatcaccagaaggcctgactgtaccttgctgtgggcctgaatttctgcctccctcagaatcagtgggagaagcaagagagtttatgcaaacaaactatagttgccacgtatgagtccctcagtgaattttacctgtgattagcacatttgtaattcagatgaactgttaatgatataattgtgattaacaaacttaaacttttaaaaattattaacacagtggttcagaacagtggtagtcccttgatggcttaataggcaaggacttagaagacaaagccatacataaaaaaccaaattatatagtctataaaacacttcaataacaaatagtatggctacatacatttgttatatttttattctatatcctagtggggaattggctaacatttggtgtgtcctaatcaagaatccacagcccagggttggttgttgcttagcatctgaaagaacctaatccgagatctatatcccagaggtagctatgatagtccttcagccaacactatctcaattagaactagaaagtttgttaattagcaaagtgatcttacaaataaattttcttggtgatatgagtggtgtccaagatatgcactttgggccatgcacagtggctcaaacacctgtgatcccagcaatttgggaggctgaggcaggtggatcacttgagcccaggagttcaagaccagcctgggcaacataaggagacccccatctctacaaaaataaaaaattagctgggtgtggtggcacacacctgtggtcccagctacttaggaggctgaggtgggaggattgctctagcccaagaggttgaggctgcaatgagctatgactgcggcactgcatctgtctcaaaaaaagatgtgctgtttggttacgagtatagtgtatcccttagtcattgtgaacaggagtatagatatctggcctggccagcagattgtaccctgcagagttccagggctcagttctgttctgccagttatcacctgcctctggatggttgaacaaatccacttgctcaaggacagttatcacagtgcccaagggacagagagctgggatgtcacaggcctaaagcacaggttcgatgatcacttatgtgtctgcttgttcataattgtatatgggacagaattcatttattcattaagtcaagcaatatttattgaacctctaatatatgccaggagacataatagacacttgaaatagaaccacatataaagtaaggatgtgacaaagagtttggtcagaggcctactctactgtagcatacctctcgtgtcaagttgtgagggaggatacttacagctctcacccacagctaatcattgagataggtgccaacatctccctaaaagggcccattaaccacaaatggccaagttaaactgctgttcaaaaaaatatgacatacgggccttgttcatactgggatggatgggcctctatcttcccttagattcctagagagctctggtcctgcaaaaggataaaaggaagctgcccccgtcacctgcaaaggaacacaccaacccactgcaagctctgaaaactgccctttcctttatcctttctttctgtggtattctctctccatgcagactgctgtgagcacaaggggaggttgtcatggtaccttttccaaatgtcagactcacacacaaggctaaggctttgagctggtccacagcaacctctctgctgaaatgcagcagggcccttggttcaagctggaatgtttggtaacagtaggatcacaattccaaggctctgtcctagggcttgcttcagcactagtgcttttttctctgtgcttctgtccattttctgtgaaattattctattttgtcttcatttttagcctctttcagttttcttttattctggctcaaaactgtactccagagctttcctttgcagcttccagcacactgcactgcaaaccttaaacaattagccacccttgcagattctctctggccctttttaacagcgaggtttcactctctttcctaggaaagtatcttaactgtaagtacattggacggcattgagtgctgcttccaattgagtcatctggtaaacccatgacatgctctaaacacagatgaggcagccacagagaaaagagtcaagattcaggtatacatggcaggggacaggagtagattgagggagggttgggagaatcctgtacaaagagacaggaaccaaggtaattaagactttgactccagattatccagtccttacagagggagagacagaatgagagcccgtgggcttagcaatacagtaaaaggtgaaagtaaagcagcggagagggggattaaaaagacacttgtctattaaaccttggaaggagacccagcagttgcattattcaaaaggtatctctgcctggcacattagaataaagggtttacagcctaaaaggcccatggggtcatccaacccaactcctcacatttgcaaagggggaagtgaaagcgagaccctgagtgccactcccagaccgtaagagtgttgcgagatttagcaaatagcaaataaaaacatagaacaccaagttcgatttgaagttcagataaatgacaaacaagtttttagtataagtgcatcccaaatattgcatagaacacacttatactaaaaaattgttcatcctgcattttatatattttatatgacgttacctccctgcaaaagttacttggctagctagcaacagagccaggtctagaatcctgacttcccgtctgtcaggaagacaggaacgactaagaggaatccaggaatccaggaacccatcaccatgcctgagagatggctgctaatacatcacctctgcttataggtcttcacactgtcattagtaaattaacccacaaacaaagacaaattctattaaataaatgggctatttacctttttaattatgacatatccggtgttggtatggggatctgtgtcaacccccaggcgtccctcactgtctccctttatgatatgatacagaattttagaactcccagtaaatggctcatcagcatcagtggcctggatggttaagatggtggacccaatgtttgtgtcttcagcaagagtcaggtttccatactaaggagaaaatggagaaggaaacaatgagaaggtctgctgtcatcaaagccaaaggacaaacttatctctctggtttcagaatagacacaagtcatagtttgcatcaatcttcatggggcatgttttttcctattgatgaatatattgcagttgattttaacatcagtcatactcatgagctgatatccattgtaccaaagaacgcaatacctcagagagctactggtaggattctaaaacaaattccccctcccatatccaatttgtttaataacttaattattgtagtagtaatgatataaatagccaccatgtattgagtatctatcaggtggtaggcactttatatacattatttaattaattcttaaatcaaccaatgaatagaggttgattaaaagcttgaactttggagttaaacagcctgaatatgaattgtaggcttgcttcttattagttgagtggcttgaagcaagttacttcacttctttaagtgtcagtttcatcatctgtccaatggagacaatagtaatagaacctacttcatgtttgctgtgggtgttaagggagacaatgcatgtaaagctcctaaattcttggcacatagtaagtgctcaataaagaaaatcaacaaaacaccttacggagtagttatgttaccatctccacttacgaggagcaaaggcttggagaagtaaaacccaccaagggtcacacagctagtgggtcaaagggattgggattcaaagccatgtttgtgcaactccaaagcctatgctcttgaacactggcctagaccatctcccactccactgaaaatcccccagattatctctcttggcatcatgatcctaaagaaggttataagtaggtctcagaagagaggaccacagcattgaaacaagcaggttcactctctgtagccagattagtatttaagctctgagacctcaagtgcaggattcttaccctcaatctaaaaaacactgtctcgataaaaggcgaggaggtcacaaagttaggaaaggatcaaaagcccaagagaatggaggctgagaagaaatgggttatttgatgcctgctgaacctcagtgcctgttatacaagacatatccactcacacctcttcccacccctagccccctcataaatcaattcccttctttgttgcaggcttgtccctattttgatttatgaacatcatcacagggctctgggctgcctcataactgacttcaaaaataacataacagtctagtcaaataggcttcttgctccttcaaaatagagacttccctccttagggaaacaatgataaagtcatcaccaagtctgaacgccctatcgatgacaagaaaacagtaatttgcatttttcttgaggttctaaattgacttttttctttctgtccagttctaattctctcaaatgtcttgggcacatttttctttggcttaagtcagagattaatttttttcttctccctttctcttacccaattattacaaattaaatcgccaatattccaaatattaaatttttggctaaaaatgcttgagacctagcagtaaatctatttattgtcctaacacaaaaaaatatataatgacaaactgtaagccgccattcaccttttttcaatttgacaaagattgtggttgttgtttttaagcagcccttggaataaatgagctattggcaggagtttataaatgaatgttcccagacacctgtaatagtaaatgttattgttccccaaaaagttccactgaagatggcatctgggttatttgtgcactgaccaaggttacctgttaagtctggcacttttcctagctactgtctgtgtctctatcccagaagaaagggtgaagtaaaatgaataaagtaaagaaaaaacaaataatgacaactactcacatctgatttttcaaagatggggatctgatcattgatatcaataacgttgatttgcacaaaacaaagggtcttgaaatctgaaaaccaaagtcatatgtcatagaaattttcactgaaaaccatgcattaatatcagaaatctgcaagaaaatacttggcaagtgaagtgacagccatagccacaattttgcaattgacatgcaatttgtgcagagagtgggctctctgtttcccacctgtacccaagtggtcaccaagtgtggggcagggtggctaaagacagatctaagagagatttttctaggtttttcattgccgtccacctgctgtcctcctaagtaaagttaggtaaggtttgttcctgagcaggatggcttccttttgtgaagcagtctttttctgactagtgaaacttatgtaatcttcaaagtccagagcaaaactgtccttccagaaagccttctgtgagcatcccagtggctgtctctccttctctgaacacatccaacctacatctgctctgactactatgatggtgaggtccaagggcctgctctcttctatctaaataagggaggaactaccaccattggcctgttcacaagagtctggctacccagcctgcaggaagcaaggtggggacagaggtagctcctggaaccctggagaaatcacccaggctttcagggatgggtttcacaattccaagacctaggcacacagccacttcagctagattccagatgtgtgtggagtgcaggtggggacaggatgcctgggggagagagaacaagagataaaatgacaggttctttgttgggttgctgttgttctaaccatggtgcactgcactgtataatggttaagactctgggcttggaattcactgtttggactctggctctgccacttagcatgtatgtgagagcttgggtgcctcactcaatttatctgtaaactgtgaataacagaacagatgttttcatcataatacagttgttagcggcctctatatagcagcaactgtattgtttacccgagttactcattcatcttcatgataacttcatgttgtaggtgctactgtcattcccatttaattaacagatgaggaagccagggaatagagaagttcaggtaacctaaccagggtcacacaactaactagtgatggagccaggattcaaacccagaggttccctttgccctctgcagccaccatccattcctctgtctgtgctctgtagcccaaggggctgaccttatgaactgcatcaatgtacatcctcaccctgagggtaacagttgggttctgccactgagaggcgtggcaagagactggagggaggacaggaagagtgtagctgggggtgtcacgcccccgttgccaacagccctcttctagtgacaggcacaggccttgctcctttgggggatgctcccctccctggctccttcaggttttagggcagaaaatgctgcttactgtgcttcacacctcctgttggtttcccttaaccctgcccacaacctttgcaaacaatcccttctttcaactctttgaggggagtctccacttcctgctgggatcctgactaatattcccaggtagtttaactctagagctggtgctcaatgcactggacatgatcccagggacagaatctattaacaatccaattacaaccaagtggatattgattgaagttaaggctggtcctcagaacgtttgtagacaacaagaatggctgaagactggagtggtcccagacccagaacccactggctcactgctctgcacacacctcgtttgaccagcagtgggcctttctgggtaaaaggccttccctggttttatgtaaaactgtgttaattatagcctagtctctagttttctgtagtgcacagttgaatgtttagttatatcaacacacacatgtattttaatatattttataatctggtccatattttctatagacgtactcatgcaaataaacaatttgtaatctgattcccactttaaactctatcttcaaattgctccaggtcctcatgtatttccacatggattcccactctcccataagtcctacatgattttgtaacttgtcatattcatccttcaaagcccagctcagaaatacctcttccagaaagcagtacctgttctctccctccactgagtcacttatttccttcatgggctaccttgggcagttccttgcaatttactgactcacatgtccgtctcttctaccagaatgagtgctccttgaggacagaatcatctatgtctccccagtaccttgcatggtgcctcaaataggtaaatgcagaataactgctgaaagaatggactgttgatagtgtgaaattgttagctcgtcatgaatagggaaggtttattatacttacatctgttctatctcttacaataatgctagacaaatattagggccttaatatttgtcaaattactgggtttcaaacattccgcattagggccctactaaacctggcttctgcctagtatctcaatatccctgtaaaggacagaaacatgaagcacagtgtgaaacgtttcttgtttgttctccatacctgtgtcatccgtgcctgccagcagaacaattactgaattatatggtaatcgaagattagtacgcattaactcaaaggaccttctaggagtctgagtgcccttgaaatgagtctgtctttgaatccaggtattttgtgtgtctgtgcacatttgtttaacaatgtgtgcagttgattaagaatgcatagtttttatcagattctcaaaggttcctgtgacccaatagagattaagaaccacttgctctgcaattgtataaggagtatggggaagaatgtctcctgatactgtcaaacggccaactagaagctgttagggtaagatagaactttccgaaagatgctcttctcctccactttcctacagtagagtcctttcagtctgaaagcaagaattgggaaatacaattcattttcctgtttgtgattatgttctgcagaatgtgcctggcagacctccaacaacagggttgttaattgacaacagctccactgctgtgctctggaatctattaccacattcacactgagacctcaactcccctggactgtacacagccagtgactgagaaaagcagcaattgtaaagctcattttcaaagacaatgaattcctctgacagccccctttagactccccgacagctgtgccaagctttcctcagactgtcctagtctaggacattcccaccagccttccttctccatctccccttcacccagcgtcaggcatcaggcttgtatttaggtctgatgactctcccagccttctttgtgcccttccgcaattttttctcacgggctccccccaataaaatcctcgtacatttaatctccttttggcatctgcttcccataggacccagaccaacacaacaatggtgcctgagctgcagctccggcctttacagtgttcaaccagctatctctgtgttatgtgtgtttcacaaaggaagcaaagaatgtttaaatggcatcattctataacataccagacattagcgcaggaaaataactcatagctagaaggaaaacaatgatttgcactcaagacggtggatatgatactaacctttgtcagacacctctatcgttaagttgtactgaggagtatcttgcttcttcaaggactgtttagctaactgtaacattccagcataggtttggattaggaagagtccatccatgggaagtttgggagtttgctccacaatcctgtagtttagaaaactgttggcagtattttcttcatccctgtcatgtgcagtaagggtcccgatactgttacctatgaggaaggaaagaaggaaaacccaccattacaggctccacataatctattaaaatagtttcactaaaataagcacattcctagaaaacaccatgaataactttgaatagcagacaaatgctcttagagttattttggttcttctcatcctatcatgtaatgggttgaatagtgtatttgtcagccagggctgtcattaagtatcatggattaaacaacagagacttattttttcacagttctggaggccagaagtctgcaatcaaggtgttgctggggttggtttcttccgaggcttctcctgggcttgtgagtggctgtcttttccttccggtgccttcacagcaccttccttctgaacctccctatgtccacatttcctcttataaggataccagtcatactggattagggcccactgtaaggacattttactttcattacctcttttaaaaccttatctccaaatatagtcacattccgaggtactaggggttagaacttcaccctatgaatctgggggagggggaagatgtagcctagaacagagggttacaacctcaacatataatttggggggcacggggacacattcagcccataacacctagtactccctcccaaaacttcatgtctaccagaacctgagcatgggactcatttgcaaataagaccttcacagatgtcactagttaaggctctggagatgaaatcatcctggatttagaggcagccctaaattcagtgacaggtgcccctataagaagggaaacacagagatgcacacagaggaggaaatgatctggaggaggaagccagaagttggagataggctgccacaagtagccagggaacaccagatgccaacagaagccggaagaggcaaggaaagattctccccttgagactctggagggaacgctgccctgcaagcaccttgatttcagacttccagcctccaggtctaggagagaaaagatttctgttgttttaagtcaccaaattggtggtgatttgttgctgtagccctaggacgctaatacacatggcaaatggtatcactaaacaaagagaagccaaccctagattgcatctaagcaacttcatggaacaattgcagaaactgactctactccaaagataacacagggcagggaccaggcaggatcctctccaccttgctgtagtttgtggtcctaagtattttattcctgtgagggtttcagtccagggagttctacaaaccagtggctatgactcggttctgcacccagctctgggcaagttctgacaggttccagaccatcctactctgggaggtgggaattgtaggtctctttatatgtagcaagaatcccacgtaggagctcaaacttgaattcatcccatttgtggagttacaccccctcccccatcagctgacacagtttgcatccactgacgcatatggaaatttagaggttttttggttttgggttgggggaggaaaaagaaagtacctatgtatgtctacagtagagctggacacatgcagatgtgcctcatgggctgcatgcagggaccatcggaatgaataggacagaagagaatatgtttctagtgcatatggcatgcatatgcccttgcaagaaaagtatctgtgtgctgggatgaaagagtgtcttactaaattctgtggtcctttggtgtctcagcagccctgctatagccctatcccctcagcaagtgagcaagaaactgaggacactgtcctcctctcactcacaggaaacctccatgctgccagaggcaccatgaggactgctggcatcagaggacacccctcgctgggagcagaggaccttgtggatcagtcggaagtgaaaggaaaaccatgtctctgagtgactgaggcctggaacaagtggagctcaaactgatacaggagtatacgtagcatctcttagaaatatgcagaaatatttagggaggtggggtttttatgagagtctaaattttctgtatgaatacataagacttggtggcaagtgggattcaagaataaatgttagtgttgctaagacttggggacacgagttccacaagataccaaacaggagaatgtaaatacactggggaatatatatatatatatatatatatatatatatatatatatatatatatatatatatatatttgtgtgtgtgtgtgagatggagtctcactctgttgtctgggctggagcacagtgtcatgatctcagctcactgcaatctctacaagcctctcaagtaggtgagattacaggcatgcaccaccacacctgggtaatttttgcagtttttttttttttttttagtagagacagggtttcgccatgttggccaggctggtctcgaactcctggcctcaagtgatctgctcatcttggcctcccaaagtgctgggtgggattacaggcatgagccactgcacctggcctaattcagtattttatcaaggttttatttgtgaatatttccacctactcatgtcctatcagctaagctagacagtaagtccccacaaggcaggagcattgtcttgtacccttttaagcttacatatatagaatatgctcagttgatttataagaattcttggtccactaaagactctgaaatatttttacaaaataaattctcacctttagagaggcaaatagcaagctgagccccttcaaaatttattctaccaacaatgacttcttcagtctcagaaaaccagcactatcctcttcccagatgaggtaggcgcctcgaaaagagcttccagcaacccccatctcctgatatttgtgctttttcagaaccccatcctgttgagtgcaggctggacctagcaacttgtttctaatggcaaaagtgatgggatcgcttccaagattaggtcatagaaagactgatgcctgtcctttcctgctctgccgtactctttccctctctctcagaactctctgaattagaggtatccagctgaacttcacccagattccagactcacagaaactgtgacatgatacatgcttgttgtttcaagctgccaagatttagagcaatctgttttgcagaaataggtaacaaatagactatatgattggcccaatgtaaaagaggcttgaagtgtcatgtccgggtcaagaaagttgtcaaagattttccacctttattcagtgtcacagaccatcccagatttcccaagaaggtgatggcacacgtgtttgttggctactgttacactactgtgactgtgagaagattcttccttataacgaactgaagtccttcaagctggcattaactcttcctgttgtggcaagagttgagaaaaatgaaacagagaggacctgcacagaacacagtgacacagaacacactgacaaaaggcagcccacacgacacctgatagcaagaagaaaaataatgagcagtgtgagcaagccgctccagcagcgcccaccaagcctccgggaaggcacccactctgtcagaggtgtgtctggtgaggaatggagggacgaaaagaaaatgtgagcccatccacaaagcacaggaggatctctccacaagggcagtgaagctctagaaatgatagtcgtgaggctgctacacttggaagcctctgaaaggtacacagcacaacagaacaaaacagttcaagaaatgccagtctgctcagtcaaggggctcactgccaagggggaaacagacaagcattgtcccaaacccagagaagccataaaactcccagaaattataatgttcttatagtagttgttcctatacaaaaactaaaaagctatcacaggacacagtaaaagaaaacatagcaagacaaagcaaaaatgataaaaatagatgggatttgacttcatctagcagcctcttgaattatattatcagcttcttggaaaggggggcccaagggtcaaaagtcaacttccattggtgttgcttacttattgcagggtgtctgtctgactttgggtgtaaatgtttaaattctttggcaaatgtgatgagattatctctttaatgagattattagaagtcaaataacgtatggggaaatcctgcaaatgagatatccctatatacatgtatataagatactagtgtaggtggctgtgatactaatgatagtagtaaggttgataatgatagtgataatggtagtagcggtaatggtagctataaaagccccaatttaagaatactatccagatactgtttgatcccaaatacggtccttacgtgactcccaaggtacagtcaacctctatgctgtggaagacatggattactgactcccagtaaggtctcctgctcaccttttacccagcagaggagagaaatggagggcagttacacagcattaggcagctctcatttcttacccagtcgttcattctcctggacctcaaatacggttactggtgacggacatgtaggtggattatcattaatatctttaacttttacatgaatttccagcggatatgaaagtggttttccgtactcatcctttgcaactgcataaaaaacatactacaacaggaaagtcagagttaaggcaagactcacccaccaccctctgtcaaaagcagagaaaatcgttgtttcatttctatgtcatttactcccttatttttaattcacttagaattggaaaattttaaaaactgagatgggtcagaattatgtgaaaattatcatgtctttgaaaaccaataatatgctggagtctgaaatgtgtgttttttttttctttaaagtaaaatccattttgctctcaactgtagatgggcataggactttgtcttgtcgcctgtgaaactcttctcttttactcactgcatccttttcttctcggtccaagggctgagtcacgtaaatatctccttcctggtcaattgaaaatgggaatcttggcagcttctctttgtcaactaaggaatattgtgcaccgggatcattccaccgcacctacagggcccaaagtcagttgtgaggaaagctgtatttggactgagagaactggaaaggaaataattttctagttctcaatttgaaatctctgacaaccttgtatgtttgtggtttcttgtaacaactgaattacgtttttcacttttaacctaaaataagcctgtttccccccaccaagttatattgctcgaaaaaagcacaccaggaaatgtttcttctctaaagcaattcttcacaaaccctctacagggtttctgggctgctttcttttggaagtctgactgtgaaagctttctatccacgaaccatccatttaagaaacaaaatgtactttgtggctggcagtgtctgaggactaagccacaatgtatggtgagcatctaatactcaccaatgaagatgaacaggggcaataggggccactctgaagtcttctccatgccattaagtaagacaaatgatacaaaaataaggacattcctttcctaaatatttagcctcagagacttcagggatgagaataactgccaactcctagggttgtttgtaaacaacctggcaaaaataaaaaataaacacaagtaagaccagtctacttgctatatagacagagcctggtctgatatattaataatgtttactgagtttgccacatgccagacacaattctaaacatatttatgtgttatatctcatttaatctccaaacagtcctctgacgtacagactactgttatctctattttataatgaagaaactagggcacaaaaaatttaagcgacttgcccaaggtcctactgctagttgaaatttccacagtaaactattctcagagcagcctgggaagatatcacagcagcaactttgtcccttgctaattatttaagcatcacccattgtccctgcagactaccttcttggttctaaagtgggctcctcttgtgttctaaaaattcagtctgagttcctcttcccatctccccctcccccctcccccctccccctcctccccctcctccctccccttctcccgctcctccttccccctctccccctctctctttctccctctctccttttgggtttcagaacacccagagcattttttccagacctgaaaattgggtaggcactctagaattttcccttggcagccccaaggcaactaagcatgagttctttgcagcatttaccaatccctttgggagtaacctgaataatagctatgaagactttagtctaggcccccaatcagaaattctcatggtaatgagtgctgacatgctttctttctaactgggaaatcagaattcttcctgctgttcttccttttttttccctcctgaagttgaagttcattaattcaacattcaataaataaatgtccctgggcccatcccaataaatatgatggaataggccattccagggccccttaacaatagtagcattaaaaaaaaattaggggaactacagactagtacttcttcataataataccttttatatctaatatttttatctacttttacagatactgtctcagttaatcttcacaaaacactgaagtattatccctattttattgatgagacattggggctcagaatagttaaatgacttgtttatgatcagtcattcaagtgatggaacaggaatatgattttgttcatctgcttccaaatccagggatctcccactaacccacagctttcatgtggaggaatttcctgggcttccagaaaatatcaaatctgggtggagtccagagtgaatttctaggagctaaggtaggagggggcccagggtaagagcacatgccacagaggtggggaagtaggagcatctgaacggaggggagaggcacacacaggagatagagtgccaggggtgagggagtttccaaggggaaaggttccctactatgatccttttacccctagccagtcctatctccgtccctcagcctaagatgggcaagtctattgggtcaagattttttccacaataagaagcagcagcctttcaaatctatttgcaacccccaaatcaaaccatgtccatacatagtgcaccataaatgacccactgcagggctgccatatcccacactgctaacagggaacaacaaacatcactgctgtctacttttaaggtgagggtgagtgaagttctctctgaaagcaaaagtatatatctgatgtcgtttggatgtttgtcccctccaaatctcatgttgaaacgtaatcctcagtattggaggtgaggcccagtgggaggtgggatcatgggggcagatccctcgtgaatggctgagcaccacgcccttggtggtaagtgagttctcactctgagttcacatgagacctggtgcttaaatgtgtgtggcacctcccacctaactctcttgctcccattgtcgtcatatgatgctcctgctccccctttgccttctgccatgatcgtaattttcccaaggccctcaacagaagcagatgctggagccacgcttgaacagcctgcaaaacgatgcaccaattaaacttttctttacaaattccccacctcaggtatttctttatagcaatacaaaaacggcctaacataatatctgcatccaagttgcctgcccatgatgcatggtcaagtccagtgactcggggccagaggctatataatttgctttataatcatgctatgaaaaaggtatctaataagtgtatcagtgaagactgtgagggtgggtctctacaaagtgaagccatttatctagttggctctcagtgttacttgggcttgggtactacctgagtgattttgatggggtgaggatcagttgagttttccaccatctccacaggttttggtgctttccaaatattctctgtcactatgatatccacagatgtggtatcactgaaggaattctcactctggcctcccatgtccttcactgagatcaccagattataggaaggattcttagcaggattcaattcctgagatcctgtgagaagtaggggagaagggaataggaagtgtctctggaagagacagaccaaactccctttttctgatcgagacagtcctaccagggcacccctgaacttaccctctcgggtaagagagatggctcccgttttgttgttgatctgaaagtacatgacattgttgatcatgggaagctggatgacaatctggtaataaagctggccattgggagtggccggatcatccaggtctgtggcattgacatacaagaagggctttcctgtttaacaagacgtacccagaaaaaaaaaaaaaaagatattaattgaaacccaaaccaaccatagctactttttccatctaaaaagtggagatataatagggaaaggtatgacaattcacaccagtggggaaataaatatttatcccactccccccttccctaaaataaggtttctcaaggtctggtccaagaacctctaagggtccctgaaactgttcaagtgctctgtaaagctaaaggtcatgtttctgtaaaagatccatttaaagtacaagataatttaatgaattgtagtgtaaaagaatggaaaatatggtattaattttgatttcactttgcaactaatctttaagaaaccacaatttattgagtttgggtatagtactaaagaatgtccagttatctgaaaatactattaaaatattcctctcttgtccaactgcatatctgtgtgaggctaattttccttcatatatttcaaccaaactagcacatggcaagagaatgaatgtagaaacagacatgagaatccaagcgttttctattaatccagacattaaagagatttgcaaagattaacacaatgccatttttcttactatttttgtctttaaaatcaattatttttcattaaaacatgttgattagtgttatttttaatgaattaataattttttaaaatttctaatatagtaaatgttgatagatataaccagtgatgtactagagacagctcatgagactcagttgttgaattttcagaaattttgtgtgtcaattattaataccaatggtcacttgaaataggccatggtaggagtatttgcaacatggaaactagaaaattctacaaatcagagctttgtccccctagaaaaatagctgttaagcctttaccaggacaccactggatataacccacctgtctaaaagttctctggagtcctcagtaaattttaagagaatatacaagtcctgaaaccaaaaagtttgagagccatttctctagcagattctattagtgaagagagaaaaggtacggcctggagcctacacatttagcagagtctgtgtgagtctttggtatgcagcttcagggacagggacatcactccacataataaactgaagtgaattttttcctggaattctcggaggcaggcattgaagaaagagaaggaagaagcttgatggtgggatgatgcaaatggccccaagtcttgattagtattattttaaatgaatatctttaaaatttctaatacagtaaatgttaatagataaaccatatttctaagaactctgaagtctaatattcatttatgttgtgtgcaactgttaggaggtgatgctccttcctaggtgcctgctggacacactcacgccttaatgaaggccttaatgaagggcttaatgaagggcttttgtggaagtgaaaggtagaaggtcaatgcagcatagagaagggctgagccacagatgggatgtaagagaagaaaagagctggaaaccaccagtgacaatatcaatggaggttcctaagaagatacaggggagtaagcttacctttctagagtgttctagagctctgaggtatcttagagatcaccctagaaaagcgtttttcaactgggggtaatttttgagacagaatctcactctgttgcccagaccgagtgcaatagtgtgatcacaacttactgcagcctcaatctcctgggaccaagtgattgtgccacctcagcctcccaagtagctaggactacaggcatgcaccaccacacctggcaaactattattttttgtagagacaggatctcactttgttgcccaggctggtctcaaactcccaggctgttctcaaactcctggctgaagtgatcctcccacctcagcctcccaaagtactgggattttgtgccctccacccaccagaggatatttggcaatgcctggagacatttttattgccacaacttggcaggggggcacatagtggatagaggtcagggggatgctgccaatcatcctacaaggcacagaatagcctctgaccaaaaaaagaattatcagacccaagatgtcaatacatagtgctgcattgagagaccatgctctggagcaatagagatagtgaaacaactcccaaatcagtgtgaaatgtaggtaagatagtgcttattgagtgacagctgcagctattagccacacaagtctgccccttccacctgacacccttccatctttccataaatatctctggcccctgcctgttacctgggcgagagttctgccttactgagccttcgtactttgactggagaaacgtgggtcgattgtcgttgatgtccttcacttttatggtgatagggactggaccctccactataattccattagcgtccagggctgcaacctgatgttgaggaaaaggaaaccatgttggtgagactgaacttcatgtcacatgcccaaaaatcacttgaaggaaattagaactcaaagaaccaatggcctggtgactgtaggagagaaagaactcacaaaaggccaaattgggaaatgctaaaacagggattgtatcagttaagcctggctaatcatgatggtgactttctatcagcagggtgttctggacactgaacatgcatctgttctggatggctgaagtccatgaaacaagagcactgtgacccctgagaatatgaaagtgttgtgttctcttccagagccattatggcggtcagcctgcaaggcctgcagcagaagtaccagacagaaagcttttatctcactcttttttccatagtaggctctctgactttcctaggtattcagataccaacggtgaaaactaaaggagaaagagagggagacgggtctttttagtcagctcctggctactggttccctctgcttcttccaacgcccaaaggagctccatcccagcaccgatacagccttcttcatgggtcccaagccaatgcaacagccacaggcagataccattgaagtatcagagatgtgctgacttttgatccaagtacctaagcatggtcttacttggataagtaatgccatcagagggtcctggcaatgtaagtggggttacgttggttaaaaagcctaaggaaaaggatatgtttgccacacccctctgtagttggtaagaaatggacatgtgaggattgcaaagcgtcccattaatgtaaggaaagctgtaactggattctgtgcaaggaaggaaggtgccagccatacttccagaacaaagggtgctcagagaggttggagttagatcccttcagctggtatcaatttacctggagattgtgagtagatcttgtttccctgtccaaggctctgttgtaatacagaagtccctcccgttctatcacaaatatgttgtctgtctccccagttagttcaaaagtcacagcaggaggattggccttaaactggggaaaaagcaaaaaacagattaagttgtaagggaaaaaacaatgttgtggaatttgtagaaagtcaccaatttcaggtaaaattttcattggttcaattactaaataagaaatcctcaacttttaaagtggtaccttctaaaagtttgtttgcacaataactgtgtaacatttaacatacattttcctcaagagactgtatactattattcaatacattgacaaaagtcattgatgctttaaattatagctggggttaaaagagactttttggtaatatctgaaatctatgacattactagcttctaagaagcattaaaagggtagctttctctctaggataaaatatgtcatttagcacttctaaaaattgtgacaaagattaatagacacgttaatgttaaggaaaagaatttataagtggctttaacttaatgcaaatgctatatgataatctattactttttcagaagtggagaaaataccgaccaccatattcatagatatggctatatcacttttaagaccacagcaacagaaaattcacataaaactaagaaaacataaaagctgttcaaccttaagttttagtatacttttatatatttttattaaattaaaagcaatatcaaagttagtatggatataaagaaacattgttgatggaaatataaattcctataatccttttggaaataacttgaggcataaaatgtttgtaccctttgatagcaaacattactatacataatttaccctaaggaaatatttcttcaaacaagtacatgcttatagtgaaagtaactttatttataataccagtaagattgaaaactcctaaatggtcaaaaaaaaaggacagtgaaattattatggcacatgaacttgacagaatattaatcattaaaatgttcattctacaaattatgaagaaacataagaaacaatgatgtaaagtaacagaagtaaatttgagagtaaatctagactgttatggtaccaaaagaattcatgtcagtaggtaagaaatggaatttaaaatataagaagagttgatgtgttaaatgggtaagattgtaagttaaaaagtttttgtgcatgtttgcttgttgatattatattgtttatataataaatgaacatgttgctattttgtgttttcagaaaaagacctggacatcagtgagaaaggtggagtaagggcctacagaaaactgctcctccataaaagcaatgagaacactggcaaaaattgtaaatatcatctttttaagaatatgggaaattaaccagatgcttgcaaaatccaaggaatgtttattaaaaaaaaaaaaaaaaactaaggtttgtggtgttttaatgcaccctaatcccatggtcctttcctaagatctgaagtagccttgaaagcaacagcctcacaccacagtaccatggagagggtgagaagcgtttgtagcttcccaaaagctccatcaccagagaactatcattatctatcctgttggcatttccctgggaacatctacttacaacacttatcttcatttgaccggactcagaattcatacaccacacacaatttttcccctggggcatttgttgaaaacaaccattagcaattgttcaacattgcagctgcctgaggctgtgataacagttgaagcaaagaagcagctgaccaaaacacttaaaagggaaagctgggaaatgagatgtccataaggggctttgaaaatctctaatatattcctggcaatctacaaggccactatcatgagcagggctgtgtgcatgcctgggaaagacctgagaaggccctaatccctcacctctggctgacttggaggctctgcataagcagaaagtgaaggcgaaggcagagttgtaaactgcctgccacatagttgaaggttgtgtcccaacatgcacacagtgccccttggtaaacaccaggagacttactggcttaaggcatttaaggaactctctatctagtcattagctgaacactaagctgactgagcagacttcagtggccagacatgacaaagaatacagactttacagaattcattatggaaagtcactaagcaaacaaacagcatcaacaaccaactccaggaaaagaaagatatatgatttctagagttgccacatcacattatttaaaatgtttggttttcaacaaattatgaaatgtacaaaaatattaaaaagtcaatagaaactgtccctgaggaagcccagatgttggatttactaaagatttttaaaaatctattttagatagattcaaaaactaaaggaaatcatctctaaagaattaaagtttgaaaacaatgcctcatcagatatagaatattgattaaaaatagaaatttttaaaatagaaattctacagttgacaaggatgataactgaaaggaaaaattcataagagggtgttcaaaagcagatttgagctagcaaaagaaagaatttgtgaacttgaaaatagattaatagagattactgaaagaaaaaaaatgaacaaaaatgaatagattcccagagaccagtgaaacaccatcaagcagaaaaacacatacataataaaagttccagaaggaaaggaaaaagggggaaaaaagattatttgaagacagaatgacccaaaacttcacaaatttaagaaaaacatgaatctatatatccaacaatcactatgaactccaaatagaataaactcaaagaaatccaaatttagtcacatcataaacatttgaaagatagagaatcttaaaagtgcatagactcatcacatgtaaaggatcctcaataaaattaacagctaattttccatggagatcagaaggcagtggaatgacacattcaaagtgctaaaagaggccgggtgcagtggctcatgcctgtaatcccagcactttgggaggctgaggtgggcagtcacgagattaggagatcgagaccttcctggctaacacggtgaaaccccatctctactaaaaacacaaaaaattagccgggcatggtggtgggcatctgtagtcccagctacttgggaggctgaggcaggagaatagcgtgaacccagaaggcggagcttgcagtgagctgagattgtgccactgcattccagcctggaggacagagtgagattcccagagtgagactccgtctcgaacaaaaacaagcaaacaaacaaacaaacaaaccaaaaaaaaaaaaaaaaacaaagtgctgaaagaaaaagagtggccaagtaagaactgtaaatcctacaaaactatccttcaaaatgaggataaaattaacctatactactatcagacaaaacagactttaaaacaaaattttcagagacaaaatgggatattctataatgatataagggtcaatccatcaagaaaccatagcaattataaacatatatgcacctaacaatggacctcaaaacacatgaaagaaaagctgacagaatggaaaggaaattaaataattcaacagtaataattgacgatttcaagactttactttaaataatagaatagaaaatcaataaggaaacagaagacttgaacaatactataaaccaattagaagctaacaaacacccaacactccatccaacaaaagccagtcacatggaacattctccaggagaggttatatgttagaccataagcgagtctcaataaatttaaagggattgaagttatacaaagtatttgacaattgaatacaattaaaaacaatataaggaaatttgggaaaatcactaatatgtaaaataacaatatactctaaaaaccaaaggtcaaagaagaaatcaagggaaattagaaaatactttgatgtaaatgaaaatgaaacacagcatgccaaatcttatgggatgcagataaagcagtacttagaggaaaatctatcactgtaaatgttcatactttacaaagatgaaatatcccaaagaacctaatcttctacttagaaaaaaaaaagaaaagaaaaacaagaaaaagaagaatagcaaagcaagcagaagaaaataacaaagatcagagtggaaattaatgaaatggagaatataagagcacaggagaaaagtcaacaaaaccagagttgattatttgaaaagatccacaaaagtgacaaacttttggctggactgatcaagaaaaatgaggtaagattcaaataactagaatcaggaatataagaggactactaccaaccttatagaaacaaaaagtattaaagagaatattgtgaacaattgttttcccacaaattagacaacctagatcaaatggacaaatttctagacagacaaaaactactaaaactgattcaagaacacatagaaaatctgaatagaactataacaagggattgtattagtaatcaaaaaatttccacacacaaaaaagcccagaaccagatggcttcactagtgaattgtacctaacatgtaaagaagaattaacatcaaaccttcagaaattcttccaaaactagaagagtaaggaacacttattcaattcattctatgaggccaatatcctgatacccaaaccagaaaaaagtcaatgcaagaaaacttcagactaatgtctcttttgaatataggcacaaaattttccaatgaaatactagcaaactgaatccagcaacatatgaaaagtattatataccattaccaagtggaaattataccagaatacaaagctggttcaatctatgaaggtcaattaaggtagtatcccatattgatagaatcaaggataaaaaccacatatttcaatagaggcagcaaatcatttgacaaaatccgtcatcctttcatgataaaaacactcaacacaccaggaatagaaggtgacttctcagcctaataaggacaccgaagtaagccccacagctaacattgtacttaatggtgaaagactgaaagctttctccataagatcagaaacaagacaaggatactcaatcttgccacttctatttaacattgtactagagattctagcaaggggaattaggcaagaacaagaaataaaaggcataaagattggaaataaaaaaataaaactatcactattcacagttgccatgattttatatagggaaaattctaaggaacctaaaaaaactattacagctaataaacaagtattataaggtttcaggataaaagatcaataaacaaaaatcaatctttctaaccattagcaaatagcaacccaaaaatgatatttttaaaattccatttacaaccacaacaaaaagaataacatatctcagaataaacttaagcaaagaaatatgaagcttataaaatggaaactacaaaacactgttgaaagaaattaaacaagttctaaataaatggaaagacacctagtgtttacagatttaaaaatctaatgctattaagatggcaatacttcccaagtttatctactgattcaatacaatccctatcaaaattacagctgccttgtttgtagaatttccaggctgatcctaaaattcatatggaactacaggggactcagaatagccaacaacaaagtaggaagacttaacgttctctaatttcaaaatttactacaaaggtgtagttccagataatgcagtactggcataaacatatatagatcaatggaatcatagtgggaggccagaaacaattcaattgatttctgatgaggatgctaaattcagtgggggaaagaatggtgttttcaataaatggtgctagaacaactggatatccacatgcaaaagaatgaagttggacccttaccccataccatacacaaaactaactcaaaatggatcaaagacctaaatagaaaaactaaaactataaaactctgagaagaaagcatagacataaatctttatgaccccgaatgaggaaatggtttcttagatatgacatcaaaagtacaaataacaataacaatataaattggacttcatcgaaattcaaagcatttgtgctccaaaggacaccaccaagaaagtgaaaagataacttatagaatgtgagaaaatacttgctgcaaatcatatctgataagggagagaacttgtatacggaatatgtaaataattcttacaacaataaaaagacaaataacctgattaaaagtaggcaaaggatttgaatagacatctctcccaagaagatatataaatagtcaattgccccatgaaaaaatactcaacatcagtcattagggaaatataaaccaaaaccacaaagaaataccacttcacaaccactaggatagctataattaaaaaaaaaaaaaagacagataataacaagtgctaaggatatggagaaattggaactcatacattactggtgaaaatgtaaaatggttcagctgctttggagaacagtttgtggtttctcaaaagtttaaacagaattaactttgacccagcagtcctgctactgagtgtgtgtgtgtgtttgtgtgtgtgtgtgtccaagagaatcaaaaacatgtcctcataaaaagttgtacatgaatagccatagcagcattattcattatagccataaatgaaaaaaaatgtccatcaattgacacatggatatccaaaatgtgatatatccagatgatggaatatcactcagtcataaaaaggaatggagttctggtacatgttaccaacatggatgaatgtttaaaatactatggtacataaaagaagtcatacataaaaggccatatgttgtatgattccatttacatgaaatgtctagaacaggcaaatctatagagatcaagagtagattagtggttgcccaaggctgaggggagtggaggctggagagtgactattaataggcataggatttctctggaggctgatggaaatgttctgtaattagatagcagtgatatttgcacgtctttttagatactaaaaactactgaattttagaggcatgaatttttagggttacatcttatttaaaatgagaaaaaaaaagacctctctcagatttatatcacactgtctgatgatatggaagcccctggtgagtacagagctggcactagttgaaaatccacaatgaaagaagtgtatggtggttcagttcattttatttttgaggacatattaaaaacccaagaaccaacctcatggggcaatgagtgttcttcatgcctctgtaggtccaggtgctggatgagaggatctgtacacctacctcctccccaccactgaagcaaagagctccgagcacatcttaccaaggctgggtttgctgcattctttccacgtacaaagatggagagagcaaaatgtgcttgactagaagtcaggagacctgtgttctattgttggctctgccattaactaacttaagcctcagtttccccatttttaaaacaagcggttgtaccaaaactccccagtgtgttttctagcatgaagcttctgtgattctaaaaagaaaatccccttcatcttcctctcactactctgtcatcccaaccccacaccctaccccaatacacacacacacacacacacacacacacacacacacacccctgtaaagaagaaacattcaaccatgataaccaggctatcatttcctgctaagaagggataactttgcagcatgactaacagaaaaactaaaacaaaacaaaaaaagaaaagtggagcagcccaaggcatgacttttactggctaggatccccagagactctggaatgatcctactgaacagtttctaggtctggatgtttgtccgttgtaaagcttgtaagttgaagattgcatctatgtacaatcctgattgtcttcaatggagtgtggacctgtactcacagaacacctactctattttgaccttgggtcttttcatacagaaatctcagaagtagccacaaactttgtttcacaaatatgttttatttagcttgtaattaaaaaaaaactatgccaatttttttacatcagtgaattttatataaatataacattttatgccttttctaggaaaattataaaatctagtagagtagtacccaaattctaactcgtgaaaatcgtctggagctaaattaagcctatccccttttgacttactttcagtttgccacagtccccactactccctcttgtcccaaatactaaagacaagtatgagaaagcgtttgatttcatatttgtgcagttgggtttttttctcatatctgttttttgttgttgttgtttggctgttgtttttcttttttccatatggcttcatttatcactcagctagcccctaagagcagttgagataactcaccacagacaggtatctatgtcatatccaagcactctattggcacctatataaggaagtctccccaatctgtatctcctgacccatattaacactgtctgagacctctccacctggctgccccacagataaccttaaaatcaataagcctaaaactcattcacttttctctaaatcttttgctgtactctctctctctctctcactcagtgacaccactaactacccagtcaagcaagccagagacctaagagttgtccttctttctgttccctcatcccctgtgctcattcagaaacataaacaacagaagtttatcgctcatagttctgaaggctgagaaatccaaccagcagattcagtgtctggtgagggcccactcctcacagactgcacctttcatgtgtccttacatggcagaagaggcaaacaggcacccccaagcgtcttttataagggcactaatcctattcatagaggtagagccctcatgatctaatcacccaccaaagaccctaactcttgatattattacattggagattaggcttcaacatatgaactttgtggggacaccaacattcagacctctatagttactcaaaccaggcctccctcacttcccgttgaactattgaaaacagttttctaaaatccttttaacgtctaggctcgctcccttgcagctcatgctctgagtgatcacacagtaagcttctacagcacaaatctagttacggttttccttgttgaaaccctccagcagcaccctgcagcctgctataggacgaagggctagtccagcccgtgctgacctccgcaggcatgcagacctttgactgcatcctgtctcccactctatactctggcccacatgccagctgtcattttcttgacaagtgcacacccccatgctttttcccatcctgtactcagcacctgcttcctgactgtgagcacctgctcgtttttgagtactcagtttaggagtcaatgaaacctcttctgttcgctcactaccatctttatttgaaattgatcattcttagattttaagtgttctcaccacaaaaaagagataagtgagataatgcatatgttaattagcttcatttagtcatttctctctatacttcaaaacacattgtacacaatatgtgcaattttgtcaattaaaaataaacataaacaaataaaaatcagtcactctttcttagtttaccctctgccccctccacatcccaccagcctcccatgagaagcttcagtgcatgtgtctgtttccttgttagttttctcttactagctggtaagctcaccggagcagggatggagtcggggtcatcccatatccccagtacccagcagagcagctggtatatatagtagtcactccgtacatggttaataaaagaaagtctgtgagaaaaagtaagtaattcaactctgtgtgagcccctgccagagtcccctagccagttccctgaatcctctctttcctcctttagtttgtagccagagtgaccttttctcaatggagtcttgattcagatccattgcttttgagaaaaactcaagatccttaggagtcagggtcctccctgtctctgtggcctcctctcccacctgctcctcctggctccatcctccctacctgcatggccttctgctagtccttggtatgtctcctgccctctcctggcagagggcagccatccctgccgggcctcttctaagctttcttccctcccttcctcaccaagttaattcccatcaacctccagctctcaacacattcactgcttcttcaggccctgacttccctgactggagaggtggaggcccctaataacaccctacctcaccgggctgcatagacatgcaagcatgcccctgccagctcttactctggggccctttgccttaagctggtaccaatgaaagaaaggggaagagagatagctttcagcctctcctctgtggaggggaactgtccagcacaatacagttgtcccttggcattggtgggggctcattcctggacccacgcagataccaaaatccacagatactgaaggcccttatataaagtggtgtattatggtcatggaacctactcgcattctcccatatacattaaaccatctctagattatttataatacctaataccatgtaaatgctatgtaaatgattattatactgtatttttaaatttgtatcatttttattgtttttcccaaatatatttgattctttgttggttgaatttgctgatgcatgaacccacagatacagagggccgtctgtaaatttttggcagttaatggaaggcacttgccttagaaggtaggtagctcagcaacctctgccacttccctggttcaggggacggggaggggtcacgggcacccccaagaaggctcatcagcatcctccaatcacttcagggccaagtgactttctcaggggatgtctggtaaatacagtagtgttttccccttctccactacatttccaggattatttctgtgtctttaatagcacttaagatgggacttaggtcccttcccttattcccacctgcagactgcccctccatctgatactgttcatggttatctaactaaataaaacgtccacctcccagtgcaccttgacaatggcccacatgggggctcagagaaggtggtaaggaaaaggcagtcctctggccagaaagctcattctagcactgactccagagaagccgtatcttccagtacttgaagcagcaagctcattgatcagacagcctcgagggtggatggtcattcccctctccagagacaggttccctttctactctaggggagaggcagagcctgcagccaccaagctccctgcagagggctgggagcactcgccccagagatgattgaggaagtccaaatagaatgtcaggtacaattcttatgatactgaggccactcatctctctgtttaacttagcttctgaaatcattcttgataatgagaatgccatgcctttattttatttcctgctatacaatagataaggaagtaaaagtccaccaagagagcatacaaaatcaagaggacagtgatcaagggtagcttttacctggaatataatttgactcggttcttggccttcataaatagaaaatgtcatgggtttcaggggtccactaaacttcccctcttggccatatccagttgcctgttaaaaaagaaagagaaaattagcatcttgtatgaagtgtctgtgtcactcattgattttattagggcttccagcaccaatatacaaaacataggattctatcatggctgaaatctgatcaaaacaggaaagagtgtaatagctgttgaagctctaccacgtcaaagtagcttgttacaaacctttccattgcttttcttaaacatctgagcagaatgtgagatgagaagaatcactctatgagaagaatgttaacatccccatattacaaatgaagcttaaaaaggttaacacagcacacatgctcaggcctaactgaactaaagcccatggtcttccacaatcccacactgtcttctaaattatatatgtttttactccagcttcataaaacacctccctccactctttttattttataaagacatttacagcagattgccagcactctagtgttttgaatttataagggggagaaagaaaatatagacgtatttagtacaaagtttgcttggcacagttacacggtaagttttagccaaatttgaatctgaatttgaactataactttaagcaaagcttactattttaacatttgattagctctttacattcatttagaaaaaaataaaagtacaaaatgtttactttaagcagtagccccacaatggttccaaaatccaaagaccctaaacttgaaagctaagcaggctctgcagacacccaagtcaagactggagtagtagtgaatgtggctgggatggtaagaagagtggctcacacttgctaagttagtacatgtggagctctgtcctaagcacatttaatcctgacaaaaactctggcagaaagttactattgttacccttgtttaacaggtgatgacactaagacccaaagaggttaaattatttgcccaggtagtggctggaagcaagatttgaacctgcaactctggaaccagccctctcagcctctatgcaccagcacccaccagagcgggtgaaacagccaaggcaacctggagggaaaactggcaggctgcactgaagatgtgcatgagagtgtgactcccaccattcccagtctcagaacatggggagcatcactgtagccctcaccacaacagcacctctgaaggcagatggagtgggcacccacgggaagggacagccagtcatgcagccacgttggggcaccctctaggaccagggatttagtgcctcatccccacgctggccttctctccttcctgggcacgactttgggtctcccatttgtggaaatcaggggtgaaagagattgaaatcagaagcatgatgtggcaagccaatggtttttggagctagacaataaaaataaaagagtaaaaagtcttctcactccctgaactgggtatgcaggacagatgtccaggtgccactaggttgggggaaaaccatttattttccagttatttagggagagcaagcacactcttgccatggaaactgctccctgctgggaatacccaaaagccatcaatatgccagtgatcagagaaaggtcttatgctagatccctcagtctggggaaccttgactaagttggatgctggatgtctggcaaaaaagcaataatgaatgagaacacaggggctttgaagtttggtcttctgttctcagatttgtggtagggccttagatttgctgcccctgggccactgccaagccctctccttttcttcctcccaccacagagaccggtaaaccaagttccctttcccaggctcacttgcagctaggaaggtggccaagtggcccagttctggttcatgaaatgagaggggaagtccactggcagtggtcaagcttccatattcctgattttaaaaaaaagggtagttgtggctgccattgccctttcctgtgactcttgctgagacaatgtaccttgtgtctgcagttggggcagctgtgatgaaccctgagaggacaaaccagctcaaaaaatggtgtagcaaagaaaagtagcccaagtctctgcaacatcatggaattgctaaacctgccctggattgcctacttcagacttcttgttatctgaggaaaataaacccctatttatttaaaatgctctaaagtcaaataagtcaaatttcctgttacttgcaagaaaatgctttttttttttttttttttgagacagagtttcacttttgttgcctaggctggagtgcagtggcacgatcttggctccctgcaacatctgcctcccaggttcaagcgattcgcctgcctcagcctcctgaatagctggcattacaggcacccccccaccatgcccgactaattttttatatttttagtagaaatggggtttcaccatgttggacaggctggtctcgaactcctgacctcaggtgatccacccgcctcagcctcccaaagtgctgggattacaggcatgagcaaccatgcccggccaagaaaatgcatccttaactcacaaagtaatgttgccagacttctagcccatctcctcctttctaagtttatcttcctttgggaggtcttcatccctttcactccttttccacatcttttcctgttccatcagctcctctagaaggcagggcataagaactgggtgtgcaggacagatgtccaggtaccaccatggttgcttaagtgaggtcagtgctttctgtggagctgctgcttatcagctttgcactcatgtcagcaagcagtctttcagttagtcacaccagtgaaaactacattagccacacacaaacaaggctgcactattccaacaaggacaagctggctcacccatcagaaaatgagaatcaagtcttggttccagggttcaaagttgcgtgcttgtattggggcaacaaatctctcttcctgccaataaacatgactattggggctataaagatttcaaagtgcatgtggacactgtgaatcatcaagccgctttccccagaagtgggaaagatggtatggtggaaatctgtgaaaggacaagatggcggctttatgcaggagttggagggaatagcgttttccatcttgcacaaagaggtgaaaggaagagaatggaactgccatcttaaagtcatttttagcatcttttatgtggcagtaatgggacttgatcaccacaagacatcatttcttctgaccaatgctatgaagaaagtatctccagagaagtcccacagtagaagcaaagcattcagagacagagctacctccagaccagacccagcgccattggaccaccaagccccaactcttaaccacattgttactgccttccaggtcaaaggacatgtgcaattgccaggttcacctacttggtagctccatcaagagctcagtgcagtgattatgtagtatttgtaccaaactcatcttccttctggaaggcccaggcataactccaaaacagatggctctgccttggtttcctccgattccctgttcagtaccatttcccaaaccctggatcacttatttactctctctttggtgcccctgaagtacatcaatgccgtatttgtgtttctaaccctctgataaatctatctcttggaaaagaacagaagatctactcgcagtctggagtaaattagtgcttctgttgaataaagccctatgcagaaggcaagattcttcaagcaaacttccagtcttcatagaagaggccttgggaggaggtaggagagagaagtggctccctcccaacacccctgaaatcccactccctgacttcacccagagacagctgtgcttgtggctttcacctgggtaaggcactgctgccagcagtggttgggcagtattttcactctagatagaaatcccactggggtgagagtagagagaaggaaaccttattttcacctttcatccaggaataaaaatgcatgttcccttctcagacaagaagcaaataaggcctaataattagatattattattaaataatttagcagtgtgctcagtgctgaatctgcaaagatgataaaagcacagtccatttttcatggaggtcagagtccatgtggacgtacacactgaacacttaaaatgctgtagtaattatagtagctaatgtttattgtgtgtttaaccaccagtcgctgatccaagagctttgtaaatgcagtatctcattgaattgccacaaaatcccataagacaagtactattattagatccacttcacagggcagaaaactgaggttcaaagcttaggtaactcaccaaattcttatcactggtagtggaggcaccgagtttgaatccatgtctgaatttgtcactaccctgggataacataggtgacaaagggcatttgagggggtagcatgaggagagaggtcaagtggggatgtttgatccagcccttccacaatcctggagacaggctttgagcctgcaggctgtgaggactcaggcttctcataaagtttgaactgcagatttcccccgggaggaaggctctgatagttttcaagtttcattcaatttcacactgtcactatgtgagctctagggtattttttgggacttgaaatttgatgtattatttatggatcccagaagaaaggaagtaagatttgaggtatgaggatctagaagcttccttctttaaaaaaaaaaaaaagagagcaaatgcttcctctaaatcttataatctcgtttcataatgcagcaattttgggggcaacctttatgaacctcagcagtcacgtagattttaaaaaaaggcacctactgtttaccccaaggtcaagggtgaggactccccagtttctatccagctccgagctctagaagcctgtcagtcaatagggttaacccaacaaatggttaaagacaaccagaaaattccaaacccttgatgagaagaaaagtatagagcagagcaaggctgaaaatagagaaaatgcttttcttgatgttttggtggtaagttttcatgcgcaaagtttaaaaaagaaagtcaagattaagggacacagactaattcatgtatcagtgcaatgtcatttcagattccctgagctatagatagatttgttttcaacattacccataactggtgttggcttttaagagctggaaagaaaatacattccctagtcgagggcagacatgtgatttgtagccatttcatcgaaaatatcacagtggaacaagctatgtttccattctatacaacaacttaattttgataggtcatctttttttaagtaataatagccattctttccctggtgtggggtagaaagatagcagaaaatattctagtaaacaaatagagaagaacaccctcttctcttaccaaataaagcataagaagacacagggagtgaagatgggcctgaagtatcatagttttctttattcaaattcctgtgaaggaaccagataaaaaaatggttagttaccagtctgttaaaatcatgtctttccaatcagtaagaatcaatggatgatatccagttataaatctagtaaaatggtatcccaaaaggccagcctctcctctatatggagcagcccagtcttccagaagcttcatgcacatcatccatagcaatatgcaagccaacatctcaaaacatgctcacaataattccatttatctaactgctttgctttgttatgatcttcttcatttcagcgtcttaaatgatgggcaatgagtgtttgttttggggtttttggaaacgcagtctcactttgtcatccaggctgtagtgcagtggtgcaatctcatctcactgcaacctccacctcctgggttcaagcagttctcccaccttagcttcccaagtagctgggattacaaatgcccatcaccacgcctggctaattttttgtatttttagtagagacaggatttcaccatggtgaccaagctagtttcgaattcctgacttcaggtgatctgcctgcgtcggcctcccaaagtgctgggattacagatgcccagccagcaatgagtattcctttcactcctattatacagatggagaagatgtattttggcagattccaggataactaaacattttgattcaaagccacaaacatatgagattccgcaagtgaaaagaactaaagaatgctcacaattcttcattcaaagatgtcaccagctgcctctttgatcttctagatattgtcattacctacacaataaacctaagaaaaaattaatttcttactattccaaaagagatcaaacaaaaatctgaactctgtccttattgtctcctgtccgatattatttttcccttcctccttaaggcttcccatttcacagagattgtgactttcactatgagacatgtcatgactaattgattttaagatgtgagagaaattttccacatggcctggaaaacagtgttgttacctgtcataagtttggactgcccctccccaaaagacagtcaaggaaatttttttttttttttttggagacagagtcctgctctgtcgcccaggctggagtgcagtggcacgatctcagcttattgcaagctccgcctcccaggtttacaccattctcctgcctcagcctcccaagtagctgggactacaggcgcctgccaccacgcctggctaattttttgtatttttagtagagatggggttttgccgtgttagccacgatggtctcaatctcccgacctcgtgatctgcctgcgtcggcctcccaaagtgctgggattacaggcgtgagccaccacacctggctgagtcaagaaaattttttcaatgtatttatttcacgaaaattccaatcactttattatctctagagattaggaataatcttggtttacttcatcatcttattctttaaagtttttctacattgaacacatatcactaatatcaccagcatggaaaaaatttcactaacattttaaccactctaaaaatttagatcctgaaaattttacatgccctacatttgcataacttatatttgaactttaaagggtaaaaatgctatttcattttagcctcaccaatgttctgggagataaagaaacaatcctttattaagcatcacccaggatgtagatttgcagagaggtctttaaaaacagtaacaggcgggaaacaatggttcacatccagaagcccagcactttgggagaccgaggcaggtgggttgcttgagctcaggagtttgagaccaccctggccaacatggcgagacccccatctctactaaaaacacaaaaattagccaggtgggtgactcattgcctgtaatcccagctacttgtgatacaggagctggaaataaattatttaggcagatagtaagggtaagagagtcctcagtaaggtttccttttaacaaaaagcagccccaaaatcatttctaacaaagagcagcctgtagaatccagctgcagacatagataagcaagctggaagtttccacaggtgaatgccagcagctcggccaataggaaaaggctatctgggggccgggcatgttcaacacggcggctccatcttcccttttctttgtaaccacgtgtacagtaagcaacagactatatggtgctagccaggtagagaatccatctgcataataaaagattaggccagcttcttcaagcactatgcaaacatcacacctggtccaaccaatctctccggccctgtgtaaatcagataccgcctcctcaagttcatatataaaaccctgtgccatttcaccacaaaaccggaagacccactcgggcacccccctctatctgcaggagatagagctaatccgctttctctttcttttgcctattaaacctctgctcttaaactcacttcttgtttgcccaggttttctatttctctaccctgagttgatgacctcgggtatttatcccagacaatgatgccacttcacctgggaggctgaggtgggaggatcacttgagcccaggaggcagaggttgcagccagccatgattgcgccactgcactgcagcctgggtgacagagcgagaccctgtctcaaaaaataaaaataaataataaattaaaattaaaaataaaaacagtaacagagtggtatggcaggtaggcttggagtcagaaagctggcctagcaacgcagcactgctctctatagctatgtggctatggatatactacttcatctttcggtgccttagtctcctcacatggaaaacacatagccattgctcaataataagtttgtcctcttggccaggcacggtggctcaggcctgtaatcccagcactttgggaggctgaggcaggcagatcacaaggtcagcagttcgagacaagcctggtcaacatagtgaaaccccgtctctactaaaaatacaaaaattagccagaagtggcagtaggtgcctgtagtcccagctacttgggaggctgaggcaggagaattgcttgaacctggaaggcagaggttgcagtgagttgagactgggccattgtactccagcctgggtgatggaacgagactctgtctaaaaaaaaaaaaaaaaaaagaaaaaaagaaaaagtttgtgctcctatgattttctcagatataatgagctgggaattgttcttctcattttgtaggtgagaaaattgaggttaaaagtcaagcaatttgcctaaagacatacagctaggaagtgacattaccttgcctccaaccagattatcaattccagagtttaaactctggaatttcaactcttgctactgtgctttatatagtttgatagctacctagatgtagatgtatgacatagagcatggacagagatagagctgtagagatatacaaatatcatgtatgtatgtatatatatttatacatgctatataaattaagcaacttgccctgaaattccacaactattttaaggaaaagctaggattaaaacccttcaggactccaagattcataaattccttgcatgtttaaaaattagcttttgcaacataattaatttggttgacatatctaaacatcattttagaattaactcatagttaaacaagacattactgctttagagtacttatttggtttggaaacacatagaaacaagtaacaacctcagattctagcatattgcaagatgatattatcaattataaatgaataaattaagtctaacaaactagttttctgtaatattagcaaaatgtacacggtcagctatcaacctgtatttgcttaatacaagtaaaaatataggcaataatgacacattgggagatctttctccttaaactcctcagcattcaagatctttcaaatgctgctcccaactcttccagccttatctgccactcccttcccacacccagtcacacctccacccagatggactttgcaccctgagctctctggcagccaagctctcacccctgctgctctccctgcctggcacaaggcctggcccagagaaaatggacaatggatatttgcttaatgaggttggatggagatgtttcctcatttctgcttctcacatcttaccatctaagttcaacttaattatttaaatagcaatgaactacaccacttctagtatgtcccagataccgtgccaagaactggggtaccaaaataaggggtacaggttctatcttcatggagctaggacctaaaccctacttccttcatgaaatcttccttgatttccagccagtctcttcctctcagagccagttctgattgatatatatatatatatatatatatatatatatatatatatatatatttttttttttttatcatttgtctgttagcattactgccactattaaataaaatccttaagggcagaggccttatttttaacttatcaggtctcttcatactatcccttgcatatatcaagccatcatcagatgttgggtaaattctaaaacatttatgattacctaacatggatatcttattaatttgttctcacctgtaagagctttcaataaacatgatatattaaaggaaactcattcaacattcaaagctttattgtgtaatacatttttattgttgatgaaaagagttgtttctcctttgaatacactaacagatttctgctcagtaaataacccagaactggtcgaactagatcatctcttcttgaactaatttttttttttttaacaccttcagtcttccagaaaaacacaagttaaatgatagaaaagcaaataaaaataaaaggaatgccttattttggtcagatgctcagagagatcactgtctgggatgtttcaatggaacctaggaagtagaaggagaaatgtacttatcctttattttgtcatttacatttaggcctgcccctcaccgagggtttccagtgggaagtagaagtcactgctttccattgccacacgtagggtgccatgatttatttgaagacaaatctaccacaccatgcggttgttaggagcatagacccaggagttagactggctggcttgggtcttaactcctccaccggctgactcgtggccctatctactcatctataaagcagggataataataataatacctaccttcgagagttaagagattcagcgagttaatatttggaatactgttggccaaaaattcattttgccactcacgtttgcttagtcaaaactgtaaacattgtccaacaggacatttctcttcacaattcccaacttttggtggcccactaatgaaaatattctaaaaacagcctacacaggaacatcctcacagccaaatgaggcagcaaggcaaagcctttacccgaatgattcaaggcaaactacactagtgctaggattatgtcaaaagaggactttggtctctcaaacaggtcccacctacacttcctccttccatggacacaataccattcaagtgtggggtaccctgggtcgcaatggtgctgatgggaagccatccttcatcactgaaattgcccgaaaccaccaagccagacacctaggtttcctcaaaaacactacttggaaaagaattgaaatagatttccagaggattctgtggcattttatctgaactacctgtaataattggccaaccgtctgcgtggaatttttgccgtttgtcaggatttccctcagatacaaggactaaattcagacagttactacagcaattatttgagagaccaagcacaccctttgcaacatagatcagagggttattattattatcttttgtttttttttttttttttttttttttttttttacaaaaaaaggagttttgaaaagaaggcctcggttcccaaactgtggctgcccctcacccaatgggcaccaccatgaccaccacttgctcaacagtagaccagggcacctgcttgcagacgggaaccagggctgctgggcttgctctgcaggaacagtgcctcattttaatctaccacacaacagaagacatgggaatcccgccgcggcctggatctgcatccagcccggataacgacaaaggcagcaaacattgactgaaaacaatttgctgcatgcaccgataagacttggtggtgaaaaactatcttgctgatttctcagaacaactctatggagcagatgctattataatatacctcttaaagatgaaatgaaaaatcaaacgatgaagaccacagaaattaagagacttgcccaaggtcacaatgccaggctaattttcactccctctgaaacacaaatatcctgatgatgagacaccaagtatcatttaatccactacagatctttccaaaatgttgaaaaggttttttccccctactttgcagctgctctttttttcagatgctgacatgacctgccccgacctgcctggaggaaaaggctgccttggtctgggaagttttgtttctactgcaaatgtatctctgtgtctcactatttctcctcatttctgtgcttcaccttaggaatcttcccttttttaaatcaatccaaatgctatgggtagaattgtgtctccctccccctcaaaaagcatatgttggagtcctaacttccaagcacctcagaatgtgactttatttggagtctttacagaggtaacgaagttaaaatgaggttgttagagtgggctctaatccacaatgactgatgtccttctaagaagagatttggagacaggctcatccacaaagaaagaacactgtgtgaatgtacagacagccatctacaagccaaggagagaggtgcacagaagatccttccttcacagctctcaggaggaaccaaccctactgccctcttgattttggacttctggtcaccagaactgagatggtaaatatctgctgtttaagcctcccgttctgtggtattttgttaaggcagccctagcaaatgaagaccccatggaacttttgtttagcctgtgctgctgtcccaggacagaggtggcctcacagggggctctgctcagtcattagacacctagggaccccccgcatcccagcagcccacccaaggcttccttgattctcccaccaggctccaagctcccaaggggattaacggcattcatttatttttttttagttacataattaggttcttcttaagaaatttagaacaccaatttgtgaggataaattccattcaccagggcacacacagattgcaggtagccctggagctgaggaatagctttgagttttggtaaaatttgccagtccatggttttctgatcagccttgcactgctttgtagtcttacatttctctttttctgtcaaagatctcaccctcctactgactaggcttccacaactgcttcttaaagtaggcattggtaagatgttttgggtttctcacactgctggtatcgattttttttttttttttgagacagtcttgctctgatgcccaggctggagtgcaatgacgccatctcagctcactgcaacctccagctcccaggttcaagtgattctcatgcctcagcctctcaagtagctgggattacaggtgtgtgccaccatacccggctaatttttgtatttttaatggagacggaggtttcgccatgttggccaggttggtctcgaactcctggcctcaagtgatccacccaccttgacctcccagagtgctgggattataggtgtgagccactgcacccagtcctgatatcaatttttatggaggtggtgatgacaaatttctggtgtgtccttcacagaggaactccatggaagaccagaggtccagccacaagtaacaagctactgcccagctgctccaggaaaaccaccctcctgccttggtggcaccaagggaggatgagcagaatggtctcgagggccgtgctggctccaagttttctcacatgctgactgcagagtttcttgcgatggctggacagcttttgaggcacatctctgttggataatatcaaggcattttgtgaagtttaaatagccaggcatcaccattcttgtcacctcaactgggtttgtaacggttgcgagattcttttcaatcttgggtttagcagctaagtacctcctctcgtacatggcctttctggaatacatagcagatcaggaatatctgccaattcctccaatgaggacaggattttgggcttccccttcttgggctttttagctctgaggttccccttttcaccttgccactggcaaagccttgttagcttcaggtttcttctccttagtatccggcttctcaactttttcacccaccatcttgcaagatgggaaggtgatgtttagacgctcttgtcatttacccatttatttgagtaaggacaaggagtttctacgtcccagatctccagatttacaagtcaacacataagcattgatttttgtcccccgtgaaaaaagctaagtgatagacaaatcttagagtcagtcatctcttatttatttattttttaaaaagcatgaagggctttgaattaaaataattcacctagcactaaggctgagccatgaagcttcaaagaacaaagaagttgcagaaggagagagctacagaatttgttttcaaatatcctaaggtagtgtgggcaggaagggatgtgactggaattcataacaccaccaggaccaaacagtgccaaatatcctgtgagccatttatttttcctcctcactgtatattgctaagagcggcataaattataaggcaaggccagatagatataaagatcagatgaaaatctcgcccaaaccatttttcatcgattaatgttcagatctgccacgcccatctttttggtctggctcacagatctctggcaccaattgcatcactcaaggtttagagaaccgcagaagcatctgaccaatttgcacttttgacaaattaaggacccaattaaagtggccattaataagctagaaacaagcagacaggtataaatctgggcttctgcctcacacttcaaacagattactccacatggggagggaatgggcagctggatgatttgtttttagagcagagaggaagacagggaagaaggaaggaaaggagggagggagggatgaacatacatacataaacataagcccagctttctgtcactaaactctgtaatatagatatgccaatctttcagtatatgaaaatctggatttacacacatgcaaaattagaggtgatgatttgttctaccaataggttcatgatagggaagatgggctcacgggaggctaaatggtcccctggagaacttaaaatggtttagattgatataatcaattataatacacattactagcataattattctttttttaaaaaatgtttgtctcactttttctttttttaaaaattttactttaagttctgggatacatgtgcagaacatgcaggtttgttatataggtatagacgtgccatggtggtttgctgcacccatcaacccgtcatttaggttttagccccacatgcattagggatttgtcctaatactctccctccgcttgcctcccaccccaggacaggccccgatgtgtgatgttcccctgtgtcatgtgttctcattgttaactcccccttatgagtgagaacatgcagagtttggttttctgttcctgtgttagtttgctgagaatgatggttcccagcttcatccatgtccctgaaaaggacatgaaatcattcttttttatggctgcatagtattccatggtgtatatgtgccacattttcttaatccagtctatcattgatgggcattttggttggctccaagtctttgctattgtaaatagtgctgcaataaacacacgtgtacatgtgtctttatagtagaatgatttataatcctttgggtatatacccagtaatgggattactagcataattattcttattaaagaaaagaataacaagttccaagaaatatttgagagaggtgtcatgttgttcctggttggcgtttgttcccccagtgctccccaagacagagcaagggaaggatcagctggggagaagaggcctctcctccaagtctcccaaaacatcccagcattgaatggaaggggggccagagcagtcacaggaaagggagccactgacctagggacaacagtgactgtcccaccagggcacttgcctgatgttgtaacccatttatacctgaggttgcaattttttgaatttttgcaatcagaccttgacgatgaccttgtgcagaaggatataaataactcccacatgcttagtgttccaataatggaacactaggcataaatgggttttaagcaggtagccaggaagaatttcagcattgacttccctcacgtgtgcagctatatacccgcaaaaaccctagaaggtggcagggggagaccctttctcccccagatctagcagaacaatatcacaagcatcttccctggactaaagaggaggactggaatcactatttctcataaagggtggcttgacttttttttgacaaagtgtttctttatgtattacacaacatttctttatgtaatataaagtttacggatgagcattttgtcaagataataaagcaacacatcctggccttagaaattcagtaggaagtaaatctaaattaggttccatcccataggatttagacactgaaggatcgaaagaaagaaagaaaagagaagagaagagaaagaaaaatactctaataccagttcatttgcaaagtgacccaaggcaggaattttaatgccaagaatgtgcagtcatgcttaagtatggcaggttcactttccaatttctgtaattaaatcgtaactgacaactgggatgggtaggagaggaagggaaaataaatttaattctgcttaataaaaggtgccagaccacgatgaaatctcattcatgaattgtttttttttttaatcattggaattgttttaaaaaatagcaaatgctcaacaaatgcaagctaagttaaacactttggacaacttacttgaacaacacaatcatataatgtgggtcctgttgttatcccacagagcaggaaactgatgcttagagcgcttgaggaagtggtgtgaatgcaggggccaagcaccaagccactctgctagatggcctcttggtgaggaagagaactcatctttagcttagatgttaagggaacaaatctaccatttccattctcctcatccgtcacttaagaacaagtcctaatatttttaagtaataagtatatggtcaaaaatgaataactcagaaatatcatgaatgagagaattccatgtcagtcttacagaatatttgaagagaaattttctttgtaccacatacacaaaaatcaagcatagcttagcttgttacgtattgcttaagtgaaaaaaaaaaatcaactttagtgtagttaatacctcagccactaggggaatatctgcttttattaagttaatatttcttgtacctaagtaaacattccttcttcttcctgtctgttcttacaagtaacaaataagtagataggtattcccttaaaattccgtgtgtctttctttggataatcaacgagcagttacagaacaactagccccattctaaatctgataccagagatttctgaatcaatgcaattttatgtcaaatctatacatctctacccatgtgaaccagcttctgttcaagcactgtttgtcggcctccagagcaaggagcatgacaatgcccagctttcctcctcagagctgttgctgttaatgtggaagaaaaatgagggacacatccttctagacattttttttgacaatggaacgagaagtagagtttctgccaggatatattttgcacatcatccagattttttttttttttttttttgagacaggttctcactctgtcacccaggctggaatgcagtggcacaatcatgactcactgcagcctcaacctcctgggcttaaggaatcctctcacctcagcctcccaagtcgctaggactataggtaagtgccatcatgcctggctaatttttaattttcttgtacagtctggatctccctatgttcagaccttccaggctggtcttgaactccagcacaagcggttctccctcctcagcttctcaaagtactggaattacaggaatgacccaccacacccagccatattttgccttttgtatgagaaaggaggaggtaccggaaatgtaaccttcaccttgaacagtgatgacttttttcaggggtcatctgggtgagtttcaaaggatgccccacctgcacctcacccaaagacttatatgggaaccatgagaggggctttaaaatgctatatatatagcaaaaccaatagttttattattctcatatttttgaatcctacttcctgaacatagaattagttcctctcttgcataatggtagatgctatttttatggcatcactgatttttttcttatttttctaaagaatgaaacaaaaatttctcaattcatcctgagtcacctacttgaactttctcatggaacagagcgctaacattcactggatgtgtaccatgcaccaagcaacatagtaagctctttacctacttatctaatttacttctcacaactacctagttaggcaagtctctagtggcagctctctgttctgtgcccacaggttggaaaatgatgaaactggcctaacccatttggccaaccctgaagactcatatggccccgtaactcactagaaaccctctctcagtaaaggactcgctttgtttcctggtgagagctgaatagcattcatcttcctttcatctaaacatgtgttttttcttcttctttcaaataatgcctcatttgctatttaagcttttgaagaaaaataaagacaagaaaatattagagaaggcactgtccttccaatctgctgcttggcatcccctaccacagagggcatctgtccctataaagtcacctgtcataaaagaccaagacagaggcaaatatcggaccattgaagataccaataagctgtgtgtggcttaacataaaaataaccacacattagcaggtggtaactccaccaccaaggccaaaagcagcccaggaagctgattaacacgcacatcagcctcttctctcacttgtgaaggcaggtctgtctgtcttcaattcttattctagtacttttacaaaaagacttttcttcttctctgcatgttccctcccttgctgtgtcctagacaattctaagaatcccaaattgaatctcattctctgagaagtagatagaatgacatgctttttgagaatgtgattccaaccccaatttctagaatacaagagccctagagcatcttaagaccagggacttttatatactcatcacaaagaatggatgtgatacttgtttaaacatcagagaactcaatttcccctttaattccactgccaagcttgatttcactgcagccacttcatcaaatgaatttataaaatatggaccaatgaaaagaaactacaaaaaaaaattgtgctccataagcaaaacttgtcatgccagcaacaaatttcccttctccgcatctgcatagcccacctcaaggaacaaatttgtcaagcaactttttaagtgccctccccctccatctactttgtccttctggaataaatacgttactgacacagttaagacatgtcagcccttacctttctgtaagtcacaaaatggtggttaaaagtccttttcttccattcagtggtcgagactcttgctacgactggagtatctcccccgggaacactccctcttccctgctttgcctcccagcctctcccttcagcttcagtcaaacattaaccattaacattttttattgctcttcgagagccactgggtatcataaaaagtgtcattacttttactccaggaaagaaatgactttgtatcaaaagaagtttaacttacatctaatccatctcaaaacaggttgctacatttttcaatgtagatgagtcaatgaaaagacaagaagttagagtggaaaagtttttgtgtatccaactatctctagagtgtgaggttcatgacatcaaagactttccatattttgtacccccaacacttagcacaggagacttgatcagcaaatatttatgtagattccatctcaaacacaaaagacggagcaggggcgccatgtctgagcaatgacacagttcattgataaccagccacatgagatatcataaatgactcagaagacatgaggaaagacacaatatggctgtgcctgcttttgaaatccaagggtcccttccaaagtctgcaagaaacaaccgatagcaaatttcccccaaacacaaaccaagtccttttttcccccccacaattcagggaatggatttacctaggaacaacttatttttccccaatcaaaatgaggtttttgattaaccaataaaagccaatgcccccagatttctcaagtcaaggcttcttttagaccaattcctgatttccacactttggtcactctgggaatccacactgaaggtgagcatcaatgtcatgtctgtgtctggtgtgttacacttggccctgtttctgtggaccttctcatgttcatttcttggcttctcctgagctgaggttgtgttttccattcctctccaggtgtgcatctgacagagggaaagcaagagagcccagcccactctctagaagggctccctcctttccagatttcatgagaaggtttcatgagtgctctaagccactgtgggaatagacctcatttatcctgaggaccctgcaagtgaaaccatctagttgcatgccagctgttaacatccttggtggactggtgggttcagcaaaggcccttcttgctttgtcccacagccagcatcactcatttagaagaatgaggttattgaggctaagcacttctcacattcttcacacctctgccctcccattagctgaataaagtgtgcttgttctacaaaatcaaatcgcttccacttgccacatgtttcagttcctggaatcaagggcaagcatctcatcacacagcattgttcataaagaagtttgggtcttctttgaaaattttaaaataataaagtgcttttaaatttatgagtttttttttttcaaaaataaagtgcatatgtatcatttatagtcattgtttttcagcaacaataacaatgatcgtgacatgttggtatatcaattaaaattctgttttctcatttagcatgtctgcaaagtagattccagtttatagacagaaaatggggacacagagaggttttatttcttgtctaagtcacacagcctttgactacagaatcgggactgcaaccctgttctgattcaaatcccatcctattcactacagctatagactctgccagatttttttccttccagctttatgcgagtaaaaaaaaaaaaaaaaaaaaaaaaaaaagtccaagggcagaaatccctgcatgagcccattcctgttggaagatggccaagttccgaaatggggttcctctgtacatcacttgctatctctagcccccagcttccagctcaaagaattaggttaattaaacactgaaaatgcctaaaccacccatcagagaaattaacaggtgattattgcatttctgaattacagaagctatttctgtactgtgggataccaggttaacaagattctgagagctgttcatatattccttacatggtttagacatccttccagattaaatccaaatgttaagaatgtgcacgtttcaggtagccaccactgcattttaggaactcattttcatgaaaagtgagacattgctggttcaatagacttgctaataataggaataaggaaaatgtaattgataaatattactgatttaattttccaaagcaaaggaggtatgatttataggatgaaaacaactgaaggccaggcgcagtggctcacacctgtaatcccagcactttgggaggctgaggcaggcagattacctgaggtcaggagtttgagaccagcctgtccaacatggtgaaacctcatctctactaaaaatgcaaaaattagccaggtgtggtggcaggtgcctgtaatcccagctactcaggaggctgactcaggagaatcatttgaacctgggaggtggaggttgcattgagccgagattgcaccactgcactccagcctagccgacagagcaagactgcatctcaaaaaaaaaaaaaaaaaagaaaacaaaactgaacaagtgaaaggacttgggctaatgctttcaactcacagcttcatggtggtgaaaacatttcaacgcttttgtctataatgttttaagcattcctccaatattatccctagaaaatacaaatgtccataaataagtaattaatttatggacatttgtaagaaagtctagatagcctcccagacaaaaaagttatgaaaacttggaattattcctaaaagtcaaagcatgttacatttctaatatttatattcttttttattttattttatttattttttgagatggagtcttgatgtccccaaggctggagtgcaatggcacaatctcagctcactgcaacctccgcctcccagtttcaagtgattctcctgcctcagcctcccatgtagctgggattacaggtgcccaccaccacacccggctaattttttatatttttagtagagacggggtttaaccatgttggccagtctggtcttgagctcctgacctcaggtgatctgcctgccttggcctcccaaagtgctgggattacaggcatgagccactgctcctggcctatttttattctttaaaactcaaaatgaaatctatgagtggtaaatttctcaatttttcaagtacttgcattttatgttctttatgtgttacatactacacattcagaatattttatcatgagtccatcaacacacaaccctcacctaacagaagtgtaaaataatattttaattacttaatatctgtcttgctctgttaacttgatgatggcagaaactttgtcttcaattagtactcaataagtacttcttaggactcaactccattcagttatttaattcaataattctaaatagtcatgattacctgcaggctcaaccaaggccaataggaacccagaaaagcaaataattttgaaccccctgaaacctagagttcacagtttttgttccacatttatttagtggaatgaagtgaaactaattttctgctagtcattgttttaggctgaagcagaatctttcttaactacttttgctggccaggacagagtccattttctgataaatttaagcaaaacaggtcttacttccatgtagctcttacttttttggagacagggtctcgctctgtcacaggctgacaggctggagtgcagtggtgcgatctcggctcaccgcagccttggcccttcaggctcaagccatcctcccacctaagcctcccaagtagctgggactacaggcacacaccaccatatcccattttttttgtagagatggggtttcatccatccaggctggactccaactcctggggtctaagatctgcccacctcagcctcttaaaatgctgggaatacaagtgtaaggcactgcgcctggcctatacttacttctgagtttgggtttggggtttttgtttggaggcttctctgttgttgagttttttttttttggcagttttccaaaccagaacacttgagagaattatcacaagatttaaaacttagataacaaaatgaatcactagttctaagtaagaaacactgaatcatacataatgctgtttaaaaatcttagctgacagccaccttgcgatattctgaaaaatatttaaggaagatagtttgaggttagtaaagattttcttccccactatctactctgacagaagtggacccactttgtactttgtttattccaggaagatttttaacttcatctatagatgctggctccaagcaactgcccagcaggcggggccctcaatctggctccagctacgcatgccatgaagtggctggagaatctcatgaatgggatggctagtaagtattcacatcatcagttgtacattggacaaatgccttccaggtctttccaaactgaagttcactaaaactggggcttacactatgaaatcctggttcagggtatgtccctgggtcccttgctctgttgcccaagctagactgcagcatgtaatcatggctcactgcagcctcgacttcctgggcgtaagtaatcctcctgcctcagcctccaaagtagctaggactacaggcaagtgccaccacaccagctaattttaaaattttttgtagagataggttctatgttgctcaggctgctcttgaactcctgagctcaagtgattctcctgcctcggtctcccaaagtgctggtattacagatgtgagccaccatgcctggctggcactctggatttctgatgcaggtgattacataggcccttctgagaaacactagcttaaggaatcattgctttatcctccagtaaatattcttcagcaaagcctattctgaattgagattaattaccccaccatgtagaacccatttctgcaggaatgtctgagataatgatgcagtcggtctgatgttgaacatgcaagctggatctggtagacatgagcatgctcatcttccctcagacatttttttctcagacagctaagctttttatttgatcttggattttctttaaattccaagaaatgaccatcattcttattggttttctgagacctatctctgtctcttatcagatttcacctaacaagcttttgctcccatccagctcatgctcagatcacagtgtctggcttccatcttcactgctccactgaaaccaccctcaccgaggttgccaacaacctcctcatgataatcagatggacgcttttcagtctgcacctcacctgacctctcacaactttcaacaccatggcgagctctcctcaaatttccctttaccccggcttccttgccaatactctgattttccttccacctcttgagctagtcccttgcagtcctacttgtgactcatccaactccttgggcccaatcccaggttatcctgtcctgtcactcactctgtggaggtcaactctgctcccatctacttgccaacatctcgagtctctctctagaccagatctctcctctggtcaaagctctggttttctatatccaactgactattccacaacttcgccaaggtgtcccatgtgcacaacaaactccacacagccatagtgaactgtactgttttaattctccaaaacatacgcctcctagaacactaccccttcatgttagccctggtggtcatcaccacttagccagacagtgtgcagtgactgcctaggaagtactgtcatggggtcaagtaggagaccagcatgcatgtgagctttgcttggaaggactcagacttggacactaaggcttattaaatggtcccccttctgtgcctgtgggtctctcattagacaccaaaacaggattgcctctggaaattctgcccttaagagaagtatttcctgggaaagaatactctttttagtaaattgtgaaattgatcttcacatgcaaaacaatgaaactggaccctgacctcacaccattcagaaaaattaaaatatatcaaagacataaattataagggctgaaactataaaattctaagaagaaagcaggggtaaatctttatggccttggattaggaaatgatgtcttagctatgacaccaaaagcacaaataacaatagaaaaaaaaacaaattggactggacttaatcaaaattaagaacttttgtgattcaaaaaacaccgttaagaaagtgaaagacaattcatagaaggaaagaaaatatttgtaagtcgcgtatctgacaaatgaactgtatctagaagatataaacaactcttacagcaacccaatcaaaaaataaaggatctgaatagaaattttttaaaagatatacaaatagctaaaaagcacatgaaaagatgctcatccttaggcataagcaaaatgcaaatcaaaaccacaataagatggcatttcatacccaccagggtgtttcatacccaccaggacagctataataaaaaagagataatacccagtgttgaagatgatgtggagaaattagaatcctcatatgcttctggtgggaatgtaaaataacacaaccactttggtaaacagtctgggagttttaacaaaaacttaaatatagagttaccatttgacttagcaatttcactcctaggtatatagccaagagaaataaaaacatcacacaaaaacttgtacacaaatattcatagcagcattattcataatagccaagagatagaaacaacccaaatattcatcaactgatggataaaatgtggtatccatatgatagaatatttgtctatccatataatagaatattcatataaaaagatatgaaatactgatactacaagactaaaccttgaaaacattatgcttagtgaaaaaagtcagacaaaaaaagcctaatattatataatccactcacatgaaatgtctggaataggcaagtccatagacagagaaagaagatttcggagttgcctgcagttggggggcagagggggaatttagagctgagagctaaaagacatggggctgcttttgaaagtgatgaacattttctaagttttattgtggtggtggttgcacaactctgagaatacactaaaaactactgaattgtgcactttaagttggtaagctgtatgatatgtcaattatatctcaataaagctgttcttaaaaaaagtattccctgcaactaatgcatattcactgcaaaataatgaaattgaactgacataaatatacaaaacataggctaaacattttcagttacctcggtctaggcccttcagatcattttgttctattatcggaaatgtcttacggtttccaaaatcatttattttcctttaagtatacgaggttttttttttttttttaactaattttacctattatttgacctcttttgttttttgtgtttttaaaatgtgaataagaacatttcagtacacaaagattatctttgccctggataaagtagaaaatgacaatgtgggcataatggcccctcagcccctctgatagtgtctcagcccaggcagttcagccctagataaacttgactcaactgcctgcctgaacgaagactattttctttctacatgactaaacctagtaactcaggagacaaggaggccaaattctcctccctttagttttcccactcaggattacattgggcctggtctcaggaacaatccaggagtttctggaaaagccatgttatcttcaaactagaattttccaatagctacaggaggaaacacaggaaatgaaagctcacatctgcaatctgtgtaattcccttgccttgggtggtccacaggagcagcccacagtgcagtggaggaggaggggagaacagaagccctgcttgggagagaccatctggctctatcaatgagcctcagccagcgtcagatcccttctaaggaggcctgggaggaggccggcggaggaccctcacttccttgctggagtctcacttagcccacatgctcctgctttaaacctgattagatagaccagcttctcaaaaagggagggctccagagggtttgttttttttttttttttaattctcagatcttcccaagtctgctctcctaagtatgagaaacaaagggaattgcctagaaccaggactatatctaaagggatttacaggacagaggtagctgtacttcttctaagttaccactttatactaaagaaaatcaatggtagttaactacacaatacttgactagaagttatccaaactccactcctcttctttatctctaaagagaggtttttctcagtacaaataagtttttagtacaggggttctcaacgctggccgcatagagccactgggattgtgatttgactggtctttggtgaagcctggcagcagtcattcttaaagtttcccttggttccaacgtgcagccgaggttgagaactgctggcttggtgtctaccctctaccaagcaattttgctctgcatctcaatcttcacagcaacacgggaaggtatttttactactttacaaataaataaatacaggagcaaagaagatacaaatcgattctctcagatttgaatccggatctgattcaaaaaataataagaataaagcctgagctgctaccctcggcaaagctcccgtagcagccgctgagtgagcctcctgcccagctctacttacctcccaggagccccaatcagacaagcgggggtggggggactcaagtccactaagcagattgatcaactcagatccacagccaaaatatcatacttccaccgtgatt

SEQ ID NO: 1016 - DNA, 81422 bp, Homo sapiens
caaacaaaactgactacaaccagtgtttattcttgatttgtcaccactcttttcatgtcttgttttcttccacatgttaaatatataataaccaaaactttactaacatacgaatgaagaaaacatgcgcagcatgtatgcatggcaggtagtgaggaaatctggccagctgactggttcctttaccaaggtttgcagagtaggttgtgtttgaacaccttctgtgggtctgtgtcatttccaagttgaagaatttcagccaaagagcaacatgtcacattgattaaagatggttaatgacacagaaacatttctgttaatactaagggaaaaggctgttcttttatttatttatttttcctgagtcctcacgtttttcttctctgacaaatgtttgaaattcagtgaaataccaaaggagtcaaggatgaaggggacacaggatggaatcagaaaaaacataaatggaatccaggcagttctatgagacaacactgatatatctccttgataaagaaaaaatgtacagaatatttaatgagtctgtcttgccccaaaagggaaaaacacaagtagctaagccatttgcagagaggaaaaatgtcatggaaaaatgaaaaatctctctaatgtctatagcacatgaaatatctaagtaggtgggtgcagtggttcatgcctgtattgggagaccaaggcaggcagatcacttgacgtcaggagttcaagaccagcctggccaaatggcgaaaccccgtctctattaaaaatacaaaaattagctgggcatggtggtgggtgcctgtaaacccagctacttaggaagctgaggcaggagaatcatgtgaacccaggaggcggaggttgcagtgagctgggatcacaccactgtactccagcctgggcgacagagcaagactccacctcaaaaaagaaatatttagcaaatattaaaggacaagagggaatatctgtttaaaaaattataatgcacgttagatgaaaagtaataggatgagatggttgttgctgaaatagcacttgctatataaattcaaacattccttttcaaattcagcttctcagaggtttgacttcagatgcttgagcactttcaacattatctttgcctttatccttctttatgcggataaacacaactgctaaaattatacctaaaagaaaaaacccagggtcaaataaatgggaccttttaaaatgtactgtcacattcagttataaagtagtattgtggtaggaaaaaaatgactcaacttcatttttgtatgtgattcaacaaaatttcactgtcctagtgaataagggactctagtcgttggccttcttggagaaatgagcttatcatttatcctgttgtatgtatgtatcaagtcccaaatcatagctgacttggtggctctcactggatctcgctgtaagaatataggacctaatgttccacactatggagtgtatatgtcccacactatagagtgtataagcacctgacaaagttcctgaactttatatatacttaatattgattctattcttcccctttcctagagaaaacaatccaattagcacaactagaaagctgttctctgacctgttcacctccctgaagctgattttcatcgtgtccataccaactatcgcatttccttgggcgccttcctcctggatcctgcctatgttgttgtgggaccctgggtagactacttaaccttcttggtttctcccacctgatacatcaaaattacactgtgcagctcagcactgattgtgtactgtcagagtccactatgaagaaggagttgttttaaggaaattaacctgctagtaagtttataggaggaatcatggcagaaaagtctggatgctcagaaacttataattccaaccctatcttgaaaataaggtcatgaaactgtaaaatcctattacttctatttctggatgtccccaaactcaagcagtctttaacttgtggtaagattatggaattaaattgatacgttaagaaaattgctatctgatttgtaaattcaaaaatcctttcaaggtgggagggcaaatagaataagaaaaggcacagaggcagaagggacctatgtaagtgagtgggacctcaaaaagacagctcaattaccatgaaaagtgtgcagtagatagtggttctcagggaggaaagatgatcaccatgcacacattaggatgggaagtggccatgacatgaaggccctcccatgccatagggagtccagactgaagggtataaagaagtgagaccccctttagatgcatgaatcagagtccagtgtgacacactggatcatgggagaaaagatcagatgctgagagaacaatcaataatacttagaataatcctagtccttcttttaaaagaaaaaggatatgaaaccataaaccccttcactcaggtacacatgaaataatgaagtatctattcctaatgtttaacttgtggtggggacaacagttgaaagagggcaattactatataggttgagtatccttaatctgaaaatctcaaatctgaaacttttggggtaccaacttgatgtcacaagcataaaattctacacctgacctcatgtgacaggttgcaggcaaaactttgtttcatacacaatattatttaaaatattgtatgaaataccttcagactacgtgtataaaatgtttatgaatcacgtgaattttgtgttgagacttgggtctcatccccaagatatctcatcgtgtatttgcaaatgttcaaaaatctggaaaaaacccaaaatctgaaacacttctgctctcaagcattttgggtaaggaaacacttggaataggcactgagttgtttgcaaaaaagaaaaagacagctagatcaggggactgtactgtctagccaagcaaggggctatggcagaggctgtggtcatgatgcaatgggttattctgggtagtaaagaatcagggttctatgcatagggaagttctgcactacacatttcagatatctcagcatcgccactggaaggctaacttctgcctgtaacaacaatggcaggtgagaccataaactctggtgtaggatctgtgtatgtcactctttccccatcaagcacagtgcctgacacatggcacagctactgcatttcttccctctttatcacaaaagctttgtaactaggcataatatatgacaattgatgaccataaagccccttatatttctaaactaataaggcaatagagacagagggtagtactaaagctgtaactccaatcaagaaagtctgatgtaatttgctggtgatctaccttctgggctattgcctgagttgccatttgagcagccaccagaccagtccaggaagacaggccctgagatgagctcacatttctgaggcccaggataagactctttgaattaagaaattacactcaccaatcaccagaagggtggtcagcagtataccaactgccatgcccacagtgggtatcccagtctggtgacctgctggccggaaacaacttccttccacacaactgcagaatgtaactgaaaagcaggacagtatttggtaggataaattctcaagtgaatagttgcagaatcccatatcaaagacaagaatctcctcaaacggcccatggtgacagatactagcctgagttgcctatagcagaatatctacctggtaaagaaacaatgccttccaagggtggccgacccccatcattgatgcggatcaagacgacatactccctctcctcaaactctgtgtgcctggtagacagtcgggcatgagtacctgccaggacaggaaaaaaaaatgaaaatacaacttcagaccctggattagcaggaataaagctcattttgtatcacatactaaggttgactggaacatggctagatatgagttaaactgcccaaagtatcatccacatcattccacatgtatcttcccataaggtaagaaagggctaaagcatcctttaagttcttaattcatgatttctctgtagaaatttatactaaatatagtcaattatcatttgtagcacttatgctctataaagttgccccaaacactgaattaatgaatgctgaaccattgctcctagaggaaagacagggttaggtttctgtgagcttctagtcatattttccccaactgatcaatacataaccttgctttttgtgtgttgctgttcaaagatatcttatttaacatatattgttcattctaacatttaactcacatctaacagcactagaacttcctgaacaaagcttatcaaacacacatatttaggttggtggaaaataattgcagttttggacattacttttaatttgtgtcccaaaccacaatttttccctgtaaggcacacatcacagccttcctgtgcttaggaattctagatagcacttcagcactatagttcaaagccatttttttttttatcatgggtcatcttttaggtttgaccctgtgtggttttttttaatactttgtgcacatgtaccctagaacttaatgtgcaggtttgatacgtaggtatacatgtgtcatgttgatttgctgtactcatcaactcgtcatttacattaggtatttctcctaatgctatcctcccccagacccccaccccctgacaggctctggtgtgtgatgttccccgccctgtgaccaagtgttctcattgttcaattcccacctatgagtgagaacatgcagtgtttggtgttatgtccttgtgatagtttgctgagaatgatggtttccagcttcatccatgtccctgcaaaggacatggactcatccttttttatggctgcataatattccatggtgtatatgtgccacattttcttaatccagtctatcattgatggacattttggttggttccaagtctttgctcttgtgaatagtgccacaataaacatacgtgtgcacgtgtctttatagtagcatggtttataatcctttgggtatatacccagtaatggaattgctgggtcaaatggtctttcaggttctgtatccttgaggaatcaccacactgtcttccacaatggttgaactaatttacactcccaccaacagtgtaaaagtgttcctatttctccacatcctctcctgcaactgttgtttcctgactttttaatgatcacccttctaactggtgtgagatggtatctcattgtggttttgatttgcatttctctgatgaccagtgatgatcatgttgatgtgtctgttagctgcataaatgtcttttgagaagtgtctgttcatatctgttgcccactttttgatggggtcgtttttttcttgtaaatttgtttgagttctttgtagattctggatattagccctttgtcagatgggtagattgcagaaatgttcttccattctgtatgttgcctgttcactctgatggtagtttcttttgctgtgcagaagctctttagtttaattagatcccatttgtcaagtttgtcttttgttgccattgcttttggtgttttagtcatgaagtccttgcccacgcctgtcttctgaatggtattgcctcggttttcttctagggattttatggttttaggtctaacatttaagtctttaatccatcttgaattaatttttgtgtaaggtgtaaggaatggatccagtttcagctttctacatatgcctagccagttttcccagcaccatttattaaatagggaatcctttccccattgcttgtttttctccggtttgtcaaagatcacatgattgtacatgtgtggtgttatttctgaggtctctgttctgttccattggtctatatatctgttttggtaccagtaccatgctgttttggttactgtagccttgtagtatagtttgaagtcaggtagtgtgacacctccagcattgttctttttgcttaggattgtcttggcaatgcgggctcttttttggttccatatgaactttacagttttttctaattctgtgaagaaggtcattggtagcttgaaggggatggcattgaatctatgaattaccttgggcagtatggccattttcacgacattgattcttcctgtccacgagcatggaatgttcttccatttgtttgtgtcctccgttacttcgttgagcagtggtttatagttctccttgaagaggtccttcacatcccttgtaagttggattcctaggtattttattctctttgcagcaattgtgaatgggacttcactcatgttttggctctctttgttttggtgtataggaacgcttgtaatttttgcacattgattttgtaccctgagattttgctgaagttgcttatcagcttaaggagattttgggctgagacaatagggttttctaaatatacaatcatgtcatgtgcaaacagggacaatttgacttcctcttttcctaattgaataccctttatttctttctcttgcctgattgccctggccagaacttccaacactgtgttgaataggagtggtgagagagggcatccttgtcttctgccggttttcaaagagaagacttccagtttttacccattcaatatgatattggctgtgggtttatcataaatagctcttattattttgagatatgttccatcaatacctactttattgagagtttttagcatgaagggctgaattttgtcaaaggccttttctgcatctattgagataatcatgtgatttttgtcattggtttttcttatgtgatggattatgtttattgatttgtgtatgttgaaccagccttgcatcccagggatgaagccaacttgattgtgttggataagctttttgatgtgctgctggattcagtttgccagtattttactgaggattttcacatcgatgttcatcaaggatactggtctaaaattctctgtttttgttgtgtctctgccagactttggcatcaggatgaagctggcctcataaaatgagttagggaggattccctctttttctattgattgaaatagtttcagaaggaatgataccagctcttcttgtacctctggtagaattcagctgtgaatccatctgatcctggacttttttttgttggtaggctattaattattgcctcaatttcagagcctgttattggtctattcagagattcaacttcttcctggttcagtcttgggaagggtgtatgtgtccaggaatttatccatttcttctagattttctagtttatttgtgtagaggtgtttatagtattctctgattgtagtttgtatttctgtgggaccagtggtgatattccctttatcatttttttattgcgtctatttgattcttctctcttttcttctttattagtcttgctagcagtctatcaattttgttgatcttttcaaaaaaccagctcctggattcattgtttttttgaggggttttttgtgtctctatcatctccttcagttctgttctgatcttagttatttcctgccttctgctagcttttgaatgtgtttgctctttcttctctagttcttttcattgtgatgttagggtgtcaattttagatctttcctgctttctcatgtgggcatttaatgctataaatttccctctacacactgctttaaatgtgtcccagagattctggtacgttgtgtgtttgttctcattggtttcaaaaaacatctttattttctgccttcatttcgttatttatccagtagtcattcaggagcagcttgttcagtttccatgtagttgtgtggttttgagtgagtttttgtcctgagttctaatttgattgcactgtggtctgagagacagtttgttgtgatttctgttcttttacatttgctgaggagtgcttaacttccaattatatggtcaattttggcataagtgctatgtggcactgagaagaatgtatattctgttgatttggggtggagagttctgtagatgtctattaggtctgattggtgcagagctgagttcaagtcctggatatccttgttaaccttctgtctcattgatatgtctaatattgacagtggggtgttaaagtctcccatgattattgtgtgggagtctaagtctttgtaggtctctaaggacttgctttatgaatctgggtgctcctgtattaggtgcatatatatttaggatagttagctcttcttgttgaattgatccctttaccattatgtaatggcctcctttgtctcttttcatctttgttggtttaaagtctgttttatcagagactaggattgcgatccctgctttttttgctttccatttgcttggtagatcttcctccatccttttattttgagtctatgtgtttctctgcacgtgagatgggtctcccaacagcacactgatgggtcttgactctttatccaatttgccagtctgtgtcttttaattggggcatttagcccatttacatttaaggttaatattgttatgtgtgaatttgatcctgtcattatgatgttagctggttattttgcctgttaattgatatagtttcttcctagcatcgatggtctttacaatttggcatgtttttgcagtggctggtactggttgttcctttccatgtttagtgcttccttcaagagctcttgtaaggcaggcctggtggtgacaaaatctctcagcatttgcttgtctgtaaaggattttatttctccttcacttatgaagcttagtttggctggatatgaaattctgggttgtaaattcttttctttaagaacgttgaatattggcccccactctcttctggcttgtagggtttctgtagagagatccactgttagtctgatgggcttccctttgtgggtaacccgacctttctctctggctgcccttaacatttttcccttcatttcaaccttggtgaatctgacaattatgtgtcttggggttgctcttctcgaggagtatctttgtggtggtctctgtatttcctgaatttgaatgttggcctgccttgctagattggggaagttctcctggataatatcctgaagagtgttttccaacttggtttcattctccccgtcactttcaggtacaccaattagacatagatttggtcttttcacatagtcccatatttcttggaggctttgtttctttttactctttttttctccttgctttatttcattaatttgatcttcaatcactgatacactttcttccacttgattgaatcagctactgaagcttgtgcatgcatcacgaagttctcctgccatggttttcagctctatcaggtcatttaaggtcttctctacactgtttattctagttagccattcatctaaccctttttcaaggtttttagcttccttgcgttgggttcaaatgtgctcctttagctcagagaagtttgttattaccaaccttctgaagcctgcttctgtcaactcgtcaaagtcattctccatccagctttgttccgttgctggcaaggagctgcaatcctttggaggagaagaggcattctggtttttagaattttcagcttttctgctctggtttctctccacctttggtctttgatgttggtgacctacagttggggttttggtgtagatgtcctttttgctgatgttgatgctattcctttctgtttgttagttttccttctaacaggtccctcagctgcaggtctgttggagtttgctggaggtccactccagaccctgtttgcctgggtatcaccagtggaggctgcagaacagcaaatattgcagaacagcaaatattgctgcctgatccttcctctgggagctttgtcccagagtgctacccacctatatgaagtatcagtcagcccctactgggaggtgtctcccaattaggctacatgggggtttgggacccacttgaggaggcagtgtgtctgttctcagaggtgaaatgtcatgctgggagaaccgctgctctctccagagctgtcagacagggatgtttaagtctgcagaagttatctgctaccttttgttcagctatgccctgtccatagaaatggagtctatagaggcagtaggccttgttgagctgctgtagcctccaccccatttgagcttcccagccgctttacctactgaagcctcagcaatggtggatgcccctctcctagccaggctgccaccttgcaatttgatctcagactgctgtgctaacagtgaacaaggctctgtgggcacgggacctgccaagccaggcacgggagagaatctccttctctgccagttgctaagatcttggaaaaagtgcagtatttgggtgggagtgtcctgtttttccaggtacagtctgtcatggcttcccttgactaggaaagggaaatcacctcacccttgtgcttcctaggtgaggcgacaccccacccagttcagagccattttaaacaatgaaatcaccaatgaaaagcacagaaacgtgaaaaacagcgcactacataaactgcaaaaagtaaaaaaaaacctaactaacttaacaatgtgagagctgggaatatgtgtgtccagtatttttcaccaccctgccagtgtccatgaaagcaaaagcgaaagctcctgtaagtactgacttttgggttacaaattttatcatgtagattattttataaacacaatctgcaaataatggggatcgactgtatgtgtcagaagattggagagtacctgggactgagcttctgtagacctgattctgggtttcaaatctgctgcttgttagctatgtaattgggtaagtcataacatttataggcctcaaaatccctctgagtccagaaataagggtatgcatgatattatacctggttttcagggcatttaccaccttttttaaaatagaaaattgagagtacaaaaacactaaacttcaaatttctaaacaaaaatttgattttgctacaattcacacttatgccctccctattcatatctgccaagaaattttcccaaatttgggaagatttaaatatgcatatttaaaaattattatggcccacctagataagatatagtaacagggaccagagttaccattccaccaaaaacaactaaaagaacaaaaaatatgtgaaaccatgggtttaaagatttatatattaggcaatggacagtgatttctgaaagaaggaaagcaaatgaggtaaattttataattgcctcagcttaccacccaaagcaaatatccaggtatcagttgcagggagcaggagctcagacagagcccagtgatgtccctgagttgaggtgatggagcacaggagtaaggcaaagttaagaaactagagtttacagagcagagtcccagagagagctgcaaagagaatgcacactaaagagatttatagaggggtctcttaaggctttagctgagtactgatcagtgtatttatatgaaggaactactcaaggctggggaaagaaccacctaaaaagattagagaacacagcgctcacaaagagccaggaatcattcctggtccctagagctaaaaatctcataattcatgtgctaccaggtagaatacatagaaggcttcacctcacaagtttgaaaacattagccctagaataaatgctgccctggccctatctaagaaaatttaaaagcaacacatgaaagcatcaaactttttccaaatgatctaactgtatttcacaataaagttcaagaatatttatgggaatacaaaatattcagcatctaaatgtctggcatttaataaaaaattgccagacattcagtaaaagagaaaaatatgacctatgagagaaaagatcaattgacgcctacccagaaattatacatattacataaatagtgggaaaagacatgaaaacagttataattatattctatatgttcaagaagctacaagactgagaagtgtagatagatacagaacattttaaaaacccaagttaatttatagaagaaaactacaaagtttgatataaaaatagactaggttggatgaatggctataatatagccattgaatatagcaggaaaaaacagtaaacttgaagatatagaaataaagctatccaaaaagaaatagaaaaaaaataagctttgagacaacttcaagtggcctaatacatgtgtaatcgaattcctgaaagccaagaaagatagtggagagaaaaacatttttgataagacaatggctaatattttttccatgttagatgaaaactccaaatcctcagatccaagatgatcatcaaacttcaggaataagaaaaatgaataaaatgccatcaaggcaatatgaacatcaaattacttaaaagtaataagagaatatcttaaaagcacccagagaaaaaagaatacaaacattcaatggaacaaggaagaaccatagtgggcagggcacccccggtggctcatgcctataatcccagcactttgggaggctggggcaggcagattacttgaagccaggagtttgagaccagtctggccaacatggaaaaaccctgtctctactaaaaatacaaaaagtagctgggcatcatggtgtgcacctgtaatcccagctactagggagactgaggcacaagaatcatttgaacctgggaggctgagattgtgccactgcactccagcctgggcaacagagtaagactgtctccaaaaaataaaaaataaataaaaaaaaagggggggtggtgaaataccttcaaagtactgaaagaaaaaatgtctaaataaatttaaaagtattctagtcatgttttctggttatgatgtaattaaattagaagttagaaaggtataaggtataggaaatattcccagaatatttggaaactaaataacacacttctaaataacacataatcacaaaagaaatctaaagggaaaacacaatgtatcaaattttgtgggcctggcatggtggttcacacctgtaatcccagcattttgggaggctgaggtgggaggctcacttgaacccaggagtttgagacaagccagagcaacatagtgtgacccccatctctacaaaaaatttaaaaataaaaaattagccaagtgtggtagctcatacgtgtagtcccagctacttgggaggctgaagcaggaggatcgtctgagcccaggaattcaaggctgcagtaagccatgatcacaccactgcactgcagcctgggtgactgaggccctgtctattaaaaaaaaaatgcagctaatgtgacacctaagataaatttatagctctaaatgcctgtttaacaaaaagatctcaaattaatggcatcagcttccaccttaatgaaaacagaacacgaacaaaaacacagtgtaggaagaataaaggaaacaataaagatctagccagtgaaatataaaacaaaaacagaaaaaaaatcaatgaaaccaaaagctggttctttgaaaatatcaataaaacttctagccagattatcaggaaaaaagataatttgccaatatcagaatgaggtgatatcactacatattctacagatattaataaaatatgaactatatcaatacattagattaatgaaatagatgaattatttgaaaggtacaagctcaaccaaaaagaaatatataaattgaatttttctatatctataaaattgaatttgtagttaaaacttcttaaaaagaaaatacaccaggcccagatagctttactggcaaattctttcaaactttaagaagaagtaataccaattttatgcaaacttgtccagataattgaagataaagaggtggaatgcttcctcattatacaaggcaaaatatagagagagaccaacatccctcatgaatatagatgcaaaaattaagttttagcaaatccaacaatacataaacatggtaatatttcatcactaagtaggctttatcccaggaataaggtgatttttagattcaaaagttgataataatgcatcaattaataggcccaaaaaatcaaatcagccacatagtcaatacatggagaaaaagcacttgaaaaatttaatatccatttccaatttaggaaaaaaaaaaccctcacaaataggaataaaaggcaaagtcctaaatctaataaagacgacctacaataaaaaacctacagctaacatcatatttaatggtgaaaggctaaatgctttcttcctaagatcatgaacaagtcaagtatttctgctcttactacctctatttgacatttcactgaaggtttcagccagtaataaacaaaaggcatacagactgaaaaggaagaagtcattattcacagacaacatgattgtctatgtagaaaatctatgaaatctaaataaggtcagcaagcctctagaatacagatcagtatacagaaatcattatattcctatatctagaaatatttagaaattgaaatatttaaaatatcaaaaatatgaaatgcttagggaaaattttgtaagaactatacactgaaaactaaaacacattgctgaacgaaattaaagagctaaataaatggagacatataccatgttcatgaattggaagacttaatatatcaattctcctccagattccccagtagattcaatacaatctcaacaggatttttttggtagaaaggaacaggctacattctaaaatttatacagaaatgaaaaagacatagaatgaaggaattttgaaaaagaacaaagtcggaaaaattaatctacctgatttcaagccttatacagctacagcaatcaagacaatgtgttattggtataaaaatagaaacagattgatgaaacagaaaaattcagaaatagatttatgtataggtggtcacttgatttttgccaaagttgttaagataattcaatgtaaaaaaaggatgttttaaacaaatggtgttagaacagttagatagctatgttaaaaacaataaactttggtctttaccacaccccctatgcaagcatatctcagcgatatgggtttggttccagaccactgcaataaagcaaatagctcagtgaagcaagtcacacagattttttgtttttctactgaaataacagcttatactatactctagactgttaatagcattatacctaaaaataaaaaacccctaaatgtccataccttaatttaaaagtactttgttgccaaaaaatgctaatgattatctgacccttcaatgagtcataatctttttgctgcaaatcatttcctgtctcaatgttggtggttgctgaaggctgggatggctgtggcaatttctgaaaataagacaacaatgaagtttgttgcacttattgactcttcctttcatgagagagccctctgtatagcatgtgatgctggttgatggcattttacccacaagacaacatctctcaaaaattggagtaagtcttctcaaacactgccactgttttatcaactatgtttatggaatattctaaatccttgcttgttatttcaacaatgttcatggcatcttcaccagaagcagattccattgttcaaaaacaaacaaacaaacaaaacacattgttcagttgtaagaagcaactctcattcattccagtttgatcatgagagtgcagcaattcagttacatcatcaaggctccacttctaattcgagctctattgttattttcaccacgttttcagtgattcctccactgaagtcttgaacccctcaaagtcatccatgagggttggaatcaatttcttccaaactcctactaatgtgtatatttcaacctcctcccatgaatcacaaatgttcttgatgatatctaaactggtgaatcatttccagaaggttttcaatttactttgcccagatccatcagaggaattactatctaatagcagctataacctgatgaaatgtatatcttaaataatttgaaagtcagaattactccttgatctggggcctgcagaatggatgctgtgttagcaggcatgaaaacaacattcatttccttgtacatctccaccagagctcttgagtaaccaggtgcattgtcaatgagcagtaatatgttgagaggaatcttttttgggggacagtaggtctcaacagtggccttaaagtattcagtaaactatgctgtaaacagatgtgctgtcatctgggctttgttgttccattgacagagcacagacaaagtagatttagcataattcttaaggaccctagtattttaggaatgctaaattagggttggctttaacttaaagtcaccagctgcattagccctaacaagagccagcctgtcctttgaggctttgaagccaggcatttacttctctagctatggatgtctaagatggcattgtctcccaaaagaaggctgtttcatctacattgaaaagtttgtttagtgtagccactttcattaaggatctcagatcttctggattacttgcttctgcatcaatttgctgcatcactttgcactttgttatggaaatagcttctttccttaaacatcataaatcaacctctgctagcttcaaacttattctgcagtttcctcacctctgtcagcctttacagaattgaagagttaaggccttgttctaggttagattttggtttaaaggactattgttgctgttttaatcttctatccagaccactcaaactttctcccttaatggcaataaggctattttgcttttttattatttgtgttcactgtaggttcacttttaatttccctcaataacttttgccttcacaacttggctaagcatttcatgcaagaggcctagtttttggccaatcttggctatcaacataacatcctcactaagctaaatcacgtctaacttttgatttaaagtgagagatgtgtgactcttcctttcacctgaacacttacatgccattttaaggttattaattggcctaatttcaatattgtgtctcaggcaatagggaggcccaaggagagagagagacatggggaaacagccagtctgtggagcgtcagaacgtacgtcgacgtcgcactgacagattaagtttgtcgtcttatgtgagtatggctccgggtgtcccaaaataattataataataacatcaaagatcactgatcagcataacagatataataatgaaaaagtttaagaattacctaaatgtgacagacatacaaagtgagcacatgctgttggaaaaatggcaccaagagactttgttgccacaaaccttcattttataaaaaaatggaagatccattgggcacgataaagcaaagtgcaataagatgaggtatgcctatacaaaaattaccttaaaaaggcatagagctaaatgcaaaagctaaaactataaaatttgggaaatgaaaaaaacagaaaactttagggaccctaagtttggcaaaaatttaagcatcacaacatacaaatcatgaataaaacatgaaaaaaatagataccaaaatttttaaatttgctctttaaaagacttgcaaaatgaaaagacaagccatggcctgggagaaaatatttacaaaagatatatatctaacaaagcacatcatctatgtatattaaaaatgcttgcaactcagcaatagaatccaaacagcctaatttttaaaaaatgaatatctaacaagacacttcaccagtgaagatggatggcaaattgcatatgaaaagatgctcaacaccgctagtcattagagaaatacaaataaaaccattatgagatactactccactcccactggaatggctaaaattaaagaggctgagcacagcaagtgctgggagaatgctgagcaactggacctctcacacactggtgggaatgtaaaatgttaagaacaatttggaaagtagttcaacctttccttaacaactgaatcatataactcccatatgacccagccattccactcctcagtatttaaccaagaaaactgcaaatctttgtccctacaaaatatttgttcacaaatcctcacagcagctttgtaatagcaaaagttggagttacaatcaacaggtgaacaggtatagtcattcaatggaatactacccctcaataatcaggaatgaagtactgatgcatgtaacaacaccgatacatctcaaaatactgagatgaaagaagccagaccaaaaaaaatatacatactatactattctatttagatgaaattattgaaaatgaaaactatagtaatggaaagcacttcaatggttgcctggggagaggggatgggtgggaagcagagattataatagggcatgaaatatcttctggaggtggtggaaatgttcattgtcttgattgtgctgatggcttcagtggtatttacatgtaatcaattctcataaaattgtatactttgaatatatatatctatctcaaagttttaaaaaatttctataaaatctgctttccatctgtcattgaaaattttgcaaatgatgcttaggtcatccaactgttcatctacaccaagagaatgctgtgtggtcataatctttcctcccttgaaatcctggggctttttcccctctggagtccttccctgtacaagcttccaaagcatgaacttccttcctgaagcatgaaagaaagctctttgctgagtacagcaaacccaccaagttaaataaaacctactttcatcatccatctatgtttttttccatgtatttctgacaactcaccattgattttggaaacttcccagtcgttttgtaagcttccactgccgagggaaaatgtaaaatggggaccccgaaataagtgctgatcatcatcagtagcctcgaaaatgagacttccaggtgcactgaggggatggcagaagaacaagcccgtgtagtccttggctagcctgggagggttgtcattcacatccataaggatcaggtggaactctgacacagagctcaaggaagacccccctaaggaattgaatgattgaaacatgggatcagttcactcattttcctcttaataagaaagatttccctttctttaaaattcaaggagttaggtacactgagatgctagaaagacgacaagcttttagaatcaaagacctagtttcattactggtgaaaaagtcttactgaccatcataataataactaagagatatgtgctaatattttacatatattacttcaaaataattgtgaaaactgagctcagaagttgtgtaacttgcccaaggcagagaggttttcaatccaagaggtctaactctagcactcacaccttcacttgctctttagcaggccttaggcatgttagtagagttttctaagcttattttcttcagctgtgtggctttgcaagaatcccacatatgagtgaatgttctggaaaatagtaaaaggctccacagacattatttactatatgataggagtaaaaaacttggatctgcagcataactggttggtagctatgtaatcttgggcaagttacttaatttctcagtgctttggtttccttgttcacagtatgtggtcaataatagcacctacgttatagtgttgtatgaggagtaagttattacactaagtgctcagtatggggctgtcagtgcaacataaacactgactgttatcatgtcctcctcaacaccaatcacagacattgtttctacaacttctgactctgaccttgtttgattccagtaatgttttcttgctcatttctagtaaaccctgttttcttgattttcttctcaacatcgtctatgtccatggctatacttaaccaaagaagaaaaggccactgtgttctcgaagttattgtatctatttatatcatgtcagtgccagaaactaaaaacagaacagggttttggaccctggttttgatttctgaaacttctagaatgtgagaaactcttgggacacatccagagtgaagttctgatccccatggtatgagaaaggggtgtgcacagcataaaggctcagccagaacctgcctgctgcttcactgggaggttttaaatcaagagttaaatgtatacaatgtgatagtggaatgtgctgcactcaagcaagagacagaagcagagggcctgtccattcacacacacccctcccaagctggcacaccgttctgcattctaccctttttggtttgacttgactgaagtaattttgtttttcttaatctttccacatgcaggggccgtttttatgattcctgtctctcttctccaattcagctctcaaccctggccctcacattttgaaagtttttttccggggctgtggtgggggagtctaaaaacatatttattgagtaatttgtttaattctcttttttggtaaacctgccagatacatttactagctaattagagactggtcaacattggatcaacagatttcctacttgtatgtctgaaaattccatgaaaatgcaaagaaactcttttttagttgccaggcttattattgggtaaacatactattcctatgtgtttatttttattttaaaaaagttctctggaactccacagttggagccagcaggcaatatatatcagcacaactaaaataaataagatacaaagattacacaggaatggctcaaacatcctgggcttttctgtctttcctttcaaaagttcacctgatttcgtcaaaacacagataccccttgttcacccaaacctatggaatcagaaactccaggggtggactcctagtgttattcaacaagctccccggggattctcacacacatcaaagtagagaacatttcataaaacattttctgcttcaaaaaggatgagagttacaatttaaggctgaaggagcaagtggtggtctacgtgaacaggtcagtggtttgattccactcagagctcctgggggaaacccacaaccacattggaagaagggaggtagttcagccagggacacagaactctctagaagaggccatagcccctacaggaaaccacagagtgagcagcagccctgctgggggcacaggtgtttttcacctttaacaaaaccacaaaggggctgggcgtggtggctcacacctgtaatcccagcactttgggaggtggaggcaggcagatcacctgaggtcggaagtttgagaccaggctggccaacatggtgaaaccctgtctctactaaaaatacaaaaattagccaggcatggtggtgggtgcctgtaatcccagctactcggaaggctgaggtaggagaattgcttgaacccaggaggtggaggttgcagtgagtggagatcgcaccactgcactccagcctgggcaacagagcaagactccatctcaaaaaaaaaaaaaaaaaaaaaaaaaaaaggaagatatgagcactcccttatattttgtacccttctcatccttccactttaaggttgtgatattctggtgttttggccctgtcagttttcttatcctccctcccatttcaacccatgtatcttctgataatctgtgttcctttttttttgttttttttttttttttgcttacctacttctgtggccaccacttgtacccgatatggacttccggcttctctgtccaatggagccacactaaagatctcaccagtcacgtggtcaattttaagccaacctcttgtgtctcccctcagtgaatagcttcatcaaatgaaaagagcaaaagaaagcctgcattactttgcatgaaaatgtgaagctagtttgtgcgtcaactaaatatgtttgtgcatccttgaaatatgttgtaaataatatacaaatgataatgctgagattatcattatcagcattacttgtatattatttaaaacatatttaaaggatctattatctcatattattaatgctttatttgcatttcatctgtcttcaaaaggatttgttcatccttacaatgtggtgtttgtgcttgtattaggaagggtatagttcacaacttctggggaaagtagttaaacttttctggcaatcaaaaactcaaattaaagtaacctggaagtatcttttaaaacctcttagcaaaccacccacctagaaaatttgaacacccagtggtggaaacgttgggcgagatgggtggatactcatagaccctggtaacacagtgaattcctcatccaacaaacatctattgagtgctgaggaagatcaggcagtgggccaagggaagagatcacaaaaaggtgttcttaggcaagtgagatagacagataaacagttgattccaataaaatgtggtaaacacaacagagggggccctatggaatccaagagaagtttacaggaatcagcaaagtctttctgaagtagtagatgtttaaggcaagaagaagacgcttcaagtagaaggaagagtgtgagataaagcaccaagggccaaggaacagcatggtgagtgtggggtcaggcatttcagcagtgctggggtatacttgggaagcagaaggtggcaaaaggtgaagccacagagatttgaagagccagatcacaagaagcaatgggcagccagccaatgatttaagcaagaaggtgacctggccatatttgtgctttcaacggagctcattggtaggtgtttggaagatgaagttgagacagacaagactagaaccacaggaaaaccaatggtagtcctttaaaaagcaacacatcatagtcatgaggatgtccatatctttagaccaaataatttcactcctggaaatgctacctaaaaaaacccaatttaatcaaagtttaaaaagaattacatgcatacatctatttaaaacattttctataataaaaaatactggaagcaacctacatatcaaaggacaagagaatcattaaaaaagtatgatgtgttaatttcccacaatgtatttttttagtatattccatatgccaaacactgtgttaggttatatacatgggtaatgagtatgaaaccctttatacttgggatttcatcctgaaagagatggaatgctttggagggttttgaaagaggagtcagatgatctgattgacttttttaaaaggtcactgactgcaattcagtgagtagattcagagtggggtgggggacggcaggggcaaggacgaatccagaacagacatggtggtgccttggagcaggctggaagcagggagaagcaggtggattctgaatatatttcaataaaagaatctataatatttgctgaaggattggattcaaatccattgggtgctaacagattttaagtttgtggagctggagaattaaattactcagaccaacactggagtcatccttaattcttaacagacttattactcatgtctgaactattgattattccttactcctgaaacactttcttcatttgtcttctggaattgtaccttacagaacacctcttctcagtctcccttgctaacctcctcttcctgacctcaacttaatggtatatgtatcctttccttgtttcatcacagtaattttcttacatgcctttatttttcccactgataaactttttattcacgtctttgaccaatggtttttatagcattttcatgaagaagataggaacttttgttaaataaatggtataaagattaaaaacattttgtgtcttctcataatttttgacccagtagtatctacactaaaccatacagtatatcccctactgttctttcttctctgtaaaactacagaagtagttagagtaaaactgcaggtggtaactttgcttctcaatgatcagataaaggtcttagaagtgaatccaagtgcctgaaggacagctcaatgggaggcaagactccctccagatgtttagagaaacttaaggaattgtctgccattcatagccacacgcgtgatttaagtcatgctgaaatatttcctatgccatagacaggaggtgtaatgtacaacagcagcgaaagatctgagttcaagtcttaactacatgatcttaaagattttatagatattatacagatatatacaaacatatatttcttaagttaatcatcattgtactttttaaggcaaatctgtgtgggtcttactgaactgaaaaaaaggaattgctaagatggaaatatttacacattttgtttagccacctcagccagagcaccagcttctccaggggtgccctagatcagctctttggagccaaggaacctatgtatcctacatccagaagattccctcagccctgtaagttggcatggtctgtccaattgggctttggtctctgtctagaactccaatacacctttagggctggaaccctttcctaaaccctagcctagataacaggcttagacacagggcctggttattctagtctctcagaggtgaacctcacttcctgaaccatccagctctcagctgggacctgaagctcatgggctggaatggaacctcatgctgcttcccacttgtctgagcctagatggttattgatgaaccaccatcccttggaatgcccccagggtgttgacagcttcctaaaccaaagccaatttcatcattgctgggtatgctgtgagggtcagccctggagtcagtgcaggccagctcctcctcctccccattggctttggtgaccacgcagccaggcctgcccagcactgttgccctttaccttatgtccagaccttctggatccttggcagtcacattgcccactttagtgcctatagctacatcctcactgactttcgcttggaatacgtgttgggaaaattgaggtgcttcattcacatctgtcacaataagcgtgaacttggcaaaagaacttgcattgtacttcacaccaaacactagaggctcaggattttctgctttgaacacaatgttggaaacagctgctgtttcaaaatcaagaggctgtgtaggagaaagagagaaaattaattttggggtgattagctcccttaaaagattcattccctatccttcttaaactctcatatattcgatatataatattggaaaaactggatatccacatgtgggagaatgaaattagactatttcataccatatatgaaaatccgttaaaaatagattacagacaaaatataagacctgaaactataacaccactagaataaaacatagaagaaaactctgacattggtcttggcaatgatctttttttattattttttatttttgagatggagcctcatgctctgtcacccagccttgagccttgagtgcagtggcgcaatcttggctcactgcaagctccgcctcccaggtttgttcaagtgattctcctgcctcagtctcccaagtggctgggattataggcacccaccaccacacccagctaatttttgtatttttaatagagacagggtttcaccatgttggccaggctggtcacaaattccttacctcaagtgatctgcccaccttggcctcccaaagggctgggattacaggtatgagccaccatgcctggctggaatagaagtttatctgactctcagttctagaggctggaaagcctaagaacatggcaccagcatctgttgaggactttgtgctgtgttatcctatgacagaagggcaaaccatctcacgagatagaggaaactcacccttttatttttagtagagaagggggttttgccatgttggccaggctggtctcaaattcctgacctcaagtgacccacccacctcagcctcccaaaatgctgggattataggcgtgagccactatgcccagcctagcaatgatcttttaggtgtgaccccaaaaacacagactacaaaagcaaaaatagacaaatgggattgcatcaaactaagaagcttctacatagcaaaggaaacagtgaagcagcaacttacagatcaggagaaaatatttgcaaatacacattagaaaaaggattaatataaaaaatttataaggaactcaaacaactcagtagcaagaaaacaacctgtttaaaacctaggcaaaggacctgaatagtcatttctcaaaagaagacatacaaatagccaacaagtatatggaaaaaaatgctcattactaatcatcagagaaatgcaaattaaaaccccaatgagatattacctcacacctgttagaatgacttatcaaaaagacaaaaaacaaacattggtgaggatgtggagaaaagggaaccctgtacactgttggtaagaatgtaaattacaatagccattgtggaaaacagtatggaggaaactcaaacaattaaaaatagaactaccatacgatccagaaatcccactactgggtatataaagtcagtatgtcaaagagatatctgcactcctatgttccctgcagcatcattcacaatagccaagacatggaatcagcctaagtgtcgaacaacaaacaactggataaacaaaatgcagtatatatatgcatacatacacatacatacacacgcacacacatatatatatacacacacacaatgaaatactgttcagctttaaaaaggaaggaagttccatcatttgtgataacacggatgaacctagaagatattacggtaagtgaaataagccaggcatgaaaagacaaataccacatgttctcacttgtatgtggaatctaaaggtgttgaacttggagagtagaatgttggttaccaggagctggggcatgaggagattggggaggtgctggtaaaagcatgcaaaatttcagttagaaggaatgagtttaaaatatctattttacaacgtggtactatagttaacaacaatatagtgtatactttaaaatcacagaagagtagatcttaagtgttttcatcacaaaaaatgataagtgaggtaattcagatgctagttagctctaattagtcattctacaatgtatgtatatttcaaaacatgttgtcctcctatacaatttttgtcaattataaacaagacaaactttcatagcagtggttctcaatcgagtgtcagcaaaaaccttctcagaatgattacagagccatgaaagagtcttttctgcaggtcttaccagagcttgcactacgctaatatgtcttagaagaggaactggaacacggaagtcctcaaatttatttaactgtgggacacttcatttattcaacagaaatgtattgattctcccaagacattctcaggtgacagcttgagaaatgcttacatagagatttccattttttatgggaaatgattttccaagggcctcaaaactcaagcccccaaatcaaagattttaaactcatggaggatgggaaagggaaacagagatgacagatgatctgctgaggacatgccagatggaaccaggaatgaacatcaagaaaccaattttggtttaatatgaggcagaatttaacagggctacccaagagtactccccctcttcaggagtgggcttactgctgtcttctccgtgtcggcttcctgatccctacattccatcctcaaactgacaagctgcacatcctgtgcagtctcatagcacctaatagatctaagtgttgatgtattttagatcttcactgaccctaagctccatgagaagaagaactgcatcatattcatctttgcttctcatctcttccctgacacatagtgcccacagtgggctggtcaggaactacaaagaccaggaaggcctggtccttgagggcctccatggagaggagattctggagaacatccccaccttccagaatcccctttcccgcatgcatgcaccaacacacaccatcatgactcactctctagttcataagtgctgtgggacaatttttcacgtagaagggtgggaactgtgtgtgaagactcggggttgagaaagaagaatcaattgaaatttgttcaaatatataagagataaaatcatgtaagccagctaagtgtgaaaaaagaggttgttcatagtgataagcacccactgtctgcagggcctggccctcgtcgacctcgtgacgtggtccaatacacgtcacgtggtccacggttcaattagggcttctccccctgaagtagaggtggggagaacaagctggagtttctcactcacaggacccactcccagtctcaggggatgacagaactgtccagttgagataaaagcctagtagaccaagcaggaaggcagcagcccccagaatgagcctgtgatggggacaaaggacacagctctctgttcctatccagtccagcaaagtccgggcccaggcaggcagcacagttgtccatatgctcagacagagcacatgcatccatcctcaccaccaagcaggtcctaagcaccctccctggcttttcctcatcccatcactgtggccccagaggcaatggtttaaagaaatgagacactgtgtgtgcaaatgagaagcagcctgtattaccagaagagaacgtgcaaggctgacagtggaaagacaagactgtacggcgagctgaggagttggaacttcatccttgactaacaaggtcagatgtgtgtcttagaaagataactccaggagcagctacatgggggatggattcgaggtgatccacactggggcgggaagactagctagaaggcagtgtcagtgttccctaaacactggatggaagaacaaatgaaaagcagcagcctgccattgaggattctatccgcataacttccacacctggaaaaacatcaaaccaaatcttctggagaaatcattataaacggaagatgctaaattagcacatggtaataagcagagctgagccaagaacaagccttgtccggccacgtgcattgtgtttcatgacctggggatatgactgtgaggccaagtcaagagacccgtcactgcctcttggaatggcctcagtcccatctggcaagacatattcaagttaactgaaaaaacctgctcataccacgattccttttgtgcacaaaaccgcctgaaaggtcaaacctagagatttagattcaacctggaggcaaagaaaatgctgaaggagaggggttgagactgggatatttacaattttcactagcgatcactgatgatatcaaagtgtgcacattagttttccagatgacatttggtctggttaaaaatagctagtgaactgagaattcaaaaggatcagccatagtagagaagtgacaaaatttgcaagttaaaataaggcagaaccctgaatttcaagaaacaggatctcaggagagttattgttgagccaggcagggctcaaagaaatagctttcctgctcatgacacacgtttggccccaagagcatgataaccaagcacacgagaggctggagcttgggcagaagtaaatacagagcagggagcatttctgacagttgtttaatctgaaggattgctttgggcacttgccaaaattactcatttccaggctttccccttgagaggctgaggccgcagtcctcagtatgcaccatctgactcttgaattaggcaagtttggcccccttaggcaacaggggaaagcatacctgtccgcaggtagaatcctagctctaattaattagaatcaagtgatgccacgtgtttaagtctgcaagctgctggatgctgtgttaggaactatacacatacttttgcatttaattcttcaacatccttactagaaaggtgctaccattttacccatttttacagattggaaaactggggcctgagaggttacatcatttggtcaaggccacaagctagtaagtggcaacaccaggactcacagaaattatttcctgagaggaggtggaggcctggagtcaagttcccggctctgccatcaccagaaggcctgactgtaccttgctgtgggcctgaatttctgcctccctcagaatcagtgggagaagcaagagagtttatgcaaacaaactatagttgccacgtatgagtccctcagtgaattttacctgtgattagcacatttgtaattcagatgaactgttaatgatataattgtgattaacaaacttaaacttttaaaaattattaacacagtggttcagaacagtggtagtcccttgatggcttaataggcaaggacttagaagacaaagccatacataaaaaaccaaattatatagtctataaaacacttcaataacaaatagtatggctacatacatttgttatatttttattctatatcctagtggggaattggctaacatttggtgtgtcctaatcaagaatccacagcccagggttggttgttgcttagcatctgaaagaacctaatccgagatctatatcccagaggtagctatgatagtccttcagccaacactatctcaattagaactagaaagtttgttaattagcaaagtgatcttacaaataaattttcttggtgatatgagtggtgtccaagatatgcactttgggccatgcacagtggctcaaacacctgtgatcccagcaatttgggaggctgaggcaggtggatcacttgagcccaggagttcaagaccagcctgggcaacataaggagacccccatctctacaaaaataaaaaattagctgggtgtggtggcacacacctgtggtcccagctacttaggaggctgaggtgggaggattgctctagcccaagaggttgaggctgcaatgagctatgactgcggcactgcatctgtctcaaaaaaagatgtgctgtttggttacgagtatagtgtatcccttagtcattgtgaacaggagtatagatatctggcctggccagcagattgtaccctgcagagttccagggctcagttctgttctgccagttatcacctgcctctggatggttgaacaaatccacttgctcaaggacagttatcacagtgcccaagggacagagagctgggatgtcacaggcctaaagcacaggttcgatgatcacttatgtgtctgcttgttcataattgtatatgggacagaattcatttattcattaagtcaagcaatatttattgaacctctaatatatgccaggagacataatagacacttgaaatagaaccacatataaagtaaggatgtgacaaagagtttggtcagaggcctactctactgtagcatacctctcgtgtcaagttgtgagggaggatacttacagctctcacccacagctaatcattgagataggtgccaacatctccctaaaagggcccattaaccacaaatggccaagttaaactgctgttcaaaaaaatatgacatacgggccttgttcatactgggatggatgggcctctatcttcccttagattcctagagagctctggtcctgcaaaaggataaaaggaagctgcccccgtcacctgcaaaggaacacaccaacccactgcaagctctgaaaactgccctttcctttatcctttctttctgtggtattctctctccatgcagactgctgtgagcacaaggggaggttgtcatggtaccttttccaaatgtcagactcacacacaaggctaaggctttgagctggtccacagcaacctctctgctgaaatgcagcagggcccttggttcaagctggaatgtttggtaacagtaggatcacaattccaaggctctgtcctagggcttgcttcagcactagtgcttttttctctgtgcttctgtccattttctgtgaaattattctattttgtcttcatttttagcctctttcagttttcttttattctggctcaaaactgtactccagagctttcctttgcagcttccagcacactgcactgcaaaccttaaacaattagccacccttgcagattctctctggccctttttaacagcgaggtttcactctctttcctaggaaagtatcttaactgtaagtacattggacggcattgagtgctgcttccaattgagtcatctggtaaacccatgacatgctctaaacacagatgaggcagccacagagaaaagagtcaagattcaggtatacatggcaggggacaggagtagattgagggagggttgggagaatcctgtacaaagagacaggaaccaaggtaattaagactttgactccagattatccagtccttacagagggagagacagaatgagagcccgtgggcttagcaatacagtaaaaggtgaaagtaaagcagcggagagggggattaaaaagacacttgtctattaaaccttggaaggagacccagcagttgcattattcaaaaggtatctctgcctggcacattagaataaagggtttacagcctaaaaggcccatggggtcatccaacccaactcctcacatttgcaaagggggaagtgaaagcgagaccctgagtgccactcccagaccgtaagagtgttgcgagatttagcaaatagcaaataaaaacatagaacaccaagttcgatttgaagttcagataaatgacaaacaagtttttagtataagtgcatcccaaatattgcatagaacacacttatactaaaaaattgttcatcctgcattttatatattttatatgacgttacctccctgcaaaagttacttggctagctagcaacagagccaggtctagaatcctgacttcccgtctgtcaggaagacaggaacgactaagaggaatccaggaatccaggaacccatcaccatgcctgagagatggctgctaatacatcacctctgcttataggtcttcacactgtcattagtaaattaacccacaaacaaagacaaattctattaaataaatgggctatttacctttttaattatgacatatccggtgttggtatggggatctgtgtcaacccccaggcgtccctcactgtctccctttatgatatgatacagaattttagaactcccagtaaatggctcatcagcatcagtggcctggatggttaagatggtggacccaatgtttgtgtcttcagcaagagtcaggtttccatactaaggagaaaatggagaaggaaacaatgagaaggtctgctgtcatcaaagccaaaggacaaacttatctctctggtttcagaatagacacaagtcatagtttgcatcaatcttcatggggcatgttttttcctattgatgaatatattgcagttgattttaacatcagtcatactcatgagctgatatccattgtaccaaagaacgcaatacctcagagagctactggtaggattctaaaacaaattccccctcccatatccaatttgtttaataacttaattattgtagtagtaatgatataaatagccaccatgtattgagtatctatcaggtggtaggcactttatatacattatttaattaattcttaaatcaaccaatgaatagaggttgattaaaagcttgaactttggagttaaacagcctgaatatgaattgtaggcttgcttcttattagttgagtggcttgaagcaagttacttcacttctttaagtgtcagtttcatcatctgtccaatggagacaatagtaatagaacctacttcatgtttgctgtgggtgttaagggagacaatgcatgtaaagctcctaaattcttggcacatagtaagtgctcaataaagaaaatcaacaaaacaccttacggagtagttatgttaccatctccacttacgaggagcaaaggcttggagaagtaaaacccaccaagggtcacacagctagtgggtcaaagggattgggattcaaagccatgtttgtgcaactccaaagcctatgctcttgaacactggcctagaccatctcccactccactgaaaatcccccagattatctctcttggcatcatgatcctaaagaaggttataagtaggtctcagaagagaggaccacagcattgaaacaagcaggttcactctctgtagccagattagtatttaagctctgagacctcaagtgcaggattcttaccctcaatctaaaaaacactgtctcgataaaaggcgaggaggtcacaaagttaggaaaggatcaaaagcccaagagaatggaggctgagaagaaatgggttatttgatgcctgctgaacctcagtgcctgttatacaagacatatccactcacacctcttcccacccctagccccctcataaatcaattcccttctttgttgcaggcttgtccctattttgatttatgaacatcatcacagggctctgggctgcctcataactgacttcaaaaataacataacagtctagtcaaataggcttcttgctccttcaaaatagagacttccctccttagggaaacaatgataaagtcatcaccaagtctgaacgccctatcgatgacaagaaaacagtaatttgcatttttcttgaggttctaaattgacttttttctttctgtccagttctaattctctcaaatgtcttgggcacatttttctttggcttaagtcagagattaatttttttcttctccctttctcttacccaattattacaaattaaatcgccaatattccaaatattaaatttttggctaaaaatgcttgagacctagcagtaaatctatttattgtcctaacacaaaaaaatatataatgacaaactgtaagccgccattcaccttttttcaatttgacaaagattgtggttgttgtttttaagcagcccttggaataaatgagctattggcaggagtttataaatgaatgttcccagacacctgtaatagtaaatgttattgttccccaaaaagttccactgaagatggcatctgggttatttgtgcactgaccaaggttacctgttaagtctggcacttttcctagctactgtctgtgtctctatcccagaagaaagggtgaagtaaaatgaataaagtaaagaaaaaacaaataatgacaactactcacatctgatttttcaaagatggggatctgatcattgatatcaataacgttgatttgcacaaaacaaagggtcttgaaatctgaaaaccaaagtcatatgtcatagaaattttcactgaaaaccatgcattaatatcagaaatctgcaagaaaatacttggcaagtgaagtgacagccatagccacaattttgcaattgacatgcaatttgtgcagagagtgggctctctgtttcccacctgtacccaagtggtcaccaagtgtggggcagggtggctaaagacagatctaagagagatttttctaggtttttcattgccgtccacctgctgtcctcctaagtaaagttaggtaaggtttgttcctgagcaggatggcttccttttgtgaagcagtctttttctgactagtgaaacttatgtaatcttcaaagtccagagcaaaactgtccttccagaaagccttctgtgagcatcccagtggctgtctctccttctctgaacacatccaacctacatctgctctgactactatgatggtgaggtccaagggcctgctctcttctatctaaataagggaggaactaccaccattggcctgttcacaagagtctggctacccagcctgcaggaagcaaggtggggacagaggtagctcctggaaccctggagaaatcacccaggctttcagggatgggtttcacaattccaagacctaggcacacagccacttcagctagattccagatgtgtgtggagtgcaggtggggacaggatgcctgggggagagagaacaagagataaaatgacaggttctttgttgggttgctgttgttctaaccatggtgcactgcactgtataatggttaagactctgggcttggaattcactgtttggactctggctctgccacttagcatgtatgtgagagcttgggtgcctcactcaatttatctgtaaactgtgaataacagaacagatgttttcatcataatacagttgttagcggcctctatatagcagcaactgtattgtttacccgagttactcattcatcttcatgataacttcatgttgtaggtgctactgtcattcccatttaattaacagatgaggaagccagggaatagagaagttcaggtaacctaaccagggtcacacaactaactagtgatggagccaggattcaaacccagaggttccctttgccctctgcagccaccatccattcctctgtctgtgctctgtagcccaaggggctgaccttatgaactgcatcaatgtacatcctcaccctgagggtaacagttgggttctgccactgagaggcgtggcaagagactggagggaggacaggaagagtgtagctgggggtgtcacgcccccgttgccaacagccctcttctagtgacaggcacaggccttgctcctttgggggatgctcccctccctggctccttcaggttttagggcagaaaatgctgcttactgtgcttcacacctcctgttggtttcccttaaccctgcccacaacctttgcaaacaatcccttctttcaactctttgaggggagtctccacttcctgctgggatcctgactaatattcccaggtagtttaactctagagctggtgctcaatgcactggacatgatcccagggacagaatctattaacaatccaattacaaccaagtggatattgattgaagttaaggctggtcctcagaacgtttgtagacaacaagaatggctgaagactggagtggtcccagacccagaacccactggctcactgctctgcacacacctcgtttgaccagcagtgggcctttctgggtaaaaggccttccctggttttatgtaaaactgtgttaattatagcctagtctctagttttctgtagtgcacagttgaatgtttagttatatcaacacacacatgtattttaatatattttataatctggtccatattttctatagacgtactcatgcaaataaacaatttgtaatctgattcccactttaaactctatcttcaaattgctccaggtcctcatgtatttccacatggattcccactctcccataagtcctacatgattttgtaacttgtcatattcatccttcaaagcccagctcagaaatacctcttccagaaagcagtacctgttctctccctccactgagtcacttatttccttcatgggctaccttgggcagttccttgcaatttactgactcacatgtccgtctcttctaccagaatgagtgctccttgaggacagaatcatctatgtctccccagtaccttgcatggtgcctcaaataggtaaatgcagaataactgctgaaagaatggactgttgatagtgtgaaattgttagctcgtcatgaatagggaaggtttattatacttacatctgttctatctcttacaataatgctagacaaatattagggccttaatatttgtcaaattactgggtttcaaacattccgcattagggccctactaaacctggcttctgcctagtatctcaatatccctgtaaaggacagaaacatgaagcacagtgtgaaacgtttcttgtttgttctccatacctgtgtcatccgtgcctgccagcagaacaattactgaattatatggtaatcgaagattagtacgcattaactcaaaggaccttctaggagtctgagtgcccttgaaatgagtctgtctttgaatccaggtattttgtgtgtctgtgcacatttgtttaacaatgtgtgcagttgattaagaatgcatagtttttatcagattctcaaaggttcctgtgacccaatagagattaagaaccacttgctctgcaattgtataaggagtatggggaagaatgtctcctgatactgtcaaacggccaactagaagctgttagggtaagatagaactttccgaaagatgctcttctcctccactttcctacagtagagtcctttcagtctgaaagcaagaattgggaaatacaattcattttcctgtttgtgattatgttctgcagaatgtgcctggcagacctccaacaacagggttgttaattgacaacagctccactgctgtgctctggaatctattaccacattcacactgagacctcaactcccctggactgtacacagccagtgactgagaaaagcagcaattgtaaagctcattttcaaagacaatgaattcctctgacagccccctttagactccccgacagctgtgccaagctttcctcagactgtcctagtctaggacattcccaccagccttccttctccatctccccttcacccagcgtcaggcatcaggcttgtatttaggtctgatgactctcccagccttctttgtgcccttccgcaattttttctcacgggctccccccaataaaatcctcgtacatttaatctccttttggcatctgcttcccataggacccagaccaacacaacaatggtgcctgagctgcagctccggcctttacagtgttcaaccagctatctctgtgttatgtgtgtttcacaaaggaagcaaagaatgtttaaatggcatcattctataacataccagacattagcgcaggaaaataactcatagctagaaggaaaacaatgatttgcactcaagacggtggatatgatactaacctttgtcagacacctctatcgttaagttgtactgaggagtatcttgcttcttcaaggactgtttagctaactgtaacattccagcataggtttggattaggaagagtccatccatgggaagtttgggagtttgctccacaatcctgtagtttagaaaactgttggcagtattttcttcatccctgtcatgtgcagtaagggtcccgatactgttacctatgaggaaggaaagaaggaaaacccaccattacaggctccacataatctattaaaatagtttcactaaaataagcacattcctagaaaacaccatgaataactttgaatagcagacaaatgctcttagagttattttggttcttctcatcctatcatgtaatgggttgaatagtgtatttgtcagccagggctgtcattaagtatcatggattaaacaacagagacttattttttcacagttctggaggccagaagtctgcaatcaaggtgttgctggggttggtttcttccgaggcttctcctgggcttgtgagtggctgtcttttccttccggtgccttcacagcaccttccttctgaacctccctatgtccacatttcctcttataaggataccagtcatactggattagggcccactgtaaggacattttactttcattacctcttttaaaaccttatctccaaatatagtcacattccgaggtactaggggttagaacttcaccctatgaatctgggggagggggaagatgtagcctagaacagagggttacaacctcaacatataatttggggggcacggggacacattcagcccataacacctagtactccctcccaaaacttcatgtctaccagaacctgagcatgggactcatttgcaaataagaccttcacagatgtcactagttaaggctctggagatgaaatcatcctggatttagaggcagccctaaattcagtgacaggtgcccctataagaagggaaacacagagatgcacacagaggaggaaatgatctggaggaggaagccagaagttggagataggctgccacaagtagccagggaacaccagatgccaacagaagccggaagaggcaaggaaagattctccccttgagactctggagggaacgctgccctgcaagcaccttgatttcagacttccagcctccaggtctaggagagaaaagatttctgttgttttaagtcaccaaattggtggtgatttgttgctgtagccctaggacgctaatacacatggcaaatggtatcactaaacaaagagaagccaaccctagattgcatctaagcaacttcatggaacaattgcagaaactgactctactccaaagataacacagggcagggaccaggcaggatcctctccaccttgctgtagtttgtggtcctaagtattttattcctgtgagggtttcagtccagggagttctacaaaccagtggctatgactcggttctgcacccagctctgggcaagttctgacaggttccagaccatcctactctgggaggtgggaattgtaggtctctttatatgtagcaagaatcccacgtaggagctcaaacttgaattcatcccatttgtggagttacaccccctcccccatcagctgacacagtttgcatccactgacgcatatggaaatttagaggttttttggttttgggttgggggaggaaaaagaaagtacctatgtatgtctacagtagagctggacacatgcagatgtgcctcatgggctgcatgcagggaccatcggaatgaataggacagaagagaatatgtttctagtgcatatggcatgcatatgcccttgcaagaaaagtatctgtgtgctgggatgaaagagtgtcttactaaattctgtggtcctttggtgtctcagcagccctgctatagccctatcccctcagcaagtgagcaagaaactgaggacactgtcctcctctcactcacaggaaacctccatgctgccagaggcaccatgaggactgctggcatcagaggacacccctcgctgggagcagaggaccttgtggatcagtcggaagtgaaaggaaaaccatgtctctgagtgactgaggcctggaacaagtggagctcaaactgatacaggagtatacgtagcatctcttagaaatatgcagaaatatttagggaggtggggtttttatgagagtctaaattttctgtatgaatacataagacttggtggcaagtgggattcaagaataaatgttagtgttgctaagacttggggacacgagttccacaagataccaaacaggagaatgtaaatacactggggaatatatatatatatatatatatatatatatatatatatatatatatatatatatatatatttgtgtgtgtgtgtgagatggagtctcactctgttgtctgggctggagcacagtgtcatgatctcagctcactgcaatctctacaagcctctcaagtaggtgagattacaggcatgcaccaccacacctgggtaatttttgcagtttttttttttttttttagtagagacagggtttcgccatgttggccaggctggtctcgaactcctggcctcaagtgatctgctcatcttggcctcccaaagtgctgggtgggattacaggcatgagccactgcacctggcctaattcagtattttatcaaggttttatttgtgaatatttccacctactcatgtcctatcagctaagctagacagtaagtccccacaaggcaggagcattgtcttgtacccttttaagcttacatatatagaatatgctcagttgatttataagaattcttggtccactaaagactctgaaatatttttacaaaataaattctcacctttagagaggcaaatagcaagctgagccccttcaaaatttattctaccaacaatgacttcttcagtctcagaaaaccagcactatcctcttcccagatgaggtaggcgcctcgaaaagagcttccagcaacccccatctcctgatatttgtgctttttcagaaccccatcctgttgagtgcaggctggacctagcaacttgtttctaatggcaaaagtgatgggatcgcttccaagattaggtcatagaaagactgatgcctgtcctttcctgctctgccgtactctttccctctctctcagaactctctgaattagaggtatccagctgaacttcacccagattccagactcacagaaactgtgacatgatacatgcttgttgtttcaagctgccaagatttagagcaatctgttttgcagaaataggtaacaaatagactatatgattggcccaatgtaaaagaggcttgaagtgtcatgtccgggtcaagaaagttgtcaaagattttccacctttattcagtgtcacagaccatcccagatttcccaagaaggtgatggcacacgtgtttgttggctactgttacactactgtgactgtgagaagattcttccttataacgaactgaagtccttcaagctggcattaactcttcctgttgtggcaagagttgagaaaaatgaaacagagaggacctgcacagaacacagtgacacagaacacactgacaaaaggcagcccacacgacacctgatagcaagaagaaaaataatgagcagtgtgagcaagccgctccagcagcgcccaccaagcctccgggaaggcacccactctgtcagaggtgtgtctggtgaggaatggagggacgaaaagaaaatgtgagcccatccacaaagcacaggaggatctctccacaagggcagtgaagctctagaaatgatagtcgtgaggctgctacacttggaagcctctgaaaggtacacagcacaacagaacaaaacagttcaagaaatgccagtctgctcagtcaaggggctcactgccaagggggaaacagacaagcattgtcccaaacccagagaagccataaaactcccagaaattataatgttcttatagtagttgttcctatacaaaaactaaaaagctatcacaggacacagtaaaagaaaacatagcaagacaaagcaaaaatgataaaaatagatgggatttgacttcatctagcagcctcttgaattatattatcagcttcttggaaaggggggcccaagggtcaaaagtcaacttccattggtgttgcttacttattgcagggtgtctgtctgactttgggtgtaaatgtttaaattctttggcaaatgtgatgagattatctctttaatgagattattagaagtcaaataacgtatggggaaatcctgcaaatgagatatccctatatacatgtatataagatactagtgtaggtggctgtgatactaatgatagtagtaaggttgataatgatagtgataatggtagtagcggtaatggtagctataaaagccccaatttaagaatactatccagatactgtttgatcccaaatacggtccttacgtgactcccaaggtacagtcaacctctatgctgtggaagacatggattactgactcccagtaaggtctcctgctcaccttttacccagcagaggagagaaatggagggcagttacacagcattaggcagctctcatttcttacccagtcgttcattctcctggacctcaaatacggttactggtgacggacatgtaggtggattatcattaatatctttaacttttacatgaatttccagcggatatgaaagtggttttccgtactcatcctttgcaactgcataaaaaacatactacaacaggaaagtcagagttaaggcaagactcacccaccaccctctgtcaaaagcagagaaaatcgttgtttcatttctatgtcatttactcccttatttttaattcacttagaattggaaaattttaaaaactgagatgggtcagaattatgtgaaaattatcatgtctttgaaaaccaataatatgctggagtctgaaatgtgtgttttttttttctttaaagtaaaatccattttgctctcaactgtagatgggcataggactttgtcttgtcgcctgtgaaactcttctcttttactcactgcatccttttcttctcggtccaagggctgagtcacgtaaatatctccttcctggtcaattgaaaatgggaatcttggcagcttctctttgtcaactaaggaatattgtgcaccgggatcattccaccgcacctacagggcccaaagtcagttgtgaggaaagctgtatttggactgagagaactggaaaggaaataattttctagttctcaatttgaaatctctgacaaccttgtatgtttgtggtttcttgtaacaactgaattacgtttttcacttttaacctaaaataagcctgtttccccccaccaagttatattgctcgaaaaaagcacaccaggaaatgtttcttctctaaagcaattcttcacaaaccctctacagggtttctgggctgctttcttttggaagtctgactgtgaaagctttctatccacgaaccatccatttaagaaacaaaatgtactttgtggctggcagtgtctgaggactaagccacaatgtatggtgagcatctaatactcaccaatgaagatgaacaggggcaataggggccactctgaagtcttctccatgccattaagtaagacaaatgatacaaaaataaggacattcctttcctaaatatttagcctcagagacttcagggatgagaataactgccaactcctagggttgtttgtaaacaacctggcaaaaataaaaaataaacacaagtaagaccagtctacttgctatatagacagagcctggtctgatatattaataatgtttactgagtttgccacatgccagacacaattctaaacatatttatgtgttatatctcatttaatctccaaacagtcctctgacgtacagactactgttatctctattttataatgaagaaactagggcacaaaaaatttaagcgacttgcccaaggtcctactgctagttgaaatttccacagtaaactattctcagagcagcctgggaagatatcacagcagcaactttgtcccttgctaattatttaagcatcacccattgtccctgcagactaccttcttggttctaaagtgggctcctcttgtgttctaaaaattcagtctgagttcctcttcccatctccccctcccccctcccccctccccctcctccccctcctccctccccttctcccgctcctccttccccctctccccctctctctttctccctctctccttttgggtttcagaacacccagagcattttttccagacctgaaaattgggtaggcactctagaattttcccttggcagccccaaggcaactaagcatgagttctttgcagcatttaccaatccctttgggagtaacctgaataatagctatgaagactttagtctaggcccccaatcagaaattctcatggtaatgagtgctgacatgctttctttctaactgggaaatcagaattcttcctgctgttcttccttttttttccctcctgaagttgaagttcattaattcaacattcaataaataaatgtccctgggcccatcccaataaatatgatggaataggccattccagggccccttaacaatagtagcattaaaaaaaaattaggggaactacagactagtacttcttcataataataccttttatatctaatatttttatctacttttacagatactgtctcagttaatcttcacaaaacactgaagtattatccctattttattgatgagacattggggctcagaatagttaaatgacttgtttatgatcagtcattcaagtgatggaacaggaatatgattttgttcatctgcttccaaatccagggatctcccactaacccacagctttcatgtggaggaatttcctgggcttccagaaaatatcaaatctgggtggagtccagagtgaatttctaggagctaaggtaggagggggcccagggtaagagcacatgccacagaggtggggaagtaggagcatctgaacggaggggagaggcacacacaggagatagagtgccaggggtgagggagtttccaaggggaaaggttccctactatgatccttttacccctagccagtcctatctccgtccctcagcctaagatgggcaagtctattgggtcaagattttttccacaataagaagcagcagcctttcaaatctatttgcaacccccaaatcaaaccatgtccatacatagtgcaccataaatgacccactgcagggctgccatatcccacactgctaacagggaacaacaaacatcactgctgtctacttttaaggtgagggtgagtgaagttctctctgaaagcaaaagtatatatctgatgtcgtttggatgtttgtcccctccaaatctcatgttgaaacgtaatcctcagtattggaggtgaggcccagtgggaggtgggatcatgggggcagatccctcgtgaatggctgagcaccacgcccttggtggtaagtgagttctcactctgagttcacatgagacctggtgcttaaatgtgtgtggcacctcccacctaactctcttgctcccattgtcgtcatatgatgctcctgctccccctttgccttctgccatgatcgtaattttcccaaggccctcaacagaagcagatgctggagccacgcttgaacagcctgcaaaacgatgcaccaattaaacttttctttacaaattccccacctcaggtatttctttatagcaatacaaaaacggcctaacataatatctgcatccaagttgcctgcccatgatgcatggtcaagtccagtgactcggggccagaggctatataatttgctttataatcatgctatgaaaaaggtatctaataagtgtatcagtgaagactgtgagggtgggtctctacaaagtgaagccatttatctagttggctctcagtgttacttgggcttgggtactacctgagtgattttgatggggtgaggatcagttgagttttccaccatctccacaggttttggtgctttccaaatattctctgtcactatgatatccacagatgtggtatcactgaaggaattctcactctggcctcccatgtccttcactgagatcaccagattataggaaggattcttagcaggattcaattcctgagatcctgtgagaagtaggggagaagggaataggaagtgtctctggaagagacagaccaaactccctttttctgatcgagacagtcctaccagggcacccctgaacttaccctctcgggtaagagagatggctcccgttttgttgttgatctgaaagtacatgacattgttgatcatgggaagctggatgacaatctggtaataaagctggccattgggagtggccggatcatccaggtctgtggcattgacatacaagaagggctttcctgtttaacaagacgtacccagaaaaaaaaaaaaaaagatattaattgaaacccaaaccaaccatagctactttttccatctaaaaagtggagatataatagggaaaggtatgacaattcacaccagtggggaaataaatatttatcccactccccccttccctaaaataaggtttctcaaggtctggtccaagaacctctaagggtccctgaaactgttcaagtgctctgtaaagctaaaggtcatgtttctgtaaaagatccatttaaagtacaagataatttaatgaattgtagtgtaaaagaatggaaaatatggtattaattttgatttcactttgcaactaatctttaagaaaccacaatttattgagtttgggtatagtactaaagaatgtccagttatctgaaaatactattaaaatattcctctcttgtccaactgcatatctgtgtgaggctaattttccttcatatatttcaaccaaactagcacatggcaagagaatgaatgtagaaacagacatgagaatccaagcgttttctattaatccagacattaaagagatttgcaaagattaacacaatgccatttttcttactatttttgtctttaaaatcaattatttttcattaaaacatgttgattagtgttatttttaatgaattaataattttttaaaatttctaatatagtaaatgttgatagatataaccagtgatgtactagagacagctcatgagactcagttgttgaattttcagaaattttgtgtgtcaattattaataccaatggtcacttgaaataggccatggtaggagtatttgcaacatggaaactagaaaattctacaaatcagagctttgtccccctagaaaaatagctgttaagcctttaccaggacaccactggatataacccacctgtctaaaagttctctggagtcctcagtaaattttaagagaatatacaagtcctgaaaccaaaaagtttgagagccatttctctagcagattctattagtgaagagagaaaaggtacggcctggagcctacacatttagcagagtctgtgtgagtctttggtatgcagcttcagggacagggacatcactccacataataaactgaagtgaattttttcctggaattctcggaggcaggcattgaagaaagagaaggaagaagcttgatggtgggatgatgcaaatggccccaagtcttgattagtattattttaaatgaatatctttaaaatttctaatacagtaaatgttaatagataaaccatatttctaagaactctgaagtctaatattcatttatgttgtgtgcaactgttaggaggtgatgctccttcctaggtgcctgctggacacactcacgccttaatgaaggccttaatgaagggcttaatgaagggcttttgtggaagtgaaaggtagaaggtcaatgcagcatagagaagggctgagccacagatgggatgtaagagaagaaaagagctggaaaccaccagtgacaatatcaatggaggttcctaagaagatacaggggagtaagcttacctttctagagtgttctagagctctgaggtatcttagagatcaccctagaaaagcgtttttcaactgggggtaatttttgagacagaatctcactctgttgcccagaccgagtgcaatagtgtgatcacaacttactgcagcctcaatctcctgggaccaagtgattgtgccacctcagcctcccaagtagctaggactacaggcatgcaccaccacacctggcaaactattattttttgtagagacaggatctcactttgttgcccaggctggtctcaaactcccaggctgttctcaaactcctggctgaagtgatcctcccacctcagcctcccaaagtactgggattttgtgccctccacccaccagaggatatttggcaatgcctggagacatttttattgccacaacttggcaggggggcacatagtggatagaggtcagggggatgctgccaatcatcctacaaggcacagaatagcctctgaccaaaaaaagaattatcagacccaagatgtcaatacatagtgctgcattgagagaccatgctctggagcaatagagatagtgaaacaactcccaaatcagtgtgaaatgtaggtaagatagtgcttattgagtgacagctgcagctattagccacacaagtctgccccttccacctgacacccttccatctttccataaatatctctggcccctgcctgttacctgggcgagagttctgccttactgagccttcgtactttgactggagaaacgtgggtcgattgtcgttgatgtccttcacttttatggtgatagggactggaccctccactataattccattagcgtccagggctgcaacctgatgttgaggaaaaggaaaccatgttggtgagactgaacttcatgtcacatgcccaaaaatcacttgaaggaaattagaactcaaagaaccaatggcctggtgactgtaggagagaaagaactcacaaaaggccaaattgggaaatgctaaaacagggattgtatcagttaagcctggctaatcatgatggtgactttctatcagcagggtgttctggacactgaacatgcatctgttctggatggctgaagtccatgaaacaagagcactgtgacccctgagaatatgaaagtgttgtgttctcttccagagccattatggcggtcagcctgcaaggcctgcagcagaagtaccagacagaaagcttttatctcactcttttttccatagtaggctctctgactttcctaggtattcagataccaacggtgaaaactaaaggagaaagagagggagacgggtctttttagtcagctcctggctactggttccctctgcttcttccaacgcccaaaggagctccatcccagcaccgatacagccttcttcatgggtcccaagccaatgcaacagccacaggcagataccattgaagtatcagagatgtgctgacttttgatccaagtacctaagcatggtcttacttggataagtaatgccatcagagggtcctggcaatgtaagtggggttacgttggttaaaaagcctaaggaaaaggatatgtttgccacacccctctgtagttggtaagaaatggacatgtgaggattgcaaagcgtcccattaatgtaaggaaagctgtaactggattctgtgcaaggaaggaaggtgccagccatacttccagaacaaagggtgctcagagaggttggagttagatcccttcagctggtatcaatttacctggagattgtgagtagatcttgtttccctgtccaaggctctgttgtaatacagaagtccctcccgttctatcacaaatatgttgtctgtctccccagttagttcaaaagtcacagcaggaggattggccttaaactggggaaaaagcaaaaaacagattaagttgtaagggaaaaaacaatgttgtggaatttgtagaaagtcaccaatttcaggtaaaattttcattggttcaattactaaataagaaatcctcaacttttaaagtggtaccttctaaaagtttgtttgcacaataactgtgtaacatttaacatacattttcctcaagagactgtatactattattcaatacattgacaaaagtcattgatgctttaaattatagctggggttaaaagagactttttggtaatatctgaaatctatgacattactagcttctaagaagcattaaaagggtagctttctctctaggataaaatatgtcatttagcacttctaaaaattgtgacaaagattaatagacacgttaatgttaaggaaaagaatttataagtggctttaacttaatgcaaatgctatatgataatctattactttttcagaagtggagaaaataccgaccaccatattcatagatatggctatatcacttttaagaccacagcaacagaaaattcacataaaactaagaaaacataaaagctgttcaaccttaagttttagtatacttttatatatttttattaaattaaaagcaatatcaaagttagtatggatataaagaaacattgttgatggaaatataaattcctataatccttttggaaataacttgaggcataaaatgtttgtaccctttgatagcaaacattactatacataatttaccctaaggaaatatttcttcaaacaagtacatgcttatagtgaaagtaactttatttataataccagtaagattgaaaactcctaaatggtcaaaaaaaaaggacagtgaaattattatggcacatgaacttgacagaatattaatcattaaaatgttcattctacaaattatgaagaaacataagaaacaatgatgtaaagtaacagaagtaaatttgagagtaaatctagactgttatggtaccaaaagaattcatgtcagtaggtaagaaatggaatttaaaatataagaagagttgatgtgttaaatgggtaagattgtaagttaaaaagtttttgtgcatgtttgcttgttgatattatattgtttatataataaatgaacatgttgctattttgtgttttcagaaaaagacctggacatcagtgagaaaggtggagtaagggcctacagaaaactgctcctccataaaagcaatgagaacactggcaaaaattgtaaatatcatctttttaagaatatgggaaattaaccagatgcttgcaaaatccaaggaatgtttattaaaaaaaaaaaaaaaaactaaggtttgtggtgttttaatgcaccctaatcccatggtcctttcctaagatctgaagtagccttgaaagcaacagcctcacaccacagtaccatggagagggtgagaagcgtttgtagcttcccaaaagctccatcaccagagaactatcattatctatcctgttggcatttccctgggaacatctacttacaacacttatcttcatttgaccggactcagaattcatacaccacacacaatttttcccctggggcatttgttgaaaacaaccattagcaattgttcaacattgcagctgcctgaggctgtgataacagttgaagcaaagaagcagctgaccaaaacacttaaaagggaaagctgggaaatgagatgtccataaggggctttgaaaatctctaatatattcctggcaatctacaaggccactatcatgagcagggctgtgtgcatgcctgggaaagacctgagaaggccctaatccctcacctctggctgacttggaggctctgcataagcagaaagtgaaggcgaaggcagagttgtaaactgcctgccacatagttgaaggttgtgtcccaacatgcacacagtgccccttggtaaacaccaggagacttactggcttaaggcatttaaggaactctctatctagtcattagctgaacactaagctgactgagcagacttcagtggccagacatgacaaagaatacagactttacagaattcattatggaaagtcactaagcaaacaaacagcatcaacaaccaactccaggaaaagaaagatatatgatttctagagttgccacatcacattatttaaaatgtttggttttcaacaaattatgaaatgtacaaaaatattaaaaagtcaatagaaactgtccctgaggaagcccagatgttggatttactaaagatttttaaaaatctattttagatagattcaaaaactaaaggaaatcatctctaaagaattaaagtttgaaaacaatgcctcatcagatatagaatattgattaaaaatagaaatttttaaaatagaaattctacagttgacaaggatgataactgaaaggaaaaattcataagagggtgttcaaaagcagatttgagctagcaaaagaaagaatttgtgaacttgaaaatagattaatagagattactgaaagaaaaaaaatgaacaaaaatgaatagattcccagagaccagtgaaacaccatcaagcagaaaaacacatacataataaaagttccagaaggaaaggaaaaagggggaaaaaagattatttgaagacagaatgacccaaaacttcacaaatttaagaaaaacatgaatctatatatccaacaatcactatgaactccaaatagaataaactcaaagaaatccaaatttagtcacatcataaacatttgaaagatagagaatcttaaaagtgcatagactcatcacatgtaaaggatcctcaataaaattaacagctaattttccatggagatcagaaggcagtggaatgacacattcaaagtgctaaaagaggccgggtgcagtggctcatgcctgtaatcccagcactttgggaggctgaggtgggcagtcacgagattaggagatcgagaccttcctggctaacacggtgaaaccccatctctactaaaaacacaaaaaattagccgggcatggtggtgggcatctgtagtcccagctacttgggaggctgaggcaggagaatagcgtgaacccagaaggcggagcttgcagtgagctgagattgtgccactgcattccagcctggaggacagagtgagattcccagagtgagactccgtctcgaacaaaaacaagcaaacaaacaaacaaacaaaccaaaaaaaaaaaaaaaaacaaagtgctgaaagaaaaagagtggccaagtaagaactgtaaatcctacaaaactatccttcaaaatgaggataaaattaacctatactactatcagacaaaacagactttaaaacaaaattttcagagacaaaatgggatattctataatgatataagggtcaatccatcaagaaaccatagcaattataaacatatatgcacctaacaatggacctcaaaacacatgaaagaaaagctgacagaatggaaaggaaattaaataattcaacagtaataattgacgatttcaagactttactttaaataatagaatagaaaatcaataaggaaacagaagacttgaacaatactataaaccaattagaagctaacaaacacccaacactccatccaacaaaagccagtcacatggaacattctccaggagaggttatatgttagaccataagcgagtctcaataaatttaaagggattgaagttatacaaagtatttgacaattgaatacaattaaaaacaatataaggaaatttgggaaaatcactaatatgtaaaataacaatatactctaaaaaccaaaggtcaaagaagaaatcaagggaaattagaaaatactttgatgtaaatgaaaatgaaacacagcatgccaaatcttatgggatgcagataaagcagtacttagaggaaaatctatcactgtaaatgttcatactttacaaagatgaaatatcccaaagaacctaatcttctacttagaaaaaaaaaagaaaagaaaaacaagaaaaagaagaatagcaaagcaagcagaagaaaataacaaagatcagagtggaaattaatgaaatggagaatataagagcacaggagaaaagtcaacaaaaccagagttgattatttgaaaagatccacaaaagtgacaaacttttggctggactgatcaagaaaaatgaggtaagattcaaataactagaatcaggaatataagaggactactaccaaccttatagaaacaaaaagtattaaagagaatattgtgaacaattgttttcccacaaattagacaacctagatcaaatggacaaatttctagacagacaaaaactactaaaactgattcaagaacacatagaaaatctgaatagaactataacaagggattgtattagtaatcaaaaaatttccacacacaaaaaagcccagaaccagatggcttcactagtgaattgtacctaacatgtaaagaagaattaacatcaaaccttcagaaattcttccaaaactagaagagtaaggaacacttattcaattcattctatgaggccaatatcctgatacccaaaccagaaaaaagtcaatgcaagaaaacttcagactaatgtctcttttgaatataggcacaaaattttccaatgaaatactagcaaactgaatccagcaacatatgaaaagtattatataccattaccaagtggaaattataccagaatacaaagctggttcaatctatgaaggtcaattaaggtagtatcccatattgatagaatcaaggataaaaaccacatatttcaatagaggcagcaaatcatttgacaaaatccgtcatcctttcatgataaaaacactcaacacaccaggaatagaaggtgacttctcagcctaataaggacaccgaagtaagccccacagctaacattgtacttaatggtgaaagactgaaagctttctccataagatcagaaacaagacaaggatactcaatcttgccacttctatttaacattgtactagagattctagcaaggggaattaggcaagaacaagaaataaaaggcataaagattggaaataaaaaaataaaactatcactattcacagttgccatgattttatatagggaaaattctaaggaacctaaaaaaactattacagctaataaacaagtattataaggtttcaggataaaagatcaataaacaaaaatcaatctttctaaccattagcaaatagcaacccaaaaatgatatttttaaaattccatttacaaccacaacaaaaagaataacatatctcagaataaacttaagcaaagaaatatgaagcttataaaatggaaactacaaaacactgttgaaagaaattaaacaagttctaaataaatggaaagacacctagtgtttacagatttaaaaatctaatgctattaagatggcaatacttcccaagtttatctactgattcaatacaatccctatcaaaattacagctgccttgtttgtagaatttccaggctgatcctaaaattcatatggaactacaggggactcagaatagccaacaacaaagtaggaagacttaacgttctctaatttcaaaatttactacaaaggtgtagttccagataatgcagtactggcataaacatatatagatcaatggaatcatagtgggaggccagaaacaattcaattgatttctgatgaggatgctaaattcagtgggggaaagaatggtgttttcaataaatggtgctagaacaactggatatccacatgcaaaagaatgaagttggacccttaccccataccatacacaaaactaactcaaaatggatcaaagacctaaatagaaaaactaaaactataaaactctgagaagaaagcatagacataaatctttatgaccccgaatgaggaaatggtttcttagatatgacatcaaaagtacaaataacaataacaatataaattggacttcatcgaaattcaaagcatttgtgctccaaaggacaccaccaagaaagtgaaaagataacttatagaatgtgagaaaatacttgctgcaaatcatatctgataagggagagaacttgtatacggaatatgtaaataattcttacaacaataaaaagacaaataacctgattaaaagtaggcaaaggatttgaatagacatctctcccaagaagatatataaatagtcaattgccccatgaaaaaatactcaacatcagtcattagggaaatataaaccaaaaccacaaagaaataccacttcacaaccactaggatagctataattaaaaaaaaaaaaaagacagataataacaagtgctaaggatatggagaaattggaactcatacattactggtgaaaatgtaaaatggttcagctgctttggagaacagtttgtggtttctcaaaagtttaaacagaattaactttgacccagcagtcctgctactgagtgtgtgtgtgtgtttgtgtgtgtgtgtgtccaagagaatcaaaaacatgtcctcataaaaagttgtacatgaatagccatagcagcattattcattatagccataaatgaaaaaaaatgtccatcaattgacacatggatatccaaaatgtgatatatccagatgatggaatatcactcagtcataaaaaggaatggagttctggtacatgttaccaacatggatgaatgtttaaaatactatggtacataaaagaagtcatacataaaaggccatatgttgtatgattccatttacatgaaatgtctagaacaggcaaatctatagagatcaagagtagattagtggttgcccaaggctgaggggagtggaggctggagagtgactattaataggcataggatttctctggaggctgatggaaatgttctgtaattagatagcagtgatatttgcacgtctttttagatactaaaaactactgaattttagaggcatgaatttttagggttacatcttatttaaaatgagaaaaaaaaagacctctctcagatttatatcacactgtctgatgatatggaagcccctggtgagtacagagctggcactagttgaaaatccacaatgaaagaagtgtatggtggttcagttcattttatttttgaggacatattaaaaacccaagaaccaacctcatggggcaatgagtgttcttcatgcctctgtaggtccaggtgctggatgagaggatctgtacacctacctcctccccaccactgaagcaaagagctccgagcacatcttaccaaggctgggtttgctgcattctttccacgtacaaagatggagagagcaaaatgtgcttgactagaagtcaggagacctgtgttctattgttggctctgccattaactaacttaagcctcagtttccccatttttaaaacaagcggttgtaccaaaactccccagtgtgttttctagcatgaagcttctgtgattctaaaaagaaaatccccttcatcttcctctcactactctgtcatcccaaccccacaccctaccccaatacacacacacacacacacacacacacacacacacacacccctgtaaagaagaaacattcaaccatgataaccaggctatcatttcctgctaagaagggataactttgcagcatgactaacagaaaaactaaaacaaaacaaaaaaagaaaagtggagcagcccaaggcatgacttttactggctaggatccccagagactctggaatgatcctactgaacagtttctaggtctggatgtttgtccgttgtaaagcttgtaagttgaagattgcatctatgtacaatcctgattgtcttcaatggagtgtggacctgtactcacagaacacctactctattttgaccttgggtcttttcatacagaaatctcagaagtagccacaaactttgtttcacaaatatgttttatttagcttgtaattaaaaaaaaactatgccaatttttttacatcagtgaattttatataaatataacattttatgccttttctaggaaaattataaaatctagtagagtagtacccaaattctaactcgtgaaaatcgtctggagctaaattaagcctatccccttttgacttactttcagtttgccacagtccccactactccctcttgtcccaaatactaaagacaagtatgagaaagcgtttgatttcatatttgtgcagttgggtttttttctcatatctgttttttgttgttgttgtttggctgttgtttttcttttttccatatggcttcatttatcactcagctagcccctaagagcagttgagataactcaccacagacaggtatctatgtcatatccaagcactctattggcacctatataaggaagtctccccaatctgtatctcctgacccatattaacactgtctgagacctctccacctggctgccccacagataaccttaaaatcaataagcctaaaactcattcacttttctctaaatcttttgctgtactctctctctctctctcactcagtgacaccactaactacccagtcaagcaagccagagacctaagagttgtccttctttctgttccctcatcccctgtgctcattcagaaacataaacaacagaagtttatcgctcatagttctgaaggctgagaaatccaaccagcagattcagtgtctggtgagggcccactcctcacagactgcacctttcatgtgtccttacatggcagaagaggcaaacaggcacccccaagcgtcttttataagggcactaatcctattcatagaggtagagccctcatgatctaatcacccaccaaagaccctaactcttgatattattacattggagattaggcttcaacatatgaactttgtggggacaccaacattcagacctctatagttactcaaaccaggcctccctcacttcccgttgaactattgaaaacagttttctaaaatccttttaacgtctaggctcgctcccttgcagctcatgctctgagtgatcacacagtaagcttctacagcacaaatctagttacggttttccttgttgaaaccctccagcagcaccctgcagcctgctataggacgaagggctagtccagcccgtgctgacctccgcaggcatgcagacctttgactgcatcctgtctcccactctatactctggcccacatgccagctgtcattttcttgacaagtgcacacccccatgctttttcccatcctgtactcagcacctgcttcctgactgtgagcacctgctcgtttttgagtactcagtttaggagtcaatgaaacctcttctgttcgctcactaccatctttatttgaaattgatcattcttagattttaagtgttctcaccacaaaaaagagataagtgagataatgcatatgttaattagcttcatttagtcatttctctctatacttcaaaacacattgtacacaatatgtgcaattttgtcaattaaaaataaacataaacaaataaaaatcagtcactctttcttagtttaccctctgccccctccacatcccaccagcctcccatgagaagcttcagtgcatgtgtctgtttccttgttagttttctcttactagctggtaagctcaccggagcagggatggagtcggggtcatcccatatccccagtacccagcagagcagctggtatatatagtagtcactccgtacatggttaataaaagaaagtctgtgagaaaaagtaagtaattcaactctgtgtgagcccctgccagagtcccctagccagttccctgaatcctctctttcctcctttagtttgtagccagagtgaccttttctcaatggagtcttgattcagatccattgcttttgagaaaaactcaagatccttaggagtcagggtcctccctgtctctgtggcctcctctcccacctgctcctcctggctccatcctccctacctgcatggccttctgctagtccttggtatgtctcctgccctctcctggcagagggcagccatccctgccgggcctcttctaagctttcttccctcccttcctcaccaagttaattcccatcaacctccagctctcaacacattcactgcttcttcaggccctgacttccctgactggagaggtggaggcccctaataacaccctacctcaccgggctgcatagacatgcaagcatgcccctgccagctcttactctggggccctttgccttaagctggtaccaatgaaagaaaggggaagagagatagctttcagcctctcctctgtggaggggaactgtccagcacaatacagttgtcccttggcattggtgggggctcattcctggacccacgcagataccaaaatccacagatactgaaggcccttatataaagtggtgtattatggtcatggaacctactcgcattctcccatatacattaaaccatctctagattatttataatacctaataccatgtaaatgctatgtaaatgattattatactgtatttttaaatttgtatcatttttattgtttttcccaaatatatttgattctttgttggttgaatttgctgatgcatgaacccacagatacagagggccgtctgtaaatttttggcagttaatggaaggcacttgccttagaaggtaggtagctcagcaacctctgccacttccctggttcaggggacggggaggggtcacgggcacccccaagaaggctcatcagcatcctccaatcacttcagggccaagtgactttctcaggggatgtctggtaaatacagtagtgttttccccttctccactacatttccaggattatttctgtgtctttaatagcacttaagatgggacttaggtcccttcccttattcccacctgcagactgcccctccatctgatactgttcatggttatctaactaaataaaacgtccacctcccagtgcaccttgacaatggcccacatgggggctcagagaaggtggtaaggaaaaggcagtcctctggccagaaagctcattctagcactgactccagagaagccgtatcttccagtacttgaagcagcaagctcattgatcagacagcctcgagggtggatggtcattcccctctccagagacaggttccctttctactctaggggagaggcagagcctgcagccaccaagctccctgcagagggctgggagcactcgccccagagatgattgaggaagtccaaatagaatgtcaggtacaattcttatgatactgaggccactcatctctctgtttaacttagcttctgaaatcattcttgataatgagaatgccatgcctttattttatttcctgctatacaatagataaggaagtaaaagtccaccaagagagcatacaaaatcaagaggacagtgatcaagggtagcttttacctggaatataatttgactcggttcttggccttcataaatagaaaatgtcatgggtttcaggggtccactaaacttcccctcttggccatatccagttgcctgttaaaaaagaaagagaaaattagcatcttgtatgaagtgtctgtgtcactcattgattttattagggcttccagcaccaatatacaaaacataggattctatcatggctgaaatctgatcaaaacaggaaagagtgtaatagctgttgaagctctaccacgtcaaagtagcttgttacaaacctttccattgcttttcttaaacatctgagcagaatgtgagatgagaagaatcactctatgagaagaatgttaacatccccatattacaaatgaagcttaaaaaggttaacacagcacacatgctcaggcctaactgaactaaagcccatggtcttccacaatcccacactgtcttctaaattatatatgtttttactccagcttcataaaacacctccctccactctttttattttataaagacatttacagcagattgccagcactctagtgttttgaatttataagggggagaaagaaaatatagacgtatttagtacaaagtttgcttggcacagttacacggtaagttttagccaaatttgaatctgaatttgaactataactttaagcaaagcttactattttaacatttgattagctctttacattcatttagaaaaaaataaaagtacaaaatgtttactttaagcagtagccccacaatggttccaaaatccaaagaccctaaacttgaaagctaagcaggctctgcagacacccaagtcaagactggagtagtagtgaatgtggctgggatggtaagaagagtggctcacacttgctaagttagtacatgtggagctctgtcctaagcacatttaatcctgacaaaaactctggcagaaagttactattgttacccttgtttaacaggtgatgacactaagacccaaagaggttaaattatttgcccaggtagtggctggaagcaagatttgaacctgcaactctggaaccagccctctcagcctctatgcaccagcacccaccagagcgggtgaaacagccaaggcaacctggagggaaaactggcaggctgcactgaagatgtgcatgagagtgtgactcccaccattcccagtctcagaacatggggagcatcactgtagccctcaccacaacagcacctctgaaggcagatggagtgggcacccacgggaagggacagccagtcatgcagccacgttggggcaccctctaggaccagggatttagtgcctcatccccacgctggccttctctccttcctgggcacgactttgggtctcccatttgtggaaatcaggggtgaaagagattgaaatcagaagcatgatgtggcaagccaatggtttttggagctagacaataaaaataaaagagtaaaaagtcttctcactccctgaactgggtatgcaggacagatgtccaggtgccactaggttgggggaaaaccatttattttccagttatttagggagagcaagcacactcttgccatggaaactgctccctgctgggaatacccaaaagccatcaatatgccagtgatcagagaaaggtcttatgctagatccctcagtctggggaaccttgactaagttggatgctggatgtctggcaaaaaagcaataatgaatgagaacacaggggctttgaagtttggtcttctgttctcagatttgtggtagggccttagatttgctgcccctgggccactgccaagccctctccttttcttcctcccaccacagagaccggtaaaccaagttccctttcccaggctcacttgcagctaggaaggtggccaagtggcccagttctggttcatgaaatgagaggggaagtccactggcagtggtcaagcttccatattcctgattttaaaaaaaagggtagttgtggctgccattgccctttcctgtgactcttgctgagacaatgtaccttgtgtctgcagttggggcagctgtgatgaaccctgagaggacaaaccagctcaaaaaatggtgtagcaaagaaaagtagcccaagtctctgcaacatcatggaattgctaaacctgccctggattgcctacttcagacttcttgttatctgaggaaaataaacccctatttatttaaaatgctctaaagtcaaataagtcaaatttcctgttacttgcaagaaaatgctttttttttttttttttttgagacagagtttcacttttgttgcctaggctggagtgcagtggcacgatcttggctccctgcaacatctgcctcccaggttcaagcgattcgcctgcctcagcctcctgaatagctggcattacaggcacccccccaccatgcccgactaattttttatatttttagtagaaatggggtttcaccatgttggacaggctggtctcgaactcctgacctcaggtgatccacccgcctcagcctcccaaagtgctgggattacaggcatgagcaaccatgcccggccaagaaaatgcatccttaactcacaaagtaatgttgccagacttctagcccatctcctcctttctaagtttatcttcctttgggaggtcttcatccctttcactccttttccacatcttttcctgttccatcagctcctctagaaggcagggcataagaactgggtgtgcaggacagatgtccaggtaccaccatggttgcttaagtgaggtcagtgctttctgtggagctgctgcttatcagctttgcactcatgtcagcaagcagtctttcagttagtcacaccagtgaaaactacattagccacacacaaacaaggctgcactattccaacaaggacaagctggctcacccatcagaaaatgagaatcaagtcttggttccagggttcaaagttgcgtgcttgtattggggcaacaaatctctcttcctgccaataaacatgactattggggctataaagatttcaaagtgcatgtggacactgtgaatcatcaagccgctttccccagaagtgggaaagatggtatggtggaaatctgtgaaaggacaagatggcggctttatgcaggagttggagggaatagcgttttccatcttgcacaaagaggtgaaaggaagagaatggaactgccatcttaaagtcatttttagcatcttttatgtggcagtaatgggacttgatcaccacaagacatcatttcttctgaccaatgctatgaagaaagtatctccagagaagtcccacagtagaagcaaagcattcagagacagagctacctccagaccagacccagcgccattggaccaccaagccccaactcttaaccacattgttactgccttccaggtcaaaggacatgtgcaattgccaggttcacctacttggtagctccatcaagagctcagtgcagtgattatgtagtatttgtaccaaactcatcttccttctggaaggcccaggcataactccaaaacagatggctctgccttggtttcctccgattccctgttcagtaccatttcccaaaccctggatcacttatttactctctctttggtgcccctgaagtacatcaatgccgtatttgtgtttctaaccctctgataaatctatctcttggaaaagaacagaagatctactcgcagtctggagtaaattagtgcttctgttgaataaagccctatgcagaaggcaagattcttcaagcaaacttccagtcttcatagaagaggccttgggaggaggtaggagagagaagtggctccctcccaacacccctgaaatcccactccctgacttcacccagagacagctgtgcttgtggctttcacctgggtaaggcactgctgccagcagtggttgggcagtattttcactctagatagaaatcccactggggtgagagtagagagaaggaaaccttattttcacctttcatccaggaataaaaatgcatgttcccttctcagacaagaagcaaataaggcctaataattagatattattattaaataatttagcagtgtgctcagtgctgaatctgcaaagatgataaaagcacagtccatttttcatggaggtcagagtccatgtggacgtacacactgaacacttaaaatgctgtagtaattatagtagctaatgtttattgtgtgtttaaccaccagtcgctgatccaagagctttgtaaatgcagtatctcattgaattgccacaaaatcccataagacaagtactattattagatccacttcacagggcagaaaactgaggttcaaagcttaggtaactcaccaaattcttatcactggtagtggaggcaccgagtttgaatccatgtctgaatttgtcactaccctgggataacataggtgacaaagggcatttgagggggtagcatgaggagagaggtcaagtggggatgtttgatccagcccttccacaatcctggagacaggctttgagcctgcaggctgtgaggactcaggcttctcataaagtttgaactgcagatttcccccgggaggaaggctctgatagttttcaagtttcattcaatttcacactgtcactatgtgagctctagggtattttttgggacttgaaatttgatgtattatttatggatcccagaagaaaggaagtaagatttgaggtatgaggatctagaagcttccttctttaaaaaaaaaaaaaagagagcaaatgcttcctctaaatcttataatctcgtttcataatgcagcaattttgggggcaacctttatgaacctcagcagtcacgtagattttaaaaaaaggcacctactgtttaccccaaggtcaagggtgaggactccccagtttctatccagctccgagctctagaagcctgtcagtcaatagggttaacccaacaaatggttaaagacaaccagaaaattccaaacccttgatgagaagaaaagtatagagcagagcaaggctgaaaatagagaaaatgcttttcttgatgttttggtggtaagttttcatgcgcaaagtttaaaaaagaaagtcaagattaagggacacagactaattcatgtatcagtgcaatgtcatttcagattccctgagctatagatagatttgttttcaacattacccataactggtgttggcttttaagagctggaaagaaaatacattccctagtcgagggcagacatgtgatttgtagccatttcatcgaaaatatcacagtggaacaagctatgtttccattctatacaacaacttaattttgataggtcatctttttttaagtaataatagccattctttccctggtgtggggtagaaagatagcagaaaatattctagtaaacaaatagagaagaacaccctcttctcttaccaaataaagcataagaagacacagggagtgaagatgggcctgaagtatcatagttttctttattcaaattcctgtgaaggaaccagataaaaaaatggttagttaccagtctgttaaaatcatgtctttccaatcagtaagaatcaatggatgatatccagttataaatctagtaaaatggtatcccaaaaggccagcctctcctctatatggagcagcccagtcttccagaagcttcatgcacatcatccatagcaatatgcaagccaacatctcaaaacatgctcacaataattccatttatctaactgctttgctttgttatgatcttcttcatttcagcgtcttaaatgatgggcaatgagtgtttgttttggggtttttggaaacgcagtctcactttgtcatccaggctgtagtgcagtggtgcaatctcatctcactgcaacctccacctcctgggttcaagcagttctcccaccttagcttcccaagtagctgggattacaaatgcccatcaccacgcctggctaattttttgtatttttagtagagacaggatttcaccatggtgaccaagctagtttcgaattcctgacttcaggtgatctgcctgcgtcggcctcccaaagtgctgggattacagatgcccagccagcaatgagtattcctttcactcctattatacagatggagaagatgtattttggcagattccaggataactaaacattttgattcaaagccacaaacatatgagattccgcaagtgaaaagaactaaagaatgctcacaattcttcattcaaagatgtcaccagctgcctctttgatcttctagatattgtcattacctacacaataaacctaagaaaaaattaatttcttactattccaaaagagatcaaacaaaaatctgaactctgtccttattgtctcctgtccgatattatttttcccttcctccttaaggcttcccatttcacagagattgtgactttcactatgagacatgtcatgactaattgattttaagatgtgagagaaattttccacatggcctggaaaacagtgttgttacctgtcataagtttggactgcccctccccaaaagacagtcaaggaaatttttttttttttttttggagacagagtcctgctctgtcgcccaggctggagtgcagtggcacgatctcagcttattgcaagctccgcctcccaggtttacaccattctcctgcctcagcctcccaagtagctgggactacaggcgcctgccaccacgcctggctaattttttgtatttttagtagagatggggttttgccgtgttagccacgatggtctcaatctcccgacctcgtgatctgcctgcgtcggcctcccaaagtgctgggattacaggcgtgagccaccacacctggctgagtcaagaaaattttttcaatgtatttatttcacgaaaattccaatcactttattatctctagagattaggaataatcttggtttacttcatcatcttattctttaaagtttttctacattgaacacatatcactaatatcaccagcatggaaaaaatttcactaacattttaaccactctaaaaatttagatcctgaaaattttacatgccctacatttgcataacttatatttgaactttaaagggtaaaaatgctatttcattttagcctcaccaatgttctgggagataaagaaacaatcctttattaagcatcacccaggatgtagatttgcagagaggtctttaaaaacagtaacaggcgggaaacaatggttcacatccagaagcccagcactttgggagaccgaggcaggtgggttgcttgagctcaggagtttgagaccaccctggccaacatggcgagacccccatctctactaaaaacacaaaaattagccaggtgggtgactcattgcctgtaatcccagctacttgtgatacaggagctggaaataaattatttaggcagatagtaagggtaagagagtcctcagtaaggtttccttttaacaaaaagcagccccaaaatcatttctaacaaagagcagcctgtagaatccagctgcagacatagataagcaagctggaagtttccacaggtgaatgccagcagctcggccaataggaaaaggctatctgggggccgggcatgttcaacacggcggctccatcttcccttttctttgtaaccacgtgtacagtaagcaacagactatatggtgctagccaggtagagaatccatctgcataataaaagattaggccagcttcttcaagcactatgcaaacatcacacctggtccaaccaatctctccggccctgtgtaaatcagataccgcctcctcaagttcatatataaaaccctgtgccatttcaccacaaaaccggaagacccactcgggcacccccctctatctgcaggagatagagctaatccgctttctctttcttttgcctattaaacctctgctcttaaactcacttcttgtttgcccaggttttctatttctctaccctgagttgatgacctcgggtatttatcccagacaatgatgccacttcacctgggaggctgaggtgggaggatcacttgagcccaggaggcagaggttgcagccagccatgattgcgccactgcactgcagcctgggtgacagagcgagaccctgtctcaaaaaataaaaataaataataaattaaaattaaaaataaaaacagtaacagagtggtatggcaggtaggcttggagtcagaaagctggcctagcaacgcagcactgctctctatagctatgtggctatggatatactacttcatctttcggtgccttagtctcctcacatggaaaacacatagccattgctcaataataagtttgtcctcttggccaggcacggtggctcaggcctgtaatcccagcactttgggaggctgaggcaggcagatcacaaggtcagcagttcgagacaagcctggtcaacatagtgaaaccccgtctctactaaaaatacaaaaattagccagaagtggcagtaggtgcctgtagtcccagctacttgggaggctgaggcaggagaattgcttgaacctggaaggcagaggttgcagtgagttgagactgggccattgtactccagcctgggtgatggaacgagactctgtctaaaaaaaaaaaaaaaaaaagaaaaaaagaaaaagtttgtgctcctatgattttctcagatataatgagctgggaattgttcttctcattttgtaggtgagaaaattgaggttaaaagtcaagcaatttgcctaaagacatacagctaggaagtgacattaccttgcctccaaccagattatcaattccagagtttaaactctggaatttcaactcttgctactgtgctttatatagtttgatagctacctagatgtagatgtatgacatagagcatggacagagatagagctgtagagatatacaaatatcatgtatgtatgtatatatatttatacatgctatataaattaagcaacttgccctgaaattccacaactattttaaggaaaagctaggattaaaacccttcaggactccaagattcataaattccttgcatgtttaaaaattagcttttgcaacataattaatttggttgacatatctaaacatcattttagaattaactcatagttaaacaagacattactgctttagagtacttatttggtttggaaacacatagaaacaagtaacaacctcagattctagcatattgcaagatgatattatcaattataaatgaataaattaagtctaacaaactagttttctgtaatattagcaaaatgtacacggtcagctatcaacctgtatttgcttaatacaagtaaaaatataggcaataatgacacattgggagatctttctccttaaactcctcagcattcaagatctttcaaatgctgctcccaactcttccagccttatctgccactcccttcccacacccagtcacacctccacccagatggactttgcaccctgagctctctggcagccaagctctcacccctgctgctctccctgcctggcacaaggcctggcccagagaaaatggacaatggatatttgcttaatgaggttggatggagatgtttcctcatttctgcttctcacatcttaccatctaagttcaacttaattatttaaatagcaatgaactacaccacttctagtatgtcccagataccgtgccaagaactggggtaccaaaataaggggtacaggttctatcttcatggagctaggacctaaaccctacttccttcatgaaatcttccttgatttccagccagtctcttcctctcagagccagttctgattgatatatatatatatatatatatatatatatatatatatatatatatttttttttttttatcatttgtctgttagcattactgccactattaaataaaatccttaagggcagaggccttatttttaacttatcaggtctcttcatactatcccttgcatatatcaagccatcatcagatgttgggtaaattctaaaacatttatgattacctaacatggatatcttattaatttgttctcacctgtaagagctttcaataaacatgatatattaaaggaaactcattcaacattcaaagctttattgtgtaatacatttttattgttgatgaaaagagttgtttctcctttgaatacactaacagatttctgctcagtaaataacccagaactggtcgaactagatcatctcttcttgaactaatttttttttttttaacaccttcagtcttccagaaaaacacaagttaaatgatagaaaagcaaataaaaataaaaggaatgccttattttggtcagatgctcagagagatcactgtctgggatgtttcaatggaacctaggaagtagaaggagaaatgtacttatcctttattttgtcatttacatttaggcctgcccctcaccgagggtttccagtgggaagtagaagtcactgctttccattgccacacgtagggtgccatgatttatttgaagacaaatctaccacaccatgcggttgttaggagcatagacccaggagttagactggctggcttgggtcttaactcctccaccggctgactcgtggccctatctactcatctataaagcagggataataataataatacctaccttcgagagttaagagattcagcgagttaatatttggaatactgttggccaaaaattcattttgccactcacgtttgcttagtcaaaactgtaaacattgtccaacaggacatttctcttcacaattcccaacttttggtggcccactaatgaaaatattctaaaaacagcctacacaggaacatcctcacagccaaatgaggcagcaaggcaaagcctttacccgaatgattcaaggcaaactacactagtgctaggattatgtcaaaagaggactttggtctctcaaacaggtcccacctacacttcctccttccatggacacaataccattcaagtgtggggtaccctgggtcgcaatggtgctgatgggaagccatccttcatcactgaaattgcccgaaaccaccaagccagacacctaggtttcctcaaaaacactacttggaaaagaattgaaatagatttccagaggattctgtggcattttatctgaactacctgtaataattggccaaccgtctgcgtggaatttttgccgtttgtcaggatttccctcagatacaaggactaaattcagacagttactacagcaattatttgagagaccaagcacaccctttgcaacatagatcagagggttattattattatcttttgtttttttttttttttttttttttttttttttacaaaaaaaggagttttgaaaagaaggcctcggttcccaaactgtggctgcccctcacccaatgggcaccaccatgaccaccacttgctcaacagtagaccagggcacctgcttgcagacgggaaccagggctgctgggcttgctctgcaggaacagtgcctcattttaatctaccacacaacagaagacatgggaatcccgccgcggcctggatctgcatccagcccggataacgacaaaggcagcaaacattgactgaaaacaatttgctgcatgcaccgataagacttggtggtgaaaaactatcttgctgatttctcagaacaactctatggagcagatgctattataatatacctcttaaagatgaaatgaaaaatcaaacgatgaagaccacagaaattaagagacttgcccaaggtcacaatgccaggctaattttcactccctctgaaacacaaatatcctgatgatgagacaccaagtatcatttaatccactacagatctttccaaaatgttgaaaaggttttttccccctactttgcagctgctctttttttcagatgctgacatgacctgccccgacctgcctggaggaaaaggctgccttggtctgggaagttttgtttctactgcaaatgtatctctgtgtctcactatttctcctcatttctgtgcttcaccttaggaatcttcccttttttaaatcaatccaaatgctatgggtagaattgtgtctccctccccctcaaaaagcatatgttggagtcctaacttccaagcacctcagaatgtgactttatttggagtctttacagaggtaacgaagttaaaatgaggttgttagagtgggctctaatccacaatgactgatgtccttctaagaagagatttggagacaggctcatccacaaagaaagaacactgtgtgaatgtacagacagccatctacaagccaaggagagaggtgcacagaagatccttccttcacagctctcaggaggaaccaaccctactgccctcttgattttggacttctggtcaccagaactgagatggtaaatatctgctgtttaagcctcccgttctgtggtattttgttaaggcagccctagcaaatgaagaccccatggaacttttgtttagcctgtgctgctgtcccaggacagaggtggcctcacagggggctctgctcagtcattagacacctagggaccccccgcatcccagcagcccacccaaggcttccttgattctcccaccaggctccaagctcccaaggggattaacggcattcatttatttttttttagttacataattaggttcttcttaagaaatttagaacaccaatttgtgaggataaattccattcaccagggcacacacagattgcaggtagccctggagctgaggaatagctttgagttttggtaaaatttgccagtccatggttttctgatcagccttgcactgctttgtagtcttacatttctctttttctgtcaaagatctcaccctcctactgactaggcttccacaactgcttcttaaagtaggcattggtaagatgttttgggtttctcacactgctggtatcgattttttttttttttttgagacagtcttgctctgatgcccaggctggagtgcaatgacgccatctcagctcactgcaacctccagctcccaggttcaagtgattctcatgcctcagcctctcaagtagctgggattacaggtgtgtgccaccatacccggctaatttttgtatttttaatggagacggaggtttcgccatgttggccaggttggtctcgaactcctggcctcaagtgatccacccaccttgacctcccagagtgctgggattataggtgtgagccactgcacccagtcctgatatcaatttttatggaggtggtgatgacaaatttctggtgtgtccttcacagaggaactccatggaagaccagaggtccagccacaagtaacaagctactgcccagctgctccaggaaaaccaccctcctgccttggtggcaccaagggaggatgagcagaatggtctcgagggccgtgctggctccaagttttctcacatgctgactgcagagtttcttgcgatggctggacagcttttgaggcacatctctgttggataatatcaaggcattttgtgaagtttaaatagccaggcatcaccattcttgtcacctcaactgggtttgtaacggttgcgagattcttttcaatcttgggtttagcagctaagtacctcctctcgtacatggcctttctggaatacatagcagatcaggaatatctgccaattcctccaatgaggacaggattttgggcttccccttcttgggctttttagctctgaggttccccttttcaccttgccactggcaaagccttgttagcttcaggtttcttctccttagtatccggcttctcaactttttcacccaccatcttgcaagatgggaaggtgatgtttagacgctcttgtcatttacccatttatttgagtaaggacaaggagtttctacgtcccagatctccagatttacaagtcaacacataagcattgatttttgtcccccgtgaaaaaagctaagtgatagacaaatcttagagtcagtcatctcttatttatttattttttaaaaagcatgaagggctttgaattaaaataattcacctagcactaaggctgagccatgaagcttcaaagaacaaagaagttgcagaaggagagagctacagaatttgttttcaaatatcctaaggtagtgtgggcaggaagggatgtgactggaattcataacaccaccaggaccaaacagtgccaaatatcctgtgagccatttatttttcctcctcactgtatattgctaagagcggcataaattataaggcaaggccagatagatataaagatcagatgaaaatctcgcccaaaccatttttcatcgattaatgttcagatctgccacgcccatctttttggtctggctcacagatctctggcaccaattgcatcactcaaggtttagagaaccgcagaagcatctgaccaatttgcacttttgacaaattaaggacccaattaaagtggccattaataagctagaaacaagcagacaggtataaatctgggcttctgcctcacacttcaaacagattactccacatggggagggaatgggcagctggatgatttgtttttagagcagagaggaagacagggaagaaggaaggaaaggagggagggagggatgaacatacatacataaacataagcccagctttctgtcactaaactctgtaatatagatatgccaatctttcagtatatgaaaatctggatttacacacatgcaaaattagaggtgatgatttgttctaccaataggttcatgatagggaagatgggctcacgggaggctaaatggtcccctggagaacttaaaatggtttagattgatataatcaattataatacacattactagcataattattctttttttaaaaaatgtttgtctcactttttctttttttaaaaattttactttaagttctgggatacatgtgcagaacatgcaggtttgttatataggtatagacgtgccatggtggtttgctgcacccatcaacccgtcatttaggttttagccccacatgcattagggatttgtcctaatactctccctccgcttgcctcccaccccaggacaggccccgatgtgtgatgttcccctgtgtcatgtgttctcattgttaactcccccttatgagtgagaacatgcagagtttggttttctgttcctgtgttagtttgctgagaatgatggttcccagcttcatccatgtccctgaaaaggacatgaaatcattcttttttatggctgcatagtattccatggtgtatatgtgccacattttcttaatccagtctatcattgatgggcattttggttggctccaagtctttgctattgtaaatagtgctgcaataaacacacgtgtacatgtgtctttatagtagaatgatttataatcctttgggtatatacccagtaatgggattactagcataattattcttattaaagaaaagaataacaagttccaagaaatatttgagagaggtgtcatgttgttcctggttggcgtttgttcccccagtgctccccaagacagagcaagggaaggatcagctggggagaagaggcctctcctccaagtctcccaaaacatcccagcattgaatggaaggggggccagagcagtcacaggaaagggagccactgacctagggacaacagtgactgtcccaccagggcacttgcctgatgttgtaacccatttatacctgaggttgcaattttttgaatttttgcaatcagaccttgacgatgaccttgtgcagaaggatataaataactcccacatgcttagtgttccaataatggaacactaggcataaatgggttttaagcaggtagccaggaagaatttcagcattgacttccctcacgtgtgcagctatatacccgcaaaaaccctagaaggtggcagggggagaccctttctcccccagatctagcagaacaatatcacaagcatcttccctggactaaagaggaggactggaatcactatttctcataaagggtggcttgacttttttttgacaaagtgtttctttatgtattacacaacatttctttatgtaatataaagtttacggatgagcattttgtcaagataataaagcaacacatcctggccttagaaattcagtaggaagtaaatctaaattaggttccatcccataggatttagacactgaaggatcgaaagaaagaaagaaaagagaagagaagagaaagaaaaatactctaataccagttcatttgcaaagtgacccaaggcaggaattttaatgccaagaatgtgcagtcatgcttaagtatggcaggttcactttccaatttctgtaattaaatcgtaactgacaactgggatgggtaggagaggaagggaaaataaatttaattctgcttaataaaaggtgccagaccacgatgaaatctcattcatgaattgtttttttttttaatcattggaattgttttaaaaaatagcaaatgctcaacaaatgcaagctaagttaaacactttggacaacttacttgaacaacacaatcatataatgtgggtcctgttgttatcccacagagcaggaaactgatgcttagagcgcttgaggaagtggtgtgaatgcaggggccaagcaccaagccactctgctagatggcctcttggtgaggaagagaactcatctttagcttagatgttaagggaacaaatctaccatttccattctcctcatccgtcacttaagaacaagtcctaatatttttaagtaataagtatatggtcaaaaatgaataactcagaaatatcatgaatgagagaattccatgtcagtcttacagaatatttgaagagaaattttctttgtaccacatacacaaaaatcaagcatagcttagcttgttacgtattgcttaagtgaaaaaaaaaaatcaactttagtgtagttaatacctcagccactaggggaatatctgcttttattaagttaatatttcttgtacctaagtaaacattccttcttcttcctgtctgttcttacaagtaacaaataagtagataggtattcccttaaaattccgtgtgtctttctttggataatcaacgagcagttacagaacaactagccccattctaaatctgataccagagatttctgaatcaatgcaattttatgtcaaatctatacatctctacccatgtgaaccagcttctgttcaagcactgtttgtcggcctccagagcaaggagcatgacaatgcccagctttcctcctcagagctgttgctgttaatgtggaagaaaaatgagggacacatccttctagacattttttttgacaatggaacgagaagtagagtttctgccaggatatattttgcacatcatccagattttttttttttttttttttgagacaggttctcactctgtcacccaggctggaatgcagtggcacaatcatgactcactgcagcctcaacctcctgggcttaaggaatcctctcacctcagcctcccaagtcgctaggactataggtaagtgccatcatgcctggctaatttttaattttcttgtacagtctggatctccctatgttcagaccttccaggctggtcttgaactccagcacaagcggttctccctcctcagcttctcaaagtactggaattacaggaatgacccaccacacccagccatattttgccttttgtatgagaaaggaggaggtaccggaaatgtaaccttcaccttgaacagtgatgacttttttcaggggtcatctgggtgagtttcaaaggatgccccacctgcacctcacccaaagacttatatgggaaccatgagaggggctttaaaatgctatatatatagcaaaaccaatagttttattattctcatatttttgaatcctacttcctgaacatagaattagttcctctcttgcataatggtagatgctatttttatggcatcactgatttttttcttatttttctaaagaatgaaacaaaaatttctcaattcatcctgagtcacctacttgaactttctcatggaacagagcgctaacattcactggatgtgtaccatgcaccaagcaacatagtaagctctttacctacttatctaatttacttctcacaactacctagttaggcaagtctctagtggcagctctctgttctgtgcccacaggttggaaaatgatgaaactggcctaacccatttggccaaccctgaagactcatatggccccgtaactcactagaaaccctctctcagtaaaggactcgctttgtttcctggtgagagctgaatagcattcatcttcctttcatctaaacatgtgttttttcttcttctttcaaataatgcctcatttgctatttaagcttttgaagaaaaataaagacaagaaaatattagagaaggcactgtccttccaatctgctgcttggcatcccctaccacagagggcatctgtccctataaagtcacctgtcataaaagaccaagacagaggcaaatatcggaccattgaagataccaataagctgtgtgtggcttaacataaaaataaccacacattagcaggtggtaactccaccaccaaggccaaaagcagcccaggaagctgattaacacgcacatcagcctcttctctcacttgtgaaggcaggtctgtctgtcttcaattcttattctagtacttttacaaaaagacttttcttcttctctgcatgttccctcccttgctgtgtcctagacaattctaagaatcccaaattgaatctcattctctgagaagtagatagaatgacatgctttttgagaatgtgattccaaccccaatttctagaatacaagagccctagagcatcttaagaccagggacttttatatactcatcacaaagaatggatgtgatacttgtttaaacatcagagaactcaatttcccctttaattccactgccaagcttgatttcactgcagccacttcatcaaatgaatttataaaatatggaccaatgaaaagaaactacaaaaaaaaattgtgctccataagcaaaacttgtcatgccagcaacaaatttcccttctccgcatctgcatagcccacctcaaggaacaaatttgtcaagcaactttttaagtgccctccccctccatctactttgtccttctggaataaatacgttactgacacagttaagacatgtcagcccttacctttctgtaagtcacaaaatggtggttaaaagtccttttcttccattcagtggtcgagactcttgctacgactggagtatctcccccgggaacactccctcttcc

SEQ ID NO: 1017 - DNA, 942 bp, Homo sapiens
ttaaatcttccattgacacaattttgctacaactctcactctaatctgtttagtttttacacaataaacaattggtttcatcagcggaggtacaagtaggagaacatttgccatgagaacattaatgaggggagagacatgcccggcaaagcggtggacaacggccaggttgatgatgggcaggtagaagatgatcactgcacagatgtgtgaaacacaagtattgagagccttaagctcctcctttttggatgcaattcccggtacagtcttgaggatcagggtgtaagacacagcaatgagaataaagtctaccataaggcagagtgctccaaaaaagccatagataacatcaattctgttgtcagaacaggccaacttcatgacatcctggtggagacagtaggaatgggataattggtttttcttgcaatatctcaagcttcttaaagtgaaagggaagggaagaaccaggagcatgctcttaaaggagaatactatccctatttgggcaactctgacagttgtcaggattgaggtgtatctcagaggattgtggatggctaggaatctatcaaatgacatgatcaggaggactgaggactccagtactgagaatccatgaatgaagaattcctgggcaaagcaggcactagaagaagtttcaggggcattgaacaggaagatgcttaacacagtgggcagagatgataaagacaaacccaagtctgacatagccaacatggaaagaaaatagtacatgggcccatgcaaggagggctctgtcttgatgataaaaagaatggtgccatttcctagaatagcaataagatacatgctgcagatggggatagagatccagatgtgtgcatattctagccctggcatcccaaccaagaagaaggtggtgatttcaacatatgatgtgttgataatggacat

SEQ ID NO: 1018 - DNA, 142507 bp, Homo sapiens
taaaatttgctgtaatatttccttatatttgtagagctgtttagaattcacccagtttgcaggattaaaacattttcaaatcttgaggaagaatgattgggttataaatttgcaggtgattaggataaaaaaaattcagcaaagcaaaccatttaagggagacaacctatgtatgtttttcctcactcctcatgactagaatagtgcagcaaacgctattattctataatagctagcaatggaatagtaagtgaaaattcacctggagtttcatgttaacttgagctgggctaaaagacacacttaaaagaatactgagttgtttaaatgggaatcctcggactaaagattatattcaatttaaaggattagctgaaaaaagtctaagtgtggctaggcaaagaggtttccagaatccttaaccacatctcagtatttatcctgccactgaggacactgctaacagaaactccatgctctgcgttaccctccaaaacatgttttctgtgctgtgcttctacactggagacacctggaaagaaggacaaatgggcttcgctgtgggtccatggaacacttactgattttcacccaaagtaaagaccttagaaatgaaacagaggtagacaaacaactctagagaaaagtaaacacaaaataaaagtcactgaagtccctctgagaatgaataggaagagggcaattaaacagaaatactaacagtcttggtgatgttacttaacacaggcagcctcggctgggtcaagatggagaacagtaacagtagagttctcagatcaggtcagttaaggaactggtgtaagtgccccatataatgtttttaagaaagcaaacagtttccccccctccaaattctgtcataattttagtgtttatgtagcttaaaaatggcatcatacaaaaaacctcatacatggctgtaagctcaattatcaacagaggtagtaaacaaaggaactcctaagaatcgattttaaaatgatcaaagtgtgactatacattcaaaaccctagagccacataatcatccccaaaatgaactgttttaattttaaaaagtttaaaaacacaatgacaatgaagcactgatatgccttaggaacagtcccaaatcagtgctgacttaaagctaagtcctctctttccaagaaaaagaaagcagagaacaaagttcaatctacaatgggagggaacagaatgaaaacaaccaaaagggtgctttccagcagcctaggttattctttgttttcaggccacaccactggaaatgcttttcttcttatataagtcttttcctcacaacctttattttttaaaaactgccatctgctgaacaagagatgtccacatttccaccagcaggtgatccacttctgtgcacagtttttgcttcctcactgtgagtcctccttccccgaaagtgcaaagagagcaagctgatacctgcaggccccagagccccaggactattccagctccacttataaagcagggtgaaggatttgctgcatttgtgcttcaaagatccagctcactttggttgtccttctcagttggcaaactgctcataaaaagcaaacttgatcctctctatgtgatggcaaagtttgatggcagggcccaattttaagtccatgcattcttgaacagtgggaagggtaaggagcaacagggcctgcccatcaatttcctgttaaagcataaaagacaaattatctgtgatgtgcacatgaaaggcagcttgatcatgacagcctctcctcactttagctctgtcaaaactggaatccctatgctttcctttccttactttttcgtcttaggtatcacacacttccttttaagtgactccatagtcttccacactaatgaagcttcagaattaataaagttttactgaggacaataaagttttaccaaggataagaatccattccagagtctctgtcccatagaaatttagtaaactgactagccctgtaactggcaactaattgtgccatctttttagagggttccttctaaatctgaaacaaaggattaactatcaacttcaatgttttcctactctgtaacattcataaaaacccgataagctcttgaatctccctaattttctaaacaaaacttatttcaatgtttaaggccactgactgtgtttcagcaagcttgccttaaaacttatcaccactctagagcctaatgtgacagatgctatttttttttaaacaagcaaatcattatttttgaaaagatgtggacaattaagcatggtatgcttgatattggagggatggaatcaaattcttaggaaaaactggaatgcaatgataatctccttcaactatgaagcaagtctgataaataactttttatcatctttgactcctaaaaatggaattaagacaattcttgtcttttggatcaaaacatttttcctaaaacttgtaaataaattgttgactattacatccataatttattgctaaagagacattactaaaaattataggtatctgtgattacctggtctaggaatattcttgctaatggagcacagtcagtggatctgatgaaccgcacaacgtctgccacactccacttcaaggggttactgtccaggtgaagcctttcagcaacttcgatccttatttccttcattccccacaacacaatcaaaccaaatggtgttacggctattttattctaaaaaagtctctctacctaaattcataatctttcaagacatgatttaaagtggtcttaggacatgatttctcccagcaaagatggcaaagacccacgtgcatcaggtactcaggaaatgtctgtcttttataatacgaagtatcaatgggaaagaatttatctcaaagttccagcacagataatttagacaatttaactaagaaaaacagggtgctgaagagaaggggatgataattccattgagagaaggcttaactaaactaccaggaggaatctttactgcttctgttcatggaatattcttaaaaagcaatctagtttttgaacactaaattgttctttagtgttatacatatgttataaaatgttcatatgtatatagtaaataatatattaagccaaatggcttaaccagaatcaaaaggataacttttttctacaaaaccatatatattatgaaacatattaaaaaggcagttttcccaaaaataaatgacaagctacaaataagctagcaatggggctttttttgttgttgttgttaaaacaagcagctactctgagagagactttccccctataagtagatgatctcaactaatccttgaaacacatgtaaatcactgcatttggggtcactttacaagagaccctggaaattctacataagtctgtattgaaagaagtagaatgtcaatatcactaataatcatattccagatggaaattccagagagaaagaaagaaaaaagaaactattttttaaatggtacctttggtgaaggaggtttattttcatcgtcagaaaatgaaaaggtgcgaagctccctttttctcctttgtctatctggaggcagcgatgtggatatctcactttgggtgggagaagaggagcatgactttttttctgacatttctgattcttcctgtagctcatcctgctgctcggatgtactgccttcacttagggaatcatcatccccttcatctgggtcatcctcatcttcacccccacttccctgcaggaaaaggagagaagtctcattgaaattcaggacatcaatcccaggtttcatatgattaaaaaaaaataataaagaaagaaaagaaattcaggacaaaccagttcttgggccacaaaaccatcttctattggccagagatctgagttagaaagacctgcaggtattctgtgtccatactataaagcagtggtcacttggcttcaagacattacaggcacatcacagatctcatacctggggagagcccgctggggtattatcaacagatgcagaggagcgtttcttcttatgaacaaaaacatttttccgcctctttctcctcttactggcttttttcagggcacaagctaagttactatgcccaccaggtggcctcccaattcttttatttttcttctttccgtaatagtgtgctaaatgtggatgacaaagaaaaatgaagtagcttcattatttttgtgtacctcaaaaccacaagagattttattagcatagcaaaaaacaggtacattgtatttgattggggtttaaattccatagagtggaataaacagatctgaagtgcacggtttgactagtactgaatgatccctccatatcaaagtatatagaacatcttcaacccagaaagctcccatggtcccttcccagtcagtaccccttactagaagcagccactattctaaacactatcactatagattagctttgcctctatggaaccacacagtaagcacttttttgtgtgtgacttttttttttttttttttttgagatggagtcttgctctgtcgccaggctggagtggagtggcacgatctcggctcactgcaacctctgcctcccaggttcaagcaattcatctgcctcagcctcctgagtagctgggattacaggcacacaccaccatgcccggctaatttttatacttttagtagagacggggtttcaccatgttggccaggatggtttcaatctcttgacctcatgatctgcccgccttggcctcccaaagtgctgggattacaggcatgagccaccacgtccagcagccatgtgtgacttcttctactaggcataatgtttttgagtcgtgtgttttattatatgtttcttttctatttggatatctggttgtaccagtgctatttgttaaaaagaatttcctttctcccttaaatttcttcatctctcttgttgaaaatcatttaaccatgttaagtttggctctatttctggaccctgtggtctgtcccattgttctatttttttgagacagagtctgtcacccaggctggagtgcagtggcgtgatcttggctcactgcaacctccaccgcctgggttcatgtgattctcctgcctcagcctcctgagtagctgggactacaggcgtctgccaccacacgcccagctaatttgtgtattttcactagagacggggtttcaccatgttggtcaggctggtcttgaactcctgacctcaggtgatctgcctgcctcggcctcccaaagtgctgggactacaggtgtgagccaccgcacccggcttgactattctttaatgccacactcttgattattataactttatggttaaaaaaagagagagactaagtcttccaactttattcttttttccaaattgtttcagctattctagatcctctgcattttcatataaattttagaatatacattccagaaatgaaacatacatattctagctgagttatgtattaaagtaatatcaaaatataatacaattttgtgaaaaaaatggaaattttctaaaggatacgaatccatttgacatcattcaaattactaactgggaaaaattataactgtccttctaaattctaggctaatttcaactatattattgtgaaagataaattcagacaaaaggcacaataaaatccacatatcttcccctcacatatcttccttcagagtagtgtgcttatatatgcatttacatgaatagtatttttcactcagctcctaataattgcagtttcctaaactaagtgctgagtctgatacaagaagctaagataattcctactcttaaggagtttacaatccaataaatataaatagaaactagaaggttagacttataagattttgtaatttaaatactgattagaaagctcgtcatactaagtatggaccttggatcaatagcatcagtggcatctgggaacttgttggaaatgcagatagatactcaggacccagatacccacagacctgatacatcagaagctccattttaacaagatccttcagtgatctgcatgcactatagtttaagaggcacagatccctaaaagaaatctttccattttaacaaggtaaaaatcctcctctgtagtgattctcccaagtgacatagggcttgtaggatttaaggaaaggtaggatcagaattttgtctttgggtggcaatgccttgacaaggctccaaattgtaaatttcatcctatgtgacccctgccccagtttctcaaagaagataagcaaggacagcgaataggtgctatgacagttcaaggtgaggttgcaactacctcctctcctatttccacctccccaactagtgtggcttcattgctgctcttcagagacactaagcaagcttctgcctcaagcctgtgcccttgatgccccctccccagaacactcccacccagctctctgcacagctggctcctgtttccttcaaggtgttacctgtcagaaagacttccctgaccccttgcataaacagcaccccacctcccagccttcctcactgtcctattttgcttgcccaccttgcttcactgttccccacagtatttctctaaatactgacccctctctaaatttcttcccttgtttgttatctgtctcccacattaaaggtaaactcactgaggataggaatttgttttctttattgttgtatcccagtgctagagcagcataagcacacaatgagcacaaaatatatacttgcagattgtatgaatgaattacatatcctattagatacaataactaatttatatacatgctatatataaaagttggcacactaaagcccatgagtcaagtctggcccatgacctgttttggtatagcccccaagccaaaaattacccttacattttttaaagggttctttttttttggagacacagagtctcgttttgtcacccaggctggagtgcagtggcgcaatctcagctcactgcaaccttcatctcccgctttcaagtgattctcctgcctcagcctcccaagcagctgggattacgggcaggtgccaccacacccagctagtttttctatttttagtagagacggggtttcaccatgttggccagactggtctcgaactcctgacctcaagtgatccgcctgcctcggcctcccaaagtgctgggattacaggcatgagccaccacacccggccaaaagggttcttaaaaaatgaaaacacaacacatagaaaaagaatatgtgacagaaagcatatgacccacaacatgaaatatttatcatctggccctttacagaagaagttcgtgtgcctctgctatatatgaatgtctgtaaagtaaaaaactttccaagatgtaaggtatggtcagctgctatggttaacacattggaaaaacatgactcactgtatttggtctttgtaagtacagaacagttctcagaacacttatccagaaccatccgtggaccgaagaggttaggacagcattccagtttgatacaggtttgccggcagaattcagtcacccgatctgctgttttcactatctcaacagtagcccgataactctttcctttatatctgccattggaagacatcagatgccaaatatattgggctaatgattacccagagaaaaatcaaacatattaatacacctaaaaaatatttttgcttcttggaatattctatgtcctttatagttcaagggccctgaaaacaacaaggaagttctgcatattgaacttaaatcaaattaaatctggtaagctatgacaactaaaagctgagttatttaaattagcaaaattaagctcctgctttctgttcctaagttaaggttttcaaatagtaatttcactaactgctctaaaaagaaaagtgacttttcactaagtctttctttacccttggcagtgatcctcagactgttatccaaggaccagtatgacctgccaattgcctgccatccatccatgacaagatcagaaagcaagagtacctgtttataacctttcacagtaatttgaaaaagtaattttatgtctcttacatctaataacaaaaattgttcttgcatttttatgtcttaaatttcttatttcctttttgtttttgagatagagtctcgctctgtcacccaggctggatgaagtgcagtggcatgatctcagctcactgcaacctccgcctcccaggtcaagagattctcctgcctcagcctcccaagtagctgggattacaggcacacaccacgacacctggctaatttttgtattttgagtagagacagggtttcactatgttggccaggctggtcttgaactcctgacctcaggtgatccgcccacctcagcctcccagagtgctaggattaggggcgtgagccacggtgcccggtcttaaatttcgtatttcttataattcattctatcatattttataaatgtattgatccatgaaagaatggaaatctaaaaaagaaaaacaagcctgggccttcaccacaaatagctgaaaaagccctgcctaaggaaacataaggcttctgatattatccacagaactgattctgtgaattttttttgttgttttttgtttgagacagaatctccctctgtcacccaggctacaatgtagtggcacgatctcagctcactgcaacctccacctcctgggttcaagcaatcctcctgcctcagcctcccaagtagctgggattacaggcgtgtgcaccgtgtctggctaatttttgtatttttagtagagacagggtttcatcatgttgaccaggctggtcttgaactcctgaccttgtgatccgcccgcctcggcctcccaaagtgctgggattacaggtgtgagccactgtgccacgccgattctgtgactttttaaagacaagtaaaagtaaagagtaaaaacaagtagtccactcacttggcttttaggacttccccacatccgtgccacacagagtctttgtccagctggagctcccgaaggacacggctgggtttgtaggctgcattgataagtaaagtgaggacctgagctcagttttaaagcagaaacacagattgggaaggagaaaagcagaccattagaatcttgtcatctcttccttaaaatgttaagattatttaggaggttaaattctagtcatatgaattaacaaatgttaacaaaataatagtatcagagatattacagccacccaaaggtgcagataagagagtaaccagatccttttcaacattttttaaatgttacggtcaggaaaaaaacaggtaccatgattttcaaattgctccagaacatgcttccaaatgctttcccagccacggtacacacagaaaattatatttgtttggaccactgtgtagacagctgagccttcttgtggctggaggagtctggtccagacgctctggcttccccagatcctgacttgccaccctgagggctgaaaggtctcttatctgttacttgcagcatatcacactggctgggaagaacagaaagcccagcagatgtgtagctttatcacggtcgctaggttaatgccacatagccacggcctttcagtcatagagtaacctcacagttcacttttgtatagttctcttctggtctctgacagaagacctttctaccctgacagaggtgaacctgctgtgtgaagagttgtttacgtgaatgtttcctagggaggagaaataattacataccctcttcactgtccaaaacatgagaaaagttagtaacttttgataaaacctagaactgtcacatctatggcatgtggctccctgtagaaatgaccataggagaatgctgtgaaatttccaagttattttgctctaggccagaaccttacctctctaaggaccagaacacagttcccaggtcctacacattgaggcagctcagcaattcttcctttgttaagatatggccctgagaagcaacggtggttgaagtatatctttggacagcaatattttccattaatcataactgggaaatgaagaaaaacaaatattcaaaacagtcattctctaccccacgtttccaaagctgaactgccagggaagaaaaacgaagcacatgtaccattatattaatataaagtttggaattacttattttgaagcttaacatgttgtctgagaatgctcttaagtaacttacagagcttatcactctgctgaaatcaaagagggtcctgaattaacatgctgattagttcctaggttactgcaaaattgatagaagaaccctatcttctattaataaagaaagtggagggtgtattttaagaacacatgaggattctggatgatcaatgatttcttttccaggtcttcaaaaaccaactttcaatcatctattctggaatatttatagaaattgttgaatattattgagaattagtttgtctcctaaaaaccaccaaactaatatgttggcagcctttgatgttgtgagagcaatcccatctctgagatttctcagagggctaaaagtatgctgtgaccacatctctaagttttttttgtactgtggggtataactgggtctggagacccttttcttcaactatttgtctgtatcaatactgtccttcaatttaatgtttttaaaaaatcccctcatagtggtaggcatgtcagctgttgaatgtaaaaaattcaaagacactaaaatactgctataaagcacagagaagctcttctaatagatatgcctgttaatccaatgttaaggaaagatatgcgcacactgcccattgttgataggatcctgcagttcataatgttttctctttaattaagaatagtcacagccaggtgttgtggctcatgcccgtaatcccagcaatttgggaggccaacgggggagcacatcgcttgagtccagtttgagaccagcctgggtaacacagtgaagccccatctctacaaaaaacaaaaacaaaaacaaaaacaaaaaaatcagccacatgtggtggcatatgcctgtagtcccagctactcgggaggctgatgtaggaggacagcttgagcccaggaggtggaggttgcagtgagctgatatcactgcactgcactccagcctggatgacacagcgagaccctgtctcaaaacaaaacaaaacaaaaaaacgatggtctatcatagtggccagtatgctggtgctcacatttccagttgaaccctgcaacccaaatgcctcttttcagaattaaggcactcatacccctgctgctgggtatgttggcagcttacagttcccagttttatgtctattctggaatcaccctgaactgggtactgctctcagcaggagagggccaccttgccccttgtgaggtggggagggagcagtggcttacttccaataactggtcagtaaagtgtggccaccacacctgaattaggatcaactctgagtggttagatcagcttcagggctcccagtggaactagaagaaacttctgttgcaactgcatcatggttcaacttatctctctgcccaatcctacttcctttactccttctaaggagctgttcccaaaaatactccccaatgaaactcctgaatgcatatgtcagagtctcagactctgtttcccagggaacctgacctatgacaaaacccaaaccaaaaggccttggctgaggttgtgcagaagatattaatgtcttaaattctgtggtttcagtaggcattcgaatggccaggaaagcatcaaaagcaaggagttacacagtcctaaccctctatgtacaaatgatgtaatgaaaaggcagtaggtacaagagacggaagtacgggtttctaatttgtgaaagacttcagtttcatttctggtctttctactcataagctgtgtgatctctctgagcttcgatttctcttctaggcatttactaaatatcacccaaatgcgcaatctgtgctagaatacacacagccaggatgctaaacattacacaacaagcacgtggaagttaagaatagttcaagagaggaccctggacaaaaggcttgaacctccagcaaggatttttctctcatttatcaggcattaattgcctctgggacaatttctttttccattgctttatttttttcacataaactgtgaaatttatatacaaagtatgcatatcataaaaaagggttttaaaaagaataaacttctacctctcaaccatctagcttaagaaagaacactgcctggaaaacttcaggttctttagctaaagtcaaggatggtaacattggccttctgagccgttggcacacaacggttgatcagtaaagaatagctacaattattagaaatggacggaactatcagcctagagatgattattaaactaaacacatcttagacagttataactctaaagtcacaattaagagacccctctatgaagacacatactatacatcaaatgtactgttttaagttattttcagatatagtccattaaaagaaactaagtcttcttttccttaagatgacatgtgcttatacctgactctgtggagttcagctcctgattcctcaggccctcgtggacagtcctcgaggatggtactctgggtcaagaaaacacagtaaaatagtgagataattcttaagatcagtaaagtgtgaggcttagtttccttcaaatctaagaagaaagcaaatgtggcatgttcgcaaaatctgtaacagaaggtactcccttgatgatactttttttttttttttttttttttaaaagaacaaggctggatgcggtggctcacgcgtaatcccagcactttgggaggctgacgtgggcgggtcacaaggtcaggagattgagaccatcctggctaacactgtgaaaccccgtctctactaaaaatacaaaaaattagctgggcatggtggcaggcacctgtagtcccagctactaaggaggctgagggaggagaatggcgtgaacccaggaggcagagcttgcagtgagccgagatcgtgccactgcactccagcctaggcaacaaagcaggactctgtgtcaaaaaaaccaaacaacaacaacaacaacaacaacaacaaaaaactacaacaacaaaaaagaacaattgtttttaaaactatatatagggcataatgagccaatggacagtctgtatatagcattgtgatactacatgttcaaactttctcttcattcactgggcaaaaaaattacaaaatttcttgtgagatgcttaaatcacaaataaactactcatttttcaacagtcaaagaacagaaactttatatagggttcgttttcttcgtccatcagttttcaaattaaagacaaattatgttatttaaaaaaaaacagaggcttattctgtatgtagcaatcactgaaaaaaggctaatttatcttttagaatgcatcctaactaaagctttggatcagttttggcaactaagtcaaggaaaaatccaaggtcagtcttttttttcattgttacctcacttctctacttggtataaatgtctatggcctttctctccacttctgttgttagttttattacccacatagttacaaaggtttaggtagttatagaatttgctatatacagaattgtttcctcctactcaaattcatatgttgaagccctagtgctcagtgtaactgtattcgaagatagggccttggggaagtaattaagattaaatgaggtcataagggtaggctataatccaatagcattgatagccttacaggaagagaggggtcggggggtgccggggagagaaagatttttccaccatgcaaggacacagccagaagacagccatctgctagccagggagaatgccctcactaggaagcaatctaccagcaccttgatcttggattttccagcctccagaatgtaagaaaataaatttctgtggtttaaagcaggggtccccaaccccagggccacggaccagtacccgtctatggcctgttaggaatggggccgcacagcaggcaagggagcattacggcctgagctcggcctcctgtcacatcagcagcagcattagattctcacaggagtgtgaaccccattgtgaactgtgcatgtgagggatctagattgcatgccccttaggataatctaatgcctgatgatctgaggtggaacagtttcatcccaaaaccattccccaccccagtctgtagaaaaactgtcttccacgaaaccggtccctggtgccaaaaacgttggggaccgctggtttaaagccaccgagcctgtggtattttgtatggcagccccagcagattaatagagaattcaacacccaatgttttaaaacacacatatacacacagaaacatttgtacttttaaggtttgaaggcactactaattaactgtttctcaaaagctgtgtgtgcaggtatgttacaaacgaagaatttcttgatgggcacaaagccactcctttgaatgtgccttttcttttagagctgtcttctaccccagctttatttttttccactgtgacaaatcataccctaatttacaatttttgctcttccttaatgaataccagcatgggcactcttattttctttcttttattcaactatcttaaggctctaaaagccaaagaaaactcaatttagacaccatcttgagaatgcattttacccttttgtatataatgccattttagaaaatgcatatactgcaaagagaagtatacaaatgatcaaatgttgaattaaaaaattatgcttccatctgagaaaatgaggaaatataccctctgaaatagttatttttctagatattctaacttgtaaactgttcatattattacgttacttactgtttttctggctgaaccactgcaattttcctctgtttatatactgtagaaagaaaaaaatatataaatgccaagaaaaataaaaagacaaaggaaaattcatatgtgtattaaggttacattagcatatttaaaacctggttctgtgtgagtgtgtgtgtatatatgtgtgtgtgtatatatatatatacacatatatatagtactataaattaatgcttatgtctgaatatctagactgaggcacattttcttagtagggatctttatacaaagagcaaaaataatattttcaaggctccctgggtcagtaagtgttgggaaagctcaatgaataaagttggacccttacctcagatcagtggtccccaacctttttggcaccagggactggcttcatggaagacaatttttccatggaccagggggtggggggtcatttcaggatgaaactgttctacctcagatcatcaggcattagatcgtgcaacctagatccctcacgagacagttcacaataagattcttgctcctatgagaatctaatgccgccccgatctgacaggaggtggagctcaggcactaatgctcactcgcccgccactcacctcctgctgtgtggtcccacgggttggggacccctgcctcatatcatatataaaacttaacccaaaggggatcaaagatctaaacataaatgtaagggttaaaactataaaactcttagagaaagttttataggagaaaactataaaacttattcttaatagtcaaaaaatggaaacaattcaaatgtccatcaactgttaaatagataaacaaaatgtgtcagatttatagcatggaatattattcagctatataaaggaataaagaacggacacacactacaacatggatgaactctgagagcagtacactaaatgaaagaagccagtcacacaagaccatgatcccatttatgtgaaatgtctagaacaggcaaacctatggagacagaaagtagattcgtggatgctggagtgggggttgattgctaatgagtatagggtttctttctgaaatgatgaaaatgttctcaatctgactatggtgatagctggtacgtcaattgtaacaccagaaagctgtttaaaaagggggaaactgggttgccactttcgaggttaggttgcagaaagactctggcttccatcttcctcaacctctcttgctctcttgcttcctcactctgacagaagccagttgtcatgttgtgagctgccttacggagaggcccacatggcaacgaactaaaggaaggctccagccaacacccagcaaggagctcaggccctcagtccaagagcccacaagaagatgcattcttgctgctatggtctgaatgtttgtactctccaaaattcacattgaaacttatccaccaatgtgctggtatgagaagatggggcctttggaaggtgatcatgtcacaagggcagaaccttcatgatgcagattagtactcttataaaagagatccacagagctagtagtcccttctaccatgtgaggacacaacgagaaggtgccaactatggaccaggaaatgcaccctcaccagaacctgaatctgccaacgcctggatcttgggcttcccagtctccagaactgtgagagataaatttctgttatttataaacttcccagtgtatggtattttgttacagcagctagaatgcactaagacacttgccaataataatctgtgtaaagctgggagcagatcctccccacgttgagccttgagatgactggagccctggctgacactttgagtgcagcctgtgagagactcagatccagacgacccacctaagttgcacccaaattcctgacccacagaaactgtaaggtattaaatatttgttacaataaataatttcctatgcaggaacagagaaccagaatgtcattttttttctctgaaatgtccagattagttttaattggcagcagccacacagaagattatttaacaatcaatcctctaacccagaaatagacagatacctcgtgctcggcgaggagtgctgagggggtggccgttggtttcacaccagcccaaaggaaatatatccatggattccacactcacaatacattcaggtataggcttcttagaacctgtttagatttaaacaaacaaacaaacaaacaaacaaacctttttttagaccattaaataaccttcttcataaactattttctagataatgttctactcttataataatgcagacacaagtctcttgacacagaagtcatacattttcatgtatgataaacattatgaaaaaaaactgtcttccatgtaaaactgtatcaggaccaaaatgggtagagaatatacagggtgacacttaagctagggaacagcaaataagaaactggaactaccactggtatcattcagatggttaataaatatcacagtcatttcagacaaatggaaaccaaatggcaaaggtgacaattttactcaatgagaacatcagttctggtacttcaggaataagccagaaaagaagaacagtgaattcaaatcaggaagtgatttggcaagctgctgaacaaggattgcataaaagtctacattcgatattatccttgacatccgcattaaatgccaattctacaaatcagaaacagtaggtaccttctcaaagtctgactatttggcagcaggataaaaaagctgctcagggcatatatggtaaccgtagcactgagtactcacgcagcgccttgcatccacaaacctgtccaattattgaatattacttttagcacagtttaccatttctactctatatactttttggttctattgggctgcagcaaccaaaatattatctcttcaataagctaggtgttaatgtccatgctcatataacttggtcacatcaaaatatatgctatttgacttatgttttccccttccagaaaataggggactctgtagtaaagaatttttattcatattcatttcctaaaatttggaatttgaaagccaaggacaggaaaataaatatttcgcttagagtcttgcattacaaaagtctctgaacaagatccctatttaactaatccattaagtttaacaggcaacattacaggagtaaacaggaagctcaaaggagagtggccacaggaaggcttctagagtgctggcactcaccctccagctggagccacaggtaggagcctctcactgcagtgatggtagcaacacacacttcttcagggagaatggggttcaccgcctcgagcttcatgttctccttaaattcatgttcagaaattaactagaaaatgaatgaatcaaatcaatttactggattaacacagtattaactcacgtgctcagctagaaaacctttttcaagtagtacttaatccctaggtttaaagataacatttattttgcattgttttgctttttaatgaagcaaaaggaaaatgtctgcctttcctggtgttataggaagtatacaggaagtacactctttgatgtcagatattcctgcattattgctacttgtatgaccttgctcaagctgtataacctctttttgcctcagtttcttcacctgtcagatgaggttgagaactcccatctggctgtgctattacaaggtatcaatgaaatagtctctaaggttctgtgtcctgaaccaagtggctatcaacactgttgactcacttcccctcatataaagcaccctatcataccacaaactgcctggttcatacttgcatgtgtatcataagaggcagttaggatgaagaatgtttatcaacagtgggaaagggtcatttaaaacagaaaaatatccagcatccgtgtcaaaatggacaactgaacatctgcgtttgagtgttctctcttctgacatctaacttaaaaactaaagttgtttttggtttgcttctattttgaagacaaaaacttaacatctatcttaagatggatataacaggaaaggaaacaacattttataagctaaaatttagaacagggtctggaaactaagttaaaggtgactctaagctggcagtaaagaaagctaagaactggaagaactgccaggtactaggcaactggaggtagaggagacagtcaaaacaaggaggatttgttgaaaacatttaagaaacatttaggttatgccattggctcctcgactccatgcattagggaaaccattccttcctctcccctacagaaggtgagatttatcctctggacagggtaaaagagaagatgcctaggtaagaggacacaaggaactgctgagggcatgtatgtcgtgaccaaaacagcggttagcctatggactgctgagaggcccagccctccgcctctacccaccaggcaggggactagaagatacttcttatggtgatatgataagcccaggaagaaacacataatgatatggattcaggtttccccaacaaatggccaatcagattccaccctataggaaagttcaaggttgacaagctccatctacctgctcagagctttcaatcagctcttcctttcagtcacccattcttaaatatagcaacaaccaagaattaccagacacctaagaagatgaaagttaggaccaaaacagacaagcaacttggaaaaagcagtgattatgcaagaagaaaacttcccaaaaggtgtgtgtgtggggggtggattaattaacagcctctgagagataagaaaaactattgcatccttagagcaagaatagtatgatattaaaaacaaagaagtacctgtaatcccagcactttgggaggctgaggcgggtggatcgcctgaggtcaggaattcaacagaagcctggccaacatagtgaaaccctgtccctactaaaaatacaaaaaattagctgggtgtggtggcgggccctataatcccagctgctaaggaggctggagaatctcttgaacccgggaggtggaggttgcagtgagccaggatcgtgccattgcactccagcctgggcaacaagagcaaagctccatcaaaaaaaaaaaaagaaagaaagaacaaacgaacgaactattcagagttccagaaaataaaaaacatgatgtcaaaaattaaaaactcaaaaggaaggccgaaagacaaagtttaggaaatcttccagaaaataaagcaaaacgactaagaaacataaaacaggataaaaagatttaaaaagcagaggtttgatccagagggccacaaccaaataaaagaacttccagaaagagaaaagagacaaaacggaaggaaggaaatcaaagaagtgatttaaaaaaaatttcccaacacagaaaggcatgaaggtccagaaagaaagtgcccactgagaacctagcacagcggatgaaaacaggctcgcatcaaggttcatcactgtgaaaagtggttctataccttccagaaagggtcgggggaaaagcaggtcatctacaaaagaacaaaaataaaaatagctttatagcttttaacttcttgatagtaacactagaagttagaaaacaactgagcaatgttttccgaattctcaagcaaaataacttccacattgagccaaactatgaagcaagtcagtagagtgaagacattttcaaatatacagtgtcaaaaaaaatttacttcccttgtaccctgttacaggaaggtactgagagatggggatccatcaaaacaaggaagcaaaccaagaaagaggaggccatgagatctctacaaaacaagggaccccaaatcatacaaaaggggagtgggcaattccctgggtgacaagggcatttccatgattaaaactacatggcaaggccggcacagtggctcacacttgtaatcccagcactacgggaggctgaggcgggaagatcatctgaggtcaggagtttgagaccagcctggccaacatggtgaaacccagtctctgctaaaaatacaaaaattagccaggcatggtggcgggcgcctataattccagctactcaggagggtgaggcaggacaatctattgaacccgggaggcggaggttgcagtgagctgagatcgtaccactacactccagcctgggcgacaagagcaagattctgtctaagaagaacaaaaaacaaacaacaacaacaacaacaacaacaaaacccacaaaaactacatggcaaacctttaaagagcaacccatccagacagagagtggaggttgctaagagggatgtctctttaacaaaagtgttaggaatgacagatttcttgatgtgactgcttttgataatgagagactactgggaagtgtggacagcagcagcaatagataaaattaagtaaattaaaaacaaggcaattattattgaggataaaaatttttaaaaagaaacaatcataaaatactgcagtgccaggtgcagtggctcatacctgtaatcccagcactttgggaggctgaggtgggcagatcacttgaggtcaggagttcgagaccagcctggccaacatggtgaaacctcatctctactataaaaatgaaaattaggcgagtgtgctggtgggcgcctgtaatcccagctacttgggaggccgaggcaggagaatctcttgaacccgggaggcggaggctatagtgagctgagatcgtgccactgcactccagcctgggtgacagagcaagactctgtctcaaaacaaaacaaaacaaaactgcagtgctcagctgtaatatctgaatgcatatcataatgtaaaaactcattttgtatttaaccaaaaattgtaatataactctaaaggaagaagaatgtggtaagacagagaggaaaggtaataaaaaataattaaatgctcatttatcataatttagaaccaacagactcagcaccataagacagggtgaatttaatttgttttaataaagtcaaagtttttaaattagaaccaagtgacatgtctaaaataaatgactcaaaagatagaaggtttttattttgaaaatgaagaaatacaaataactagaattacagtgagaagaacaggaagtagttatttctgggaagggagactgtgaaacggggtagggcagggactgctattttaccttctaagccttttactgctacatggctctttaaaccacatgcatgtattatttggatagaagaatttaaataagcttaacaatttttctccacttaatatttcaacagtttttcctattattgaaccatgaaaaataatcataaaatttcaaattcacgatttcagctaagaaaaaataaaaccaataaacttataaaactaacttaattagcaaactaactgattcacttctgcagtaaatgtattttcctttagaccatgtgattacaatcaccactgtgctcatctggattaagtgagatgattatcttcagagcaataacatggaaagcaagggaagcacagcagtccctgcagccctgccatagtggccatgaggccgtgggggtcctcaccggagggaagcacctctggggagcagcttcagcaccacactgtttgaggtagtcagcccagtcaaagtcctggcttgggtagcctaggtggggacaaatgaacaatgagtcacactaccacaccacatacgcctgcctggcttcacccctcaccaagggtccactcacaacttccagtgatgctagtctgacaactttgatcattttagaggggcgaaaagcattctataaatctagagcactgttaattttataaaatagagcaactctggtcaaactgtaataagacaatcagactctggataaatttgtaaactttcaaatttcaaactaggcatttattttgagcactattttatatgattagttgctggcaatttaccaaaagaatttaagacagttatgactggatttgatttgtatatataaatccactcttattgtcaattctaaagggactcgggctctcaaggaaaagagacagcaaatagtattagttaatctgcaaagacgaagactttttttctttgttaaagctgtttcctgaaatgtgtctcagatatcactgatacaaatcctcttgtcattttcagattcatatattacagaatatcaatgcttttataatctaaatcatgtatttatttcagaaaaatcaagcttagcaccccacttaagtctactgaggttcttgatggaagcatctccaagctgctgctgactcagcaccatctacatgcaaagagctgagcgaggcccaactgcctactgtgtctgagttgctctcagcctccagagagcttaatgtctcacaggcaaaaaaataggctactcaagtctatgccctctgacagcccaacagtccctgcctaccgaagactggcaccatgttctccctttgccccaacctcaatgcctgacagtacattttctgccattttcagttatgtaatctactaccttccctctatttacaaagacacagttgatttgtctataacaacactgaaagcttcagtatttttaacaactgttccttctttttcacatagaggtggcaagcagaataaagaacttgggatatctagagcgtgcctgcaaagcaagaacttccttctatggctgttctacaccacaccctccaaccaggcattcatctgctgtgttcactgatggaggagactctaggaagttctgttaatatttccccctatttgccccttgaagggaccgagttgtactcattgagcttgtcactctccccagggataagctcaatgcctggcttacagcaaacttcacatgaatgtttgttgaatgaataaaagctgaatggaagacaaaggttctgagtttatgacccttgttaacaagaaagagtacttccagcccagtgttccagcagtcaccatttagaaaagtgatgctatgctttactgaaaacctactaataacatatatagactgccaatcaaataatctgatttgctaatattaaaaaatcagataaacatctgacatattctagattctctaagtttaaaaatattaaaaatttcagtcaagctcaactaacccattaattaagggccttgattaaaggatcaaagactatattttgcaaagttgcaaatatcaggaaaatgagcttttattttcctacctactccctgagttctactcttcaccataaacttctctgtagaaagtcccctccatgacaaggctcagacacctaaagataatcagtaatctaccttctaactctggctctacggcctcttctcacaagccagcccccagtgcttgctgtgcatccaagctcacccctctgccacccctaacagacataaaagggactaaggagccagcacgaacccaggttggaacctggttttccagggggttatgaggacatagatatcaaagtcagaggatagaacgcactctctttaacagttttttagctcagtttgtaactttcaaatatgtaaatacatggaatctagacctttccttatacttttctcagaccccaaaaacgttaggaacaggctagggcaggaggagagggacaaaagatttcagcaatgccatctgacatgtctcatttcaaggagaagctctcaagtgacaattcagaagacagcgaatgtgcacctggaggggggctgatgtgtaggccattcttcagactccactgcacagggaagatgccaggactgtcggcgtggcacacaaaggatcgccgtgcgtggttctcaggacgcaagtcatccatttccaccagaaagtacttctcatcaaaaacctatacatgcaattaatagatgaaatagacaaatgcacacatatatatgtgctttctccttggcacagccaaacatattacaaaagttcatactcatgtgggtattaataatactaaacactaaatgttagctctgtgttatgtaatacatataattactgttttaattaaatgcttttcatgtatcaattcagttttaatcttaacaactgaatgaggtaagtacatatacatatatatacatatatacatatatatacatatatacatatatatacatatatacatatatatacatatatatatatatatacacatatatacatatatacacacacacacatatatatatagtttgtttgtttttttttggagacagggtcttgctctcttacccaggctggagtgcagtggcatgaatttggctcaccgaagcactgcagtcttgacttcctgggctcagttgatcctcccacttcagtcccttgagtagctgggacaacaggcatgcaccaccatgcccagctaattttttttaatttttgtagagactcggtctccatatattgcccaggcttgtctcaaactcctgggctcaagcaatcctcctgcctcagcctcccaaagtgctgggattacatgcatgagccaccacacctggcccaagtacctttatcaactccatttcacagataaggagaatgagttcaaacagaggttaaataacttgccctgggttacaaaacaaagaagaagcaaaacctggatccaaagccatgtagtttggctccaaacaaaatttattctaagcttagtgacaaacttagtttaagcttatgctactatgtattagtttttcaaatcctagcccagtttcaaatgccaaagaacgaactttatttatttatttatttagagacggagtttcgctcttgttgcccaggctggagtgcaatggcacaatcttggctcaccgtaacctccgcctcccgggttcaagcgattctctcacctcagcctcccgagcagctgggattacaggcatgcaccaccatgtccagctaattttgtatttttagtagagatggggtttctccatgttggtcaggctggtcttgaactcctgacctcaggtgatctgcctgccccggcgtcccaaagtgctgggatgacaggcgtgagccaccacacccggccaaagagataactttatgaacttcctctggcttcccactagccctcccttcagactctaggtagggccttctggccccacctgcaggctcagaatccctccttgctttgagaataatcttcttccaagacagggaaaacttaaatctcaataggtcagaggatttagcacccaggcaactattcctctagtcacattcaactttggcttctattttcagtaaatgtccttctgctctagttggaaactgaaattctctcgccaatgcctcagttgtagtgactgagcagggccttgataaccttacttcttagttttgtcagtattccaaaagattaaatctgaatctggaatacatagctggagccagtccactgccagaacttttaacactaactgcctgatccccattcatctcctcattccaatgagctctgcatctggttagacgttgatgagactgcctgcctccaactttacagataccctggcctcctaaaggagttaaatctcctttacttatatgcagctaggcctgccccaaagaatgcgtcccctactagtccagtgcccaggcccaaggctgctttggctagggctaccaagctctgaaggaggaatgggccacagcaaactggacaaatacaaaacgtgcacagaagtaattctagctgcacggcctagaaggaaaaatgggttggatcaatagagcttaaagatcaaaacactacccatttcctaaaccagtcaccttgacagggattcttaccaagagagttatctccattttaccttaacaactgtagcaggagagatcccaaaaggagaccaggggtctacagcttccaatttcatgtttacagagaatgtatgaatgccaataacttgtttgtcctgaaatgcagacaccaaaaggggatgaaaacatagtatctgtatcaatcttacactcacatgtagctgtgattaacagaaatgtccagctctggtaaatcctatagttttcttcttttttttaaatgtgcaaaactatccaatataattttctactctggaaaaaactatccaggaaaaaacaaaacacacagaagtgcttctactctctacattcaaagacaaggaatatctggagaaaaaaacaaatttattttatcagttaagactatgtagttaagggtaaaaaagaaaaggttcaaactactttaggagaacttggggagaaaatctagacaactgttagaagaaaacaaggatgatcatcagtccagccttaacacaccctcctccttcagagaccatggcattcttaccgactgcaggggctgctttacactttcacctcctgcgttgctttactctactgtaaggggagcaataccggtctatcacatgttttgtttttaccttaaataagtaagatggtaatggctcttcctcttcctctttcactttggccaaaatctcttgccactcagcttcattttttagatgtctaatggctttaataaaacatgacaacatgctttagatgatgagaaacttatactttttacctgtcctgaaagcattcacataaacaaaaacaagtcactttccactggaactagaaaagggttcaagcccacttatatccctttacattcaaagaacttgcaccttaacttcagtactttgctctatgcagagcctggacagcttggctctatgaaaatacctacagtaagatcataatgattgttgtaatccataaaattgtaatataacatccaaattggggcacataataataaatgcaaattgatttaaacagtaactctagaaataccaatattattggtatttcttttaatcaacaatttgctgtgacccaattttctatgtacctagctaaatgctccctagataattttttattttatcttggtcaagggtcagtatgggttggcacagtagtctatgaggtatatcaatatgtgtggtaaattataaaagcaataaaaagaaaagaaaagtaggcacttggccaggtacggtgtctcacgcctgtaatcccagcattacgggaggctgaggtgggcggatcacttgaggtcaagagctcgagaccagactggccaacatggtgaaaccccatctctactacaaatacaaaaattagccgggtgtggtggcatgtgcctgtaatcctagctactggggaggctgaggcacaagaatcgcttgaacccgggaggcggaggttgcagtgagctgagatcatgacactgcactccagcctgggtaacagagcaagactctgtctcaaaaaacaaaacaaaacaaaacaaaaaccaaaagcagaacaacaacaaaaaagaaaaataggcacttaatttaacaactccatataaactgttttgtaatagctctattatgagaactaacaaaggttttcataatatgcagaatatattttttcagcctcatagatattaataacatagcatgttaatgtcacagaagaaaaatgtcctattactcttcacctgaagggggctgaagctcatatccctgttgagcagcccaaccaacgtgatgaagaaatggatccaagtaatacaaccaatgttcataattgtcagaactttcaagtccttcataacgtagcttcagccttcctccaatgttttctactacagtaacaatccaagtgcttaaagagtcctggaaagcttgacattctagtctggatcctggagcaatgagatctaaaggattcctcccattacggagctgtaggattaaaaagtaaaacaacccagtaagagaaattaacataatatttttgaaaagccaacttataaatgatctcaaaccagcctttgtattttttacccattcaaaagccagtgacactaaattgtctatcatcatacaagcctcttacagtattatttctaggagatatgaaaatgtttatcttaaagaaaatctacctataatgcagtaaaattactctaacacatctctatctctaggactatgttatgtagtttcatttagtaagaatttttaaaatatcatcattcctcatctattataaaacaaatatggtccaggcatggtggctcacacctgtaatcccagtactttgggaagctgaggtgggcagatcacttgaggtcaggagttcgagaccagtgtggccaacatggtgaaaccccgtctctactaaaaatacaaaaattagtcgggcatggtggtaggcacctgtagtcccagctacttgagaggctgaggcagaagaatcacttgaacccaggaggcagaggttatggtgagccaagatcatgccactgcactctagcctaggcaacagagcaagattctgtctttataaaaaatttaaaaatttaaaaaaagcaaatatcaaaataccatcatcatcattaaagagaaaaaatcaaacaaaagtcaaagtcaaagtcacctgtaatcccacctcaaagaaagaaccacaagaaacactttggcatacactctttttctccatacaagtcaatatccacctctgccagtctgtctgttcctattttttgaaaaatggaaacactgtatactgtttcttaatttgttcttcatttagtacatcataggtatctttctataatagcacatataactcttcctcatgttttatagtattttatgatattttacattgtaaatgggcaataatttatccagttacctacagatagtatttcagttgtttctggttttttattgatgtcacaacaatgttcaaatgaacagagtaaaagcttttgattacagtgatggaaaggaaaagtttaactctcactatctagaagtatattaaaaactacaataaagaaaagaaattcattatcaagttatcacttaatcatttctaatacacaaccttacatttttttcctagtaaaaactgctctgtgacacttacatatccagatatgcaaagggacatatgaaaaagtggaggaaaagatttagagctaaaagtcagcatggcagagtcatggtcaaaaaagagtagaatagtttatcaattcatccattcattaaaatgttactgagtttttagtatgtataaggccctggctaagcataaataaatgagtcagagtataaaaaataaaaaccagtttgaaatagagtattcaccaatcaaaatttaaaagggaatgtgaatggatgacagaagtaaatgtaaccataaaactcttagaaaatacaggagtaaatcttcttgaccttgggttaagcaaagccttcttagatatgataccaaaagcacaagcaacaaaagaaaaaaagataatctggattatatcaaaataaaaaatgtttacgctgcaaacaataaaaagacaaaccatagaatgggaaaacatattttcaatattttgaaatgcatgtatattttgaatgcataatacattcaactcaataataaaaagacaacccaatttaaaaatgggcaaagaaatgtctccaaaaaggatacagaaatggcccataagcacaaaaaaacatactcaacatcaacagtcattacagaaatgtaaatcaaaatgagatgccacttcatacccacttagtcagctataataaaaaagataacaagtgttggcaaggaagtagagggatgggaaccttcatacattgcatttcacatatgccacaaataattttaccagtatgacagaaagtgacaagatataacttagaaatgtcataaccaataaatccatttcacaaaatcaagagatctatattcactaacaagcttaaaggccacactaatttaaaaggactgctgaaaagcaggtggaaggcagaagtgcaatagatccaatgtgttccaagcaaaaaaaaaaaaaaaaaagggtgggttggggggactccaagtcacctggtgtgggagttacaaatgtccaccctcaagcagaatcgacctctgctcagtttcagagtgaaagccctcagaaggtcctattttccaactgtataaaagaatctgggaaattagattttttatgtgttagcaactaattcagaaaatatttaggcactaagcaagccaccagtttgcaacctctgagggtaagtttaaacttcccaatacctatgcctatgtctctaataataacgtttattttcttcagagtggtaaataagcaaccgattttaagattctttgaaagatcagatgggttttccatgctgatgtggcatgtagtaatactcacgccctctagcagcggaacaggaggactacatgctcctatcagggtctgccgcagaaactcatcccagtcagatactttatctctgatgcctagatgagggaataaatgactgattactcaaaatgccagccacagaatgcagagaaaccgaaatcagtggagatggtttaaaggtatttcacattttaagatctaagagtccaacatactgcttgagagcttgaaaagataaaacaaaataaaaccaaaaatgcttctctagatggagctactttctggttagtttattaagagttgtatacaaaacaaagagaatagtcccaactacctattcctataattttacccagaaggtaccttactttattttttatgatggaaactttcaaacatacaaaaagaaaaatgatctaatgaatcctaagtgccctggcgtcaacaactgtcacctcatggccaatctgtttcatctaaaccaggatttacaagctacaactcgagggcttaatccagcctgctgtctgtttttgttaataaagttttactggaacatggccatacccatttgtttacatattgtctgtggctgctttcacactacaaaggtagggttttagcagctttgacagagattgtatgactagtaaagcctaaaatatttactatcttgccctttacagataatttgccaatgcctggcttataccctcacactccacccatgcccaaccaaggatcagttagaagacaattccagatagcatataatttcatccatatatatattttagtacatatttctaaaagaaaatattttcttacaaaaccacaataacaacatcatacctttaaaaaattaacaataattccttaatatcaaatatccagtctatgttcaaacttccccaattgtctcataaacagttttgtcaatttgtttgattacatcaggacccaagtgagacgcacgcattgcaaatgtctccttgatttcttttcatcagtaggtttcttctccttcctcccctcccgtgtccctactctctctttttttactccacatttattgagacctggcctttgttctctatggagttttttagagtctgatttcattggttacgtccctgtggtgaccagttgttctactgttccctgtatttgccataaatcagtatttagagctagaagcttgatcaaattcaggttagactttgcggggtggtgagggtgaaagaatacttcacaagtggaataagttatacccttccctcaagagcatgaagaggcacatatggtctggctgtctctccctttgtgacattagcagcttttaacggttactacatagatgcactgattcattacgggctcaatggtgatattctaattgtattattccttcttcatttactaaccaaagaacttccataaagaaaaatttctctacatcaactatttgattatgctgaggtagatttcatagaaagaaggctttctttgaacatatacttgattgtctttactctttctctatatttaccaccctttaaaataaacagttgattggcaggcatcttccaagagtggctaatgagggttttgtttcaaaatttcactatgaagtcatacattaaaacaaatacatttcaagccattacagctgttgtccttacgacactctatcttcaaccagaggcagtctcttcaggttggctcctgagaccttttggcatgacactagtaaagagccactgataacttttttgctttttggtatgacaagatgttccaggatcatctaggaaattgcctgacctagtgcaggactcagctacttctgcaagaagccccagtttatttccatggaaatggtatttagagacctgggcatgctcattgtcactgggttagtgtttctcggccttttcagtgtctagagttaatgcatttcttcttcttcttacatcacaatacttccaatacaaattcagaaagatagtgctttcatttaactcatccatctaagctctatttcctttctataacgctgaaaatcctagttctcaattacacatttcttttttttttttttttttgagacagagtcttgctctgtcccaggttcacgccattctcctgcctcagcctcctgagtagctgggactacaggcgcccgccaccatgcttggctaattgtttgtatttttagcagagacggggtttcaccatgttagccaggatggtctcgatctcctgaccttgtgatccgcctgcctcagcctcccaaagtgctgggattacaggggtgagccaccacgcccggccacacatttcattctttatttgcttttgcctaccatatacaaacaactatttcaaagtaacaacattaagtctaccaccaacagtaggattactaaaaataggttaagattttttctttgcatttttttttgttattgttgtccttagaatatataaccctaactggggacatactttcatattttactgtatttttaagtcactgaaatagctcctctttgtgtggttatcccataagctccatatacagttaggtttccttgatttttaggaattgctttctaaacatttaattttgctttctagttgcataaaatatttacaaggttcaaaagtcaaatctacaaaataaaataaggtacattcataaaatttagcttctattcctacctccttcattcttttcccttctttccccataggtaacttttttctaaatgattcattcttttttttttttgagacggagtcttgctctgttgcccaggctggagtgcagtggcacgatctcagctcacggcaacctccgcctcccgggtccaagtggttcttctacctcagcctcctgagtagctgggattactggcacacaccactacggttggctaatttttgtatttttcgtagagatggggtttcaccatgttggccaggatggtcttgatctcctaacctcgtgatccacccgcctcggcctcccaaagtgctgggattacaggagtgagccactgcgcctggccaacgatttactcttttattttgaaaaaaataagttcacacacacacatttgtatcatcatatccttgagctctcctcctcctcaagtctgtacacatttttctttttttcatacaataacatatcctgagcccactccttggttgtatgcagaccctcctcctttttattgctgtctatagctgcttttcttacaaagtatcctttgtcagctatcaagactgacagctggtttcttttctactggcagttgcctgtacatctttgtccttttatttttactttttcgtagtctctctgcttaggtatgtctcctatacagaggacaagagtggattttgctttatgaggcaatctgaatttatttgtttacttctaataaaagagtatgcccagtaacacttattgatattattaatatgcatggcctaaatttcatattgttaaatgttatatacttcgtgtatatgtagttttttttactatgtgatctatcccgtttacacatatagtttctctttctaagtctctttcgtcatatagaaaggttcttatttttgttctacggattacctttatataacacttttagtcctctctatttttggactactttctattttgttgttgttgtttctataaacaatactgaagttagctataagcccttcgttttctctccttcagcatctcatttcaggtactatccttttactcccagttaacatttaaatagttatattacatggcaataaagctgtttttttttttaagacaattagtgggcttatacaactattcacgttttccccattcttgtcccatattttttatagtaataatgtaactacattttcagagcatacagctattatataccacagtgtctcccttacaaccatcatttagtttaagttctatagctatacatatatttaatgtttcactaccatttcccatgctaatgttacctcattaatttgctcagctgaagctcattccctagtggacgccttaggaagggctcatgggaacaatattacttagttcttacctgttcgtaacagtttgcatatagcctttagatctgaagttcagtttggctagatataaaatccctgtctcatattttctctttcattacatttcttaagtacattacattccattgtcttttgacataaaccattgttaataactctgatgaaaatcttgttttctttcctctataagaaacttggtctttctcctaaatagccgtggtattattttttgctttaaagttcaatactttcattagaacaattttgatgtagctgccctcatttgattttcctacatacatagtaatccctttcagtatgtattacaaggcctcttttatttctgtaaggtttacctgaattatggtccagcatggtagccggactacacctgcaatcccagcactttaggaagctcaggcgggcagatcactagaggtcaggaatttgagaccagcctggccaacatggtgaaaccccctctcaactaaaaatataaaaattagctgggcatggtggcatgtacctgtagtcccagctactcaggaggctgaggcagaagaactgcttgaacctgggaggcagaggttgtagtgggccgagatcgtgccactgtactccagcctgggtgacaaagagtgacactctgtctcaaaaaataaataaataaatgtttacctaaattatagtttatagtattttattgtttcattgcttcagttttcttcttcaaggacttctactgcaggtatgttaaatcatttttacctagctgtataaggtgtttctcaagtcctttttatttctttgtttggtttttattttaaaatttctttcctttttttcatctgtttttcttcagatagtatccatggtgctgactcattcctgtgctcattttaactaagtcttcattttcaatattcttttatttccagttcttgcctaagttttactttttctcttttcaaatcttcccttttttaatcctttcatttctgaatgtttataaattttatttataatttttttcactgtttctattattgttgctacttttttgttaccttattttgaaatgtttttatctgacacaatgttcacctcttctgtggttgtttctactcttttttcactgtaataatcttgtatgagattcaactgaaatccttttctgttgttcacatttaaacgagatgcattttcctacatacgttaggatgagatggtaggccaggtggcttcatgtctctagagctctctcttctattgttactcacaaagtaaaaaaccttcacaaaggagaagcccacagacatcccaggaccctaacactcagatcttcgtttccaaataccattcttcactaaaagaaaagacttcttggggaaatggctgatttcagggctgagacagcaaaatgcttcttgagccaaaaaataagaaactgcttaaagaaaaataaggacatattaaaaggatacagtagcccgcttgaaggggtaaccactcacccaatctaggacagtttcaggatcaaaagaaatataaagtaaaggattataacccattaaataagatcagaatcatgagtctacactgataaacatacctacatatacacatacatacataaatggaggaaagggggaagctctttctatagtatagtagaaagccaattaagaaatgtagaagaaattttttaaaacaccatttggtaattattgaaaaaataattgtttcagataaaatttataaatggatactaagaatagtgggttaaagtgtgaagagtaatgggatattttcataatctccaagtatcttccaacaagacactaactaaaaagcaaaaaataatacctttacgatgaaaaaacttggcatatacgaacctaatcaagtgatggaagttaattttacctgtaataaggcaaatcaatagcatgtatcttctgatatcatgcactggaagggcacagcttttgcatttttcctaccaaaagtgaacaacctgaatgtaaggaagcatcagacaaacccaaattgtgggaaatctgacagaatgactggcctgtactcttcaaaaatgtcaagttcaaaaaagaaaaacaatggttaagaaaacgagagagacacgacaactaaatgcaatgtgattctagacaggaatcttggaccaggaaaagaaatacagcataatgaacattattgggaccaggatagaatgaacattgggaaaactggcctgtaactttcaaaatatcaaagtcatgaaagacgaaaaaccctgaggaactgttccagattataggaaacttatgagacatgacaactgaatgtaacacatgatctgggatttttctttaattaaaaaagagttattggccaggcgcggtggctcacgcctgtaatcccagcactttgggaggcagaagcgggcagatcacctgaggtcaggggttcaagaccagcctggccaacatggcaaaatcccgtctctactaaaatgcaaaaaattagctgggtgtggtggcgggtgcctgtaatcccagctacttgggaggctgagggaggagaactgcttgaacccaggaggtggaggctgcagtgagctgagattgcgccattgcactccagcctgggcaacagagtgagactctgtttcaaaaaaaaaaaaaaaaaaaaaaaagttattgggccaggtgtggtggttcatgcctgtaatcccaacactttgaaaggaggaacgcttaagaccagcagtttgagactggcctgggcaacacagcgaaactctgtctctacaaaaaagtttaaaaattagttgggtatggtgacacacacctgtagacccagctacttggcaggggtgaggtgggagaatcacttgaacctgggagttcaaggacacagtgagctaggatcacgccactgcactccagcctggctgacagagcgagattctgtctcaaaaaaataaaatagaacgaaattatcttaaatgttattggaatagctggtaaaaactgaataaggcccaggcatgatgcatgatggctcatgcctgtggtactagctattagggaggctgaggcaggataatcacttgagcccaggagttggagaccagtctgggtgatatagcaagaccctgcctcaagaaaatagaaatgaaaataaaaacaaaaatactagaaagtgatataaatataaaaataagaccatgtttattaaacaatgttccttttaaaaaactgagtactatctgtaaacagtattgtatcaaagttaatttcctcattttcatattttactgtaacatgaataccttgtttttagaaatacatacagtatttttgaataaaagggcatcatgtctaaaactgactctcatgtggttcattaaaagaacatgagtaaagcagtggagacaagataaagtaaacatcatatatgtcaccattaacaacatttggaaacacttggcaaaaagtctccaataattttccatatgattctcataactttttggtaaatctgaaattatatcaaagtaagaagttaaaagaaaaataccaaaagtctggtattttctttcttttgagacagaatctcactctgtcacccaggctggagtgcagtggcgcgatctcggctcaatgcaacggccgcctcctgggttcaagtgattctcctgcctcagcctcctgagtagctggaattatagttgtgagccaccacacccagctaattgttttgtatttttagtagagacggggttttgccatgttggccaggctggtctcgaactcctgacctcaggtgatccagccgcctcagcctcccaaagtggtgccattacaggcatgggccaccccgcccagacaactcacgtattttcttaaatccggagtcctcttatctttccccacctttatctcacccttctctttcttttgcctttattgtctctcttctgcttaatttggtttttactccttctggaatggtgcttgatttagttcatttaagagttcctagttaccagattgcttgagggtatgaggagagaggacaataaaaacaaaagaaaatcaacagcacatcagtctggcccaacgggcttaaaaacaaccagatctacaaatctcaaactcagagaacctcacagtctgaaaggatgatatgcagctagtgttccctatgagcatcataaaaacctgaggctttatgtagcaaagaaaataattttaaaagacagggaaatgtgtattattccttataaatattttcactcaaaatgctaacctagaaaagctgggtaaacctatatgctcgagagacttaaaacctcaagactgtggacaatccaaattttcttacagtaaaatcacgtcacgtcttgataggaagtatttcattaccttctggggcttcaagggtcttcttattctgctcacaccacccaatggggtagagatcagccttcctgatgtcacaccagaaatctgctctccgatcctccccatagccatcatagcggagaaggagcaactgctcacaggtagtgataacggtggcaacccagtaggtctcaggatctgttctcacagccacctccagcttcatcccaggagcaaatccattttgcaaacgtgtgtccaccttaacagggaaatgttattaagcaccagacaagtatcttaaatgagtatttctttgaccaatgttcttttttaagacttacaattccgaagcactaaatgcaataacatctcaaggaaagcctgagaaattccaattctaacttacagaagcaatccagataaaacaaacgaatagcaatgctgctctgttccatctgacaatgaaggaactcaatattttcaccaaagcagtctattatgattacagaaaatgcttcctattaagtatataaattactagtcaccattttaatagctttcaacacattgtttacaagaatgatttctgcatcaaccaacaggaaatttatgatgctagaaaagtgagaagacaaaaataaaccataatgataataaattagtacaatatgtaccatatacagggagccatatttcccagtttccctaaaagtctatgtttccaccaattactcttaaataataattaataacatcccccctttccctctcaaaagtgttctaatttagatgaaacattatatggtcacaaaggtctgggttagcaaatctggaactattaatactttatgtgtatactaacattaaataaatatactatgaataataagagccaggtttctcaccatgggaaaaagaagtgacaaataagcaaagggaagcctgtggtgttggactggaatcagatgcatctgaacagggacatgatgatggattggtaggcagatagagacagacagacaggcagatagatggatggatggatggataaagaaatgaacgaataatagagatggagacaaccatacacatgtatttcccaactctgtgaattgagagggactagaaataatgacatgtagtcacagtaagcaaatatagtgtacaaattttgatttctttcttttcttttttatttttttgagacaaagtttcgctctgttcacccaggctggagtgcaatggcgtgatctcggcttaccgcaacctctgcctcctgggtacaagcgattttcctgcctcagcctcctgagtagttggggttacaggcgcccgccacaacatccagctaattttttgtatttttagtagagatggggtttcaccatgttggccaggctggtcttgaactactgacctcaggtgatccacccacctcagcctcccaaagtgttgggattacaggcgtgagccaccaggcccggcctcttttttatttttttagacagggactggctctgtcacccacactaaagtgcagtggtgcaatctcggctcactgcaacctcaagtcatcctcccacatcagcctcctgagtagctgagaccccagatgtgcgccaccatgccttgttaatttttgtattttctgtagagacggggttttgccatgttgcccaggctggtctcaaattcccgatctcaagcaatctgcccatcttggcctcccaaagtgctgagattacagtcatgaaccactgtgcctggcccaaattttgatttccaaataccaccttccaattaaaaaaaaaaaaaaacaaggacttcagggaaaaaagcttattccgattctgggataggaaaaatacaattagagcctggaatatcttgtgatgccagaaagtaaggaaatgatcaaaaaattatgggagtatgttgaaggaacatacaagacaactagaaggatctcactggctacatctgggacaatttgagcaataaaataaatagtgagagtaatgcattataactaatagatttaaataagtatccatgagtccacactgatataaattaggggagaggggacagatcttccttagagtagaaaaccagttaataaatattgaaaaaaaaagatggaaatagaaaatcactagtagacaaacatcacagaaataaacattgcaagagccgggcgcggtggctcacatctgtaatcccagtactttgggaggccgaggcaggtggatcacgaggtcaggagatcgagaccatcctggctaacacagtgaaaccgtctctactaaaaacacaaaaaaaattagccaagcatggtggcgggcgcctgtagtcccagctactcaggagacaaaggcaggagaatggcatgaacccgggaggcggagcttgcagtgagccgagatcgcaccacggcaggcaatccagcctgggcaacagagcgagactccatctcaaaaaaaaaaaaaagaaaaaaagagataaacattgcaggcaagaattattgatggactctaaaatactatgatgagaaacaggatatctgcaaaatctcaaaggttctcccagtaagattcttattaacttcaaaggggaaaacagcaacattacagtgaaaaaatctggcagatgccacgtaactaaccaatcaaagtttgcatcagtatcatgcagccttgatttcatacaagttaactgcaatatcattcctacaacattattaccaaatctgcacaaattcaatccaatcatgagaaaaaaacaaatccaaattgaggaatattccacaaatagttgacatgcaatataggctcatcaaaagtgtcaagtccataaaagacaaagaaagaacgaggaactgtcatataccagagaagactatgaagacatgacaaataaatgcaatatggcaaccacagccactggaaaatgcaagtggaatcctggagacagccagagagggaaagtcccacattctgtgtaaaaagtcctcccccgctagtcactacctgttctatcactatcctaaacactatggttatattgactatgtttccacactatgttaatgaaattatgcggtatgaatattttttgagtggagcttctcttgtcgaacattacttacgagatttattcatgctgttgcatgtaacagtagcttacttcttttcactactgtgtagtattccactatatgaatatgtcacaatttattcattccacttctactagttactagctatttgggcagttcacagttttgggaagctacaaataatgatgccataaacatttttgcttgtcccttggtacatacatacatgaatttctaaaatacataacaaccaaactgttttccaaagaagttgtaccaatttagtttcccaatagcatatgagaaatccttttgctccattcctttttttttttttgagacagagtcttactctgtcacccaggctggactgcagtggagtgatctcggctcactgcaaactccacctttcaggttcaagtgattctcatgcctcagcctcccaagtagctgggaccacaggcacgtgccaccacacctggttgatttttgtattttttgtagcaacaaggtttcaccatattggccaggctggtctctaactctgggcctcaagcgatccacctgcctcagcctcctaaagtgctgggattacaggcgtgagtcaccacgcctggctccttttgctccactctaaccaacatttttctattttcagtctttttcactttttttttttttttgagacaaagtctcactctgtcgcacaggctggagtgcagtggcgtcatctctgctcactgcaagctccgcctcccaggttcacgccattctcctgcctcagcctcccaaatagctgggactacagatacccgccaccaagcccggctaattttctgtatttttagtagagaccgggtttcaccgtgttggccaggatggtctcgatctcctgaccttgtgatccgcccgcctcggcctcccaaagtgctgggattacaggcgtgagccaccgcgcccagccccttttttcacttttaaccattttggaaggtgtgtcatgtatcttattgtaattttaatttgtatgatctgattattaatcaagttgacaacctttatatttattagtcatttagatttcttttgggaaatgcttaagttccttacccatttttaaattcagtctatattgtgggcatcagttctttgacagttgtgttgcaaacatttttctcattttcactatgatgtcttttgataaacagaagttcttaaatttattgtagtctaatttatcaatatttttcctttaaaaaggtagtgattttctatatatgtattttttttttttttcctcgagacagcgtctccttctgtcgcccaggctggagtgcagtggcgcgatctcagctcactgcaacctctgcctcccgggctcaagtgattctcctgcctcagtctcccaagcagctgggactacaggcatgcaccaccatgcctggctaagttttgtatttttagtagagatggggtttcaccatgttgtctaggctgctctcgaactcctgacctcaagcaatccgcctgcctcggcctcccgaagtgctgggattataggcgtgagacaccgcacccagctgctttttctgtatttttaaacaaatcttttcctatctttaaaggtcataaggatcataaactatattattatctaggagctatcatatttagaactaacatacacctggaattaatgaagttaatatgaagttaaatatgggtaagggtttatttgtttcaacatgtgtacacaattaaaccagcacttttcccgaccactataagtcatcaactttgtaataatcaagtgtccctacaaaagtggatctgtttctgatttacttttccttaaagtagcactatactatcttaattaaacttgatatctagtacagcaagtcttctcattttgtcttattctttaggtgtgtctggctacccttgatccacgatatatccatataaaaatcagaatcagcttgtcaatttctacctaaaattttatatatatgtactttttgaaatttaatttgtttgcagtaaatctacagacctagttagggaaaactggtatctttacaatagtgactctctcattacatgaacaaggtgtatcccttcatgtataatggtctttattttacatcagtaatgaattggagttgccttacaattattattattattattattattgttattattatttttggagaccgagtctctcattctgccgcccaggctgatgtacagcggcacaatctcgggtcactgcaacctctgtctcctgggctcaaaggatccccccaccccagcctctgatgtagctaggattacaggtgtgctccaccatgcctggctaatttttaatttttttttttttttttttttgtagaaaaggtctcactatattgcccaggctggtctcgcattcctgggctcaagcaattctcccaccttggctcccaaagtgctgggattacaggtgtgagccactgcacccagcatccttgcaattttttttacatttaatcctagacattttatgtttctgatgttactgcattttcatttagttccaaatatttcaaagtttcccgagaccgcttcttttatccgtgttattcacaagtgtgttgtttaatctctaagtaactagggactttccagctatctttctgttattgatttctagtttaatttcactgtggtttgagagcacactgtatgatttatattattttaaatttgttaaggtgtgctttatgggcctgggtgtggtctatctttgtgaatgttccatgtgagcttgagaagaatgtatcttctgctgttgttgaagtagtctatagatgtccattatatccagttgattgatggtattgcagagctcaacaatgtccttactaattttctgcctgctggatctgtccattttcgataggagggcgttgaatttcccgactaataatattgaatccatttgtttctccatgcagttctaccaggttttgacttgcgtatttttacattctgttgttagatgcatacattttaaggactgttacgtcttcttgaagaactgacccctttattattatgtaatgtccttctttttttttttttttttttttttttttgagaccgagtttcactcttgttgcccaagctggagtgcagtggcatgatctcggctcaccgcaacctccgcctcctagattcaagcgattctcctgcctgagccttcctgagtagctgggattacaggcatgcaccaccacgcctggctaattttgtatttttagtagaaacagggtttctccatgttggtcagactggtcttgaactcccgacctcaaatgatgcactcatctcggcctcccaaagtgctgggattacaggcgtaatgtcctaacattccttgctttgaagtcagctctgtctgacattaatacagctaggtcttttttttgttagtgttagcatggtatatctttctccatccatttacttttaacctatatgtctctttatatttaaagtgcttttattatagacaacatatagttgggtcatattttttgatccactctgataatctccatctttttaacagtgcatttagaccactgacattcaaagtgattactgatatagttggattaatatctaccatatatgttagtgttttctatttgttgccttcttctttgtttccattttgtctttcactctttatctgccttctgtggttttaaacaggcattttatattattccactttgccttcttagcatattatatttcttttaactgtttttagtagttgccctagagtttacaatatacatttaaactaatccaaatccaatttgtgattttaaaaaacccttataataacaattctaattctgccatttcttcccctgtatcattgctaccatttatatatgtaagcatgccttagcatatatttatacataagcatacataatcaaataaattgttgctgtcattactttttttgtttgtgttttgagatggagtctcgctctgttgcccaggctggagtgcaatggcgcaatctcagctcactgcaacctccgcctcccagattcaagcaattctcccgtctcagcctcccaagcagctggaattacaggcacccaccatcatgcctgtctaatttttgtatttttgtagagacaaggtttcaccatgtcggccaggctggtcttgaactcctgacctcaggtgatccacccgccatggcctcccaaagtgctgggattacaggcgtgagccaccgtgcccggctgctgtcattattttgaataaactgttatatgttccctcaataaagaataagaaatattaggccaggcatggtggctcatggcataatcccagcattttgggaggccaaggcaggaggttcccttgaggcaaggagttcaaaaccagcctgggcaacatagcaagacccatctctaccaaaatatatatatatttttttaagttagtcaagcatggtggtgggtgtctgtagtctcagctactctggaggctgaggcaggaggactgcttgagcctgaagctgcagtgagctaggatcacaccactgcactccagtctgggcaacagagcaagactcttatcttaaaaaaaaaaaaaaaagaaaaatccaaggttttcttttacattttaaaattccttctccaaaaaaaaaaaaaaaaacacacattccttctctaacactcttttttccttcctcagaaaccatgcaagcaaggatagagaggactgaaatagttaaggcatttaaagcaaaaagccactaatttagagctgtgtatcaagcaaaattatccttaaaaagtactaaagattttctcaggcaaacaaaaattaagggattctgtcaccagtagacctgtcttgcaagaaatattaaaagaaattctttttttttttttttgagatggcattttgctcttgttgcccaggctggagtgcagtggcatgatcttggctcactgcaacctccgcctcttgggttcaagtgattctcctgcctcagcctcctgagtagctgggattacaggtgcttgctacgactggctaatttttgtatttttagtagagaaggggtttcatcatgttggccaggctggtctcgaacttctgacctcaggtgatctgggccgaattaaatgaataggttgggctatttaactgcagcaggaacatgcccttaaagacacagattgctcatgctttagtttgtgtctaaagaatgcctttaagcggttttctgccctgggcgggccaggtgttccttgccctcattcccataaacccacaaccttccagcttgggcgttagggccattatagacatgttacagtgctgcagagattttatttatggccagttttggggccagtttatggccagactttgaggggcttgctcccaacaatgcaatatgaaataaaatccttatctgaaatatgtaattctcaccactttaagagagatataaatgaacaaagaataatcaaaaagggcagctaacatgactgagtttttacacacggaaaactaaaaatagtgggactcgctgtgcatggtggctcacgcctgtaatcccagcactttgggaggctgaggcgggcggatcacgaggtcaggagatcgagaccatcctggctaacacggtgaaaccccatctctactaaaaatacaaaaaattggccgggtgtgatggcgggcgcctgcagtcccagctactcgggaggctgaggcaggagaatggcaggactctttagcatataaagacaacagctaaaagaatatggtttatattcacagacaacactgactgtgcatcagtgtcttcacaaatcctagaacaaaagaagtatgccctactgaacattgctatgggctaaactgttcaccccaaaatttgtatgttcaaaccctaagctccagtatgactgtttggatataggccctttatgaaggttgtcttagtccatctggggtgctacaccaaaatatcttaggctggaaaatgtataaacaacagaaatttactgctcacaattctggaggctggaaagtccaagatgaaggccccaggggattcagaatctggtgagggttcactttctgcttcaaagatggtgccttcttgctgtcttcacatggtggaagttgagcaaacaagctctctcaagcctcctttataatggtgctaatcccattcatgagaaaaaacctttatggccgaatcacctctccaaggccccacctcttcataccaacgcaatggggattaggtttcaacatataaattttgggagggcacaaacatttagaggtcataaggatggagccctgatctaacagaattggttcttcttcctttaagaagagacaccacagaactcttactgtttctaccatgtgaagacacagcaaggtggcaactatctgcaagccagaaagagggccctcaccagaaagcagctacacacctaggctttcagtctccataactgtgagaagataaatgtcagttgtttaagccacctagtctatgatattttgttatggcagcccaagcagactatgacaaatatgaaataagtagttttagaattaattattctgtgtgttttaagagggagtttgagtaaacaggttaaaaactaggtctaggatgggcacagtagctcacgcctgtaatcccagcactctgggaggccaaggcaggaagattgtttaagcccaggagtttaagactggccgacatggtgaaacaccatctctactaaaaattagctgggtgtggtggtgtacacctgtagtcccagttacttaagaggctgaggtgggagggtcacctgagcccagggggttgaggctgcagtgagctatgatgggcgatggagtgagacactgaccccctacccccctcaccaaaaaaaaaacctaggtctagatataaattataaacaaaatttggggtactttcttacattctaaagtcattacacagggcaaatatgttgtcattgacaaggcattaaactgggttgttagggcataaaaccaggctgcacaggccactaatatgacatgtaaatatgcatgtcatacttatgttctgctcagtaagagtgacagcaaataatgctattgaaattactttcaatgaatgcaacaaagtaaatgtaacaaagtacaataatttttttcaatttatgacaaggttttttgacaaaagtaaaggaatattcataaatggtcaaaaagataagtcatgcattgagtagcagaaaatacacaaaaccaaaaaggattttagaatatggcaagtgtgaccaggcacagtggctcatgcctgtaatcccagcactttgggaggctgaggtgggaggatcacgcggtcaggagatcgagaccatcctggcaatggtgaaaccccatctctactaaaagtacaaaaaatagccgggcgtggtggcaggcgcctgtagtcccagctactcgggaggctgaggcaggagaatggcgtgaacccgggaggcggagcttgcagtgagccaagatcgtgccactgcactccagcctgggcgacaaagcgagactccatctcaaaaaaaaataaaaaaataaaaaaataaagaatatggcaagtgttcttactaagggtggcaggaggaaagaaaaagctcttaaattacttcaagtaccacaaattaaaataactttaaattctctaatgataatacagagattcgaaataaagggatataacaccagtaaggcaaatatagttattgcttacatgtttaaaagacccatagggaactgctgtggaccctgtttcttctagataatcttcccagcttaattctacctcttccataccagagccggcatctagaattaaaaataaaacaaaaacaggtgaatcccaattaaagaaaactcaaggtataaaaatataaacttaataaacctaactttacagaatttacttcacaactgattttgcacaaaagaattaagtggggttttgttttgttttgtttttgttttttaaatgataggtgcccttagtgcactgattgtcaacgaatcttcacagaacagcagtttgacatgctatctcttgctgaagaggcacccaaatctagagttcacccaaatggatcacataaaactggtaggagtataaaccattactatcactttggactgaaatttagtattctaatgtcaaacattgaagacacttaataagcatttcaaacttaaattttcaacttgatcctttcttagtactctcagagtgaaagatactcctagtaaatattttaccttaataaaaaaaaaaaagtgtcattatccttgcccccctccctttttctccataccttatatccaatccatagaagaattctgtaggtactatcttcaaaatatatccaaaagctagaaagatctcctaacgtcacgactaaatcaactagagaaccaagagcaaacaaaccccaaagctagcaggagaccagaaataatcaagatcagaatagaactgaaggagatagagacacgaaaaacccttcaaaaaaataaacaaatacaggcactggttttttgaaaaaattaataaaatacctgtaatcccagcactttgggaggctgaggtgggcagatcacttgaggtcaagagttcaagaccagcctggccaacatggtgaaaccccgtctctactaaaaataaaaaaattagccaggcatggtggcacatgcctgtaatcccagctactcaggagactgagtcaggagaactgcttgaacccaggaggcagaggttgcagtgagccgagatcgtgccagtgcactccagcctgggtgacggagcgagactctatctcaaaaataaataaataaataaataaataataaaatagaacactaactagactaataaagaagaaaaaagagaaaaatcacatggacacaataaaaaatgataaaggagatatcaccaccaatcccacagaaatacaaacaaccatcagagaatactataaatacttctatgcaaataaactagaaaatttacaagaaatggataaattcctggacacatacaccctcccaagactgaaccaggaagaagttgaatccctgaatagaccaataatgagttctcaaattgaggcagtaatgaacagcctaccaaccaaaaaaagctcaggacagatggattcacagcacatttctaccagagatacaaagaagagttggtatcatttcttctaaaactattccaaaaaactgaaaatgaggcactcctccctaactcactttatgaggccagcatcatcctgataccaaaacctgtcagagaaacaacaacaaaaaataaaacttcaggccaatattcctgatgaacatcaatgcaaaaatcctcaataaaatactggcaaacagaatgcagaagcacatcagaaagcttatctaccacaattacgtaggcttcatccctgaaatgcaaggctggttcaacagacgcaaatcaataaacgtagttcatcacataaacagaactaaagataaaaaccacatgattatctcaaaagacacagaaaagcctttgaaaaaattcaacatcccttcatgttaaaaactctcagtaggctgggcgtggtagctcacgcctgtaatcccagcactgtgggagaccgcggcaggcagatcacgaggtcaagagatggagaccatcctggccaatgtggtgaaaccccgtctctactaaaaatacaaaaattagctgggtgtggcggcacgcacctgtagtcccagctactcgggaggctgaggcaggagaattgcttgaacctgggaagcagaggttgcagtgagctgagatcacgccactgcactccagcctggtgatggagcgaggcactgtctcaaaaataaataaatacaataggctgggtgcagtggctcacgtctgtaatcccagcactttggaaggccgaggctggtggacgacaaggtcaggagtttgagaccagcctggccaacatggtgaaatcccatctctaccaaaaatacaaaaaaattagccgggtgtggtggcgtgcgcttatagtcccagctactcaggaggctgagagagaagaatcacttgaaccggggaggtggaggttgccgtgagccgaggttgcgccactgcactccaggctgggcgacagagcgagattccatctcaaaaaatcaataaataaaataaaataaaaactctcaataaactaggtattgatggaacatatctcaaaataataagagccatttatgacaaacccacagccaatatcatactgaatgggcaaaagctggaggcattccccttgaaaactagcacaagacaaggatgccctctatcaccactcctattaaacatagtattggaagttctcactggggcaatcaggcaagagagagtgataaagggtattcaaataggaagagaggaagtcaaactgtctgtttgcaggtgacatgatcctatatctagaaaaccccatcgcttcagcccaaaagcttcttaagctgagaagtaacttccgcaaaaatctcacgatacaaaatcaatgtgcaaaactcacaagcattcctatacgccaacaacagacaagcagaaagccaaatcatgaatgaacttccattcacaattgctacagagaataaaatacctaagaatacagttaacaagggaagtgaaagaccccttcaaggagaactacaaaccactgctcgaggaaatgagagaggacacaaacaaatggaaaaacattccatgctcacagacagaaagaatcaaaatatcatgaaaatggtcatactacccaaagtaatttatagattcaatactattcccattaaactaccactgacattcttcacagaattagaaacaaatttcacaggaaaccaaaaaagagcctgtatagccaagacaatcctaagcaaaaagaacaaaggtgaaggcatagccctacctgacttcaaactatactacaagcctcaaaacagcatgatacttgtacaaaaacagacatccagaccaatggaacagaatagagaactcagaaataagattgcacatctacaaccatctgattttcaacaaacctgacaaaaacaagcactgaggaaaggattccctatttaataaatggtgctgggagaactgactaagccataagcagaaaattgaaactgggattccttccttacacctaatacaaaaattaactcaagatgcattaaagacttaaatgtaaaacccaaaattatacaaaccctagaagaaaatctaggcactaacattcaaggcataggcatgagcaaagatttcatgacaaaaacgtcaaaagcaattgcaacaaaagcaaaaattgacaaacgggatctaattaaactaaagagcttctgcatagcaaaagaaacaatcaccagagcgaacagacaacctaaagaatgggagaacatttctgtaatctctccatctgacaaaggtataatacccagaatctacaaggaacttaaacaaatttacaagaaaaaacccaacaaccccattaaaaagcggacaaaggacatgaacagacaccttacaaaagaagacatttatgtgggcaacaaacataaaaaaaagctcaacatcactgatgattagagaaatgcaaatcaaaaccacaatgagataccatctcacgccagtcagaatgatgattattaaaaagccaagaaacaggctgggcagggtggctcatgcctgtaatcccagcactttgggaggccgcggcaggcggaccacttgaggtcaggaattcaagaccagcctggctaacatggtgaaaccccatctctactaaaaatacaaaaattagccaggcgtggtggcgtgtgcctgtaatcccatctactcaggaggctgaggcaggagaatctcttgaacctgggaggcggaggtggcagtgagcagagatcacaccactgcactccagcctgggtgacagagtgagactctgtctcaaaaaaaataaattaaattaaaaagtcaagaaacaacagatgctgttgaggctgcagagaaataggaacacttttacactgttggtgggaatgtaaattagttcagccattgtggaagacagtgtgccaattcctcaaagacctggaaccagaaataccatttgacccagcaatcccattactgggtatctacccaaaggaatataaatcattctattatgaagatacatgcacatgtatgttcacggcagtactattctcaatagcaaagacatggaatcaacccaaatgcccatcaacaatagactggataaagaaaacctggtacatatacaccatggaatactatgcagccataaaaaggaacgagataatgtcctttgcagggacatggatggagctggaacccattatcttcagcaaactaacacagcaacagaaaagcaaaccctacatgttctcacttataagtgggagctgaacaatgtgaaaacatggacacatcggggggaaaagcatacattggggcctgtcaagggggacgggggagggagagcatcaggaaaaacagttaatgtatactgggcttaatacctaggtgatgagttgataggtgcagcaaatcaccatggcacatgtttacccatgtaacaaacctgcacatcctgcacatgtatcccggaaattaaaaacaaacaaaaaacatatttcaaatcgaatcacttcccaccatatctactggctatctctagtccaaggtctaaccacaatatcttccacctttcaattacacttaaaatctaaaatctgtgggacactacaaaggccgtacatgacctgatccctggctgcctaccctaccactttatccccagccagactctccaggctcaccacactcgggtgacaatgaggttcctgccattctttaatcatactctttctacaaaccctctacatttgctatccctcaactcaaagaatcatctcccagtgtccttcatgctccatttcattcaagtctctactcaaatgttcgtcttcagaaaggcaacagtatccatctttaggctctgcttcccttttctttatggcattcattcctattgacaatatacctgttagatcataaactccataaagtcaggaatttgccacctagattcttacaatactcttgttaagtgagccaagactcaaatactctataatccaataatctcacttcacataaactccctaagagcagggatggttgttttgttgttgttgttgttgttgttgttcattgacgtattccttcagaacaatgcttgttatatagaagactctcaataaactgctgaatgagtacaccctaggggaaaccatactccacatgaccacaaggaggtaaatataaggatgttcatcacagcagcatttgtaatatcaacaaactggaagcagtaagtagaatagataagttatggcaacccttcaatggaatactactacacagcagttgaaatgaatgctagcgttgacacagataagtctcaaaaacacacatcaagcagaaaaggcaagtgcagaatgaaaagcacagctaggtttcaaaacaaaactttgcagtgtaatgtttatgaatacatgcatattaatataagagtgtaaagaaaaggatgaaaagaatacgtatcaacttcaacaaagttacctttggggataaagagaaggaaacagattagaagggaagtacaaaagaggcttaaactgtattatgtttcacttcttttaaaaaatgaaaatgcatgaaaagatgttcaacattactaatcattagggaaatgcaaatcaaaactacaatgaaatgccatttcacacatattagaataactataaacaaaaagacaaaaaataataagtgttggtgaggatatggagaattaagaatggttgtatatttctggtgggaatgtaaaatggtacagccactatagaaaactgtacagtacttcctcaaaatatttttaattatcatatgatctatctatctatctatctctctatctatctatgcatgtctgtgtatatacccaaaaagaattaaaaagagggactcaaacatgtatttgtacacaaatgttcatagcagcaatattcacaataaccaaaaggcagaggcaacccaagtgtccatcaacagacgaatggataacaaaatgaatgtggtatatacatacaatggaatattatttagccttttaaaaaaaggaaattctggccgggtgcggtggctcatgcctgtaatcccaacactttgggaagccaaggcagaggacagcttaagcccaggagtttgagaccagcctgagcaacagagggaaatctcgtgtctacaaaaatatttttaaaagtaagctgagcatggtggtgagtggctgtagtcccagctacttgagaggctgaggtgggaggatcacttgcaaggttggggctacagtgagcagtgatcacatcactgcactccagcctgggctgttagagaccccatcctcccaaaaataaagttctgacacatactacaacattgataaacaatgaagacattatgctaagagaaataagcccgtcacaaaagacaaatggatacctacagtagtcaaattcatagaaacagaaaattaaatggtgggtgctaggggctagggaaactggggaatggggagttactgttgaacaggtatacctttccatttggaaagataaggagatggatggcagtgattactgcccaacaatgtgaatgtacttaatgccaataaactatacacttaaaaattgttaaaacggcctgtaatcccagctactcagggggctgaagcaagagaaccgcttgatcccaggagttcaagactgtagtgtacatgattgtgcctgtgaatagccactgcactccagcctgggcaatgctgcaagaccccaccgctttaaaaaaggtgaaagtggtaaattttacattatggacattttaccacaataaaaaattaaaaacatattgaacattaacatttattaaatatttatgctaggcacatgattgtttgttgtagtcttttccatagttttaatgtatttgaaatgttttcattagaaatacaagccaataataaagacagctttgagggcaacttgaaagtacaggccagcagaaagtcaatttacattactaaaacttaacaaggctgggcattcgtggcccttagcaaggactctaggtccttaaatagcatgttaatttaaaaataaaaaataagtaacaattaaaatgatgaatcactcaactaaaatctctcacacaatgctgagaagaaacaagactaatgatgtgatgagatgatgagcaagatatatgagagtttattaaagaaataaatgcataatccttaaatatatgaaaatgtgcaaattttgttttaagagaaatgcaaattaaaacgacagagatatcagattgaaaagaattccaaagtgtgacaagcctcaatggtgaggctgtaaacaggtaaagcataatgacacaacctctgtggaagaaaacttggcaatatccaacaaaattacatatgtatttaccttttgatccagcaatcccacttctaggaatctatcccaaagatatgctggcaaaaatacaaaaagacatttgtacaaagccattcattgtagcactatttgtaataccaagactggaaataaccctgacgtccatcaataaggaaatggttgaataaatatggtatatgtattcagtacaggttgctgtaaagcaatgagaacaatctctatatactgatgtggaataatctccaaaatatactgttaagagtaaccacactaccaaacagtatttttttttgtatccctattttttgtataagatgggagagaggccaggcgcagtggctcatgcctataatactagcactttgggaggccgaggtgggtggatcacatgaggccaggagtttgagaggagcctggccaacatgatgaaaccccatctctactaaaaatacaaaaattagccaggtgcatggtggcacgtgcctgtaatcccagctactcaggaggctaaggcatgagaatcgtttgaacccagaggcaggggttgcagtgagccgaggttgtgccactgcactacagcctgggtgacagagcaaggctccctgtctcaaaaaaaaaaaaaaaaggagagggagatgtgagtatgaggatatatgtatatacactcacatatattagtttatatttttaaaaatgaacaacaggagaataaattaaaaagtaataaaactggctatatatatggaaaaagagaaagaattagtaatatcaggttgaagttattttattttattttattttattttatttttgagatggagtttcactctgtcacccaggctggaatgtggtggtgcgatctcggctcactgcaacctccacctcctgggtacaagaggttctcttgcctcagccttcctagcagctgggattacaggcgcataccaccatgcccagctgattttttgtatttttagtagagatggggttttaccatgttggccaggctggtctcaaatccctgacctcaggtggtccgcccgcctcgcccttccaaagtgctgggattacaggcatgacccaccgcccggccaattttgactttagaaatatgcaggctcattatacaatttagaaacaattaaattgaaattaaaaaaattctataaatttcaaataaactgaaacacatgagctaactgttggtgggaaaaccacaagaaaacaggattcctttaagtaatgttatttatttttatttgtttttgagacagggtcttgctctgtcacccaggctggagtgctgtggtgcaataaaagctctctgaagcctcaaccaccctggctcaagcaatcttcccacctcagactcccaagtagctgggactacaggtacatgccactgcacctggctaatttttttttttctttttggtagagacagggtctccctatgttgcccagactggtcttgaacccctgggctcaagcaatcctcctgcctttgcctcccaaagtgctggattacaggcgtgagccaccgggtctggcctatgccatattaaaatacaatactctgactataaacaccagtggaatatatttaaaagcaaaaactataaagaaatcttaaactgcacactgtggttgatatctaaaatgttggtattattattttaaaataattagaggacttctataggataaaaacaaagaataatattaccatcattagcaaacaagacatttctaaaagggaagagatacaagcataaaatcaaagaagaaaaaactttgtaaccctgttttatttttgtttgtttgttttgtttttttgagatagagtttccctatattgccccagctggccttgaattcccaggctcaagccacctcagcctcccaagtagcaggactacaagtgcatgccactgtgcccagctaaaaccctgtacttttaaatttacattgtaagtatcaatgtaaaaccattattttctttacttttcaaaagatgtgtattttcatggctgggcatggtggctcacacctgtaaatcccagcaatttgggaggctgaggcaggaagatcacttgaagccaggagtttgaaaccagcctgggcaacataacatagcaagaccccatctctacaaaaattaaaaaattgctggggatgatggcatgtgcctgtgttcccagctacttgggaggctgaggtgggaagatcacctgaacttaggagtttgaggctgcagtgagccatgatcatgccactgtactccaccctgggtgacaaagcaagattttgtctctaaaaaatagaaaataattttaaatgtgtattttctagctatgtctgtaagtaaggcctagaataaatgacaacctagtatcaaattagcactccagcacccagattgtggtctctaaatatcatacctactttaaagaaaaaaaaagctcctcagagaaacagcggattgcaagtttggggggcaggatatgttcaggaggtacttgggaatcttactggtccagaaagcaaggactaactgtatcaaaggtacatgacgtcacatcagaagaacacaggaaccagtctgaaacaactcttgctgctctagaatttgatcatcaaatgaatgatgacagcaatacattcaaactcatcaaatgtatacatatacatatacgtacttaaatacatgagttaataatatttaacacaaaggaaaaatcaacttctgaaatggcagaatgattattgcagtgaacccactctcccataaaagaaccaaaggactggctaaccaatgaaaatcatcatttcaaagtcctaaaattaaccaaaggcagagaacaagctaaaaagcatcaattcaagataagccactaaacctcagttagaagagcaaaatgcgacattttaggttgagactattcccttccctcttccttctccagctcaaaaataaaattttagagctgaaaataacccaattaattaaaaaaaaaccctctatggataagttcaacagcagaatgaagcagacaagaaagaatgagtaaaattgaagacaaaacaacagaaaaaacccaatctaaacaacagagagaaaacattaaaaaaaaaaatgaagagagtctgagggacctgtgggacaataagataagcttaaacccaaaaaatatatacaccagactcaaacttccaaaaactaaaggcaaaaaaaaaaaaaatcttaaaattaacaacagagaaacctctcttttaaagcaaagcgttgcgggtgggaggtgggagagtgtccaatgacagcagatttctcatcagaaaccatggaggccagaaagaagtagcacaattattttctgagagctgaaagaaatgagctttcaacccaggattccatatccagcaaaaatatccctcaacaatgaatggggaaatcaacatattctcaaatgaaatgaaatgaagacaatctgtcactactagacctcctttaaaaaaaagactaacggccgggtgcggtggctcaggcctgtaatcctagcactttgggaggccgaggcgggcagatcacaaggtcaggagatcgcgaccatcctggctaacacggtgaaaccccgtctctaccaaaaatacaaaaaattagccgggcgtggtagcaggcacctgtagtcccagctactcgggaggctgaggcaggagaatggcgtgaacccgggaggcggagcttgcagtgagccgagatcccgccactgcactccagcctgagcgacagagcaagactccgtttcaaaaaaaaaaaaaaaaaaaaaataggactaaagccggcgcggtggctcacgcctgtaattccagcactttgggaggccgaggcgggcggatcacgaggtcaggaaatcgagaccatcctggctaacagggtgaaaccccgtctctactaaaaatacaaaaaatttgccgggcgtggtggcgggcgcctgtagtcccagctactcgggaggctgaggcaggagaatggcgtgaacccgggaggcaaagcttgcagtgagccgagccgagatggcgccactgcactgcagcctgggcgacagagcaagactcccgtctcaaaagaaaaaaaaaaggactaaagccggcgcggtggctcacgcctgtaatcccagaactttgggaggccgagacaggtggatcacagggtcaggagatcgagaccatcctggctaacacagtgaaaccccgtctctactaaaaatacaaaaagttagccaagcgtggtggtgggcgcctgtagtcccagatacttgggaggctgaggcaggagaatggtgtgaacccaggaggcggagcttgcagtgagccgagatcacgccactgcactccagcctgggtgacagagcgagactcagtctcaaaaaaaaaaaaaaaaaaaaaaagactaaagaaaattctctaaatagaaatgaagtgacaaaagagagaatcttggaaaatcaggaaaagaataaatgacaacataaagagtaaaaatactgaaaaatataataaattttccttctctcaagtgttctaaattatatgtttgacagtttaaacaaaaatgttaagcatgtctgatgtggttctcaaaatatgtagagaaaatatttaaggcaattataaataaaagagggtaaagagaagtaaaagtaggtaagatttctatacttcactttaataaaatgaagattgtgataagttatatatatatatatatactataatacctaaagtaaccaccaataagtgctacaagaggatatactcaaaaacactacaaatcaaaatggaattctaaaaaaaagttcaagtaacccacaggaaagcagagggaaaaaaagaacacaggagccagtctgaaagaaatctcactgctctagagaaacaaacaaacaaaagcagaaaaaataaataagcaaaaaaggcagacttgaatccaaacatatcaataattacattaagtataaatggtatacatacatcctataaggccaaaatttttaaaaattagtgtatgctgtgtcaagaaccttatttcaaatataattatacaggcatgttgaaaagaaaaggatgaaaaagatataccatgcaaatgttaataaaagaaagctggaataggtaaatcctagagacagaaagtagattatggatgtcagagtctgggtggaaaaggaaatgatggctaatggtttgttgtgatggaatgttctggaattagatagcagtgatggttggaaaactttgtgaatagactaaaaacctctgaattatgtactctaaaagggttgattttatggtatgtgtattgcatctcaaaaaacatatttcaataaagttttttgaaaaacctcaacaaaaaaaccaatctttattaattaaaaataaaccaattgataatgagccaaagacatgaagagacatttcactgacgaggatatgcagatgccaagtaggaacatgtaaagatgttcaatatcactggcggccatgagggaggtacaaattaacaccaggatgagctgtcactacccacctatcagaatggcttaaacaaaagtaatgacaacaccagatagcagtgaggatgtagagaaactagaactctcatatactgctggtgagaatgtaaaatggcacagccactctggagcataattttgcagttttctttactaaatatgatctagtgattgtgctgctgggtatgtaccccagaaaaataaagtattatatacacaattgttaatagcaacttatgtgttggtaagagccaaaaactggaaacaaccaaaatgtactacaatagatgaatggttaaccaaactgcagtacattcatgactgctcctccacaataaaaaggaacaaactgtcaatatacgcgagagcttggatggatgtcaagggcattattaaagcccatctcaaaaagccatgtactgtgttattctatttatgtaacattctttaaatgacaaaattacagagatggagaacaaattaacagttgcctgggattagggaaagtcaggggaaggaggataggtgtgggagctctttgtggtgatggaatagttctgtattttgactgaggggatggttccaggaatctacacatgtgacaaaatgacatagaattgcacattctttatactaacatcaatttcctcagttttatatcatattatagtaactaatgagagaaactgggtgaaaggaacatgaaatatgtcagtaagtactatctttgcaaactcctgtgaatgcataattacttcaaaataactagaaagtaatcatcaaaattttaatgctattttaaaaaagaagtctgttcaaaacagtttctttttttttttttttttgagaaggagtctcgctctgttgcacaggctggagtgcagtggcgcgatcctggctcactgcaagctctgcctcctgggttcacaccattctcctgcccgagtagctgggactacaggcacccgtcaccacacccagctaattgtttgtattttgtttagtagagacggggtttcaccgtgttagccaggatggtctcgatctcctgacctcgtgatctgcccacctcggcctcccaaagtgttatgattacaggtatgagccaccgcgcccggccttgttcataacagtttcttattttttcagcaaacattattagtagcccctagtgccaggttctctgagaggtacagaagatggcaatgaaaaacaacttaagacttcaaagagcttccagttcagtggtagagaaacagacaatataacacaggcaagtaatataattgtgcatcctagagaataaattctgagaataaaaccaatacctgcatcaagctgctgctccccgttcatttccacagcatataggcaggctatatcctcccaaaacaaaggaaaggcctatggttctgctaggatctgaagattacttgcaggtttcaagcatctgttcaatgggtatccacgggtccaaatgaaagtgctgaaaaatgaaaaagaacacattaaacagcctgaagcccaagtgtgctcactcactcatcaaacagggcactcgactggttgagagatgacataagacaaaaacatactggcagaatagataggactggaggaaaaaattgataccttttctaattttgaagagtctgtatgtgtatgtgtgcgctcatgtgcgtctgtatgtgtagagaacgcacactatcgagatcttgataataaatctaaaactcacaacaaagtaagatgcatatgaatcattaccctttaaatttacattaccatacttagcaccatgattcctatacacaaaactccagttcctaatggtctcctagggagacaggggagttagctttcaatgctgtcttacacaacgaatatgattcaggatagagtattactttatctaattttccatctcatctatctagaatattatgcagatccataaatatcaactgtattagcctacaattataaagagaattcctccaaaataagctttgaacctgcttattctttttttaaaaaacagctttagggctggaagcggtggctcatgactgtaatcccaacactctgggaggctgaagtgagaggattcctttgagcccaggagtttgggaccagcctgggcaacatggcaaaacctcacctgtactaaaaatacaaaaactagctgggtatggtggcgcacgcctgtagtttcagctacttgggaggctgaggtgggaggatggcttgagtctgggggacggaggttgcagagccaagatcgcaccactgcactccagcctgggtgacacagccagacactgtctcaaaaaaaaaaaaagaagaagaaaagctttattgggatataagccacataccaaaatttcccattttgaggtacaaattaataatttttagtaaatgtacaaagtgtaaccatcataattgaatttgagaatatttctattatcctgaaaagaagccaaatgctcacttgcagttccttcctattccatccctaagctcaagcaaccactcatctcctttgtctctacagattttgcctttcccaaacatttcacataaatggaaccatatgaaatgtggtctttcatataaccttggttttctttcacttatcatgtttttgaggttcatccacgttgcagtatggatgaatctatttattcttgctttatatatacatgtaaaataatctaagatattaatctaagatattatcttaatatgtgcctaacagattagaaagagtaaatgaaagggagaagagagctgctacaggaaggcatggcatgaactaactgcaagagcgacaatacagaaaactatagcattgggatgggtacttaacagcacagctttgggagtgatattctgcaggatcaagcaattctatacttctcaaaagttttgagtgtgtattagagcccccagtaaatgattctcataagcaactttaatcatgaagaaaaagcttagcttttaatacatccttataccacttttgcctgaaaaggtaccagctacctaaaggacaatagcttaaaatgggtagggatggccaggtgcgtggctcatgcctgtaatcctagcactttgggaggccaaggcgggcagatcacttgagcctaggagtgaaagaccagcctgggcaacacagcaaaaccctgtctcaaaaaatatatatgaaaattagctgggtgtggtagtgcatgcctgcagtcccagctacttgggtggctgaggcaggagaatcgcttgagcccaggaggctgagggtaaggctgcaatgagccaagatcatgccactgcactccagcctgggcaatgagagtgaaatcctgtctcaaaaaaaaaaaagtggggaggtaaggaaacctaggttctagtgccagctctactgataactagctatgcaatctgatacgctaccgtattatgtccattttttatctataaaacaaataaagatctttttcagattttaaattttcatttcataatgagcgtagaaaacgttttgataactattaaaattgtggacatcccacttgagataaatgccaattatcccaaatcgtatcacagaatataagcaccgaaacccacactttcaaagatgggaacaattgaaaagaaacttgagagtgatgtttaaggcttctaaatgtgctctcttccctcagtttacttttctaccccaagcccaaaacatccaaactgtatcactccacctaccaatttattcatccccatatacttatcaaacaccagctccttaccaaccactactgtaggggtggggtaaagtaatcaagagagatatggttcctgctttcatggagcttattttcaactgcagggagacaaattaagccaacaataaaaaaattatttaaattgctagcaagtagaagtactagatgataagaaagaatataaaggcaggtctaacctaaggtcactgacagtgtccctgagaaaatgatacagcagctaggcaaaagggggagaaaaggaggactattccaggcaccaagaacagcataaaccaaggctctacagtgggaaggacctgaaggctgctgtggctagagcatgcaaaccaacagaataagtggcaaataaaagactgaacaggaagagaagggataacagcaattaatatttactgaggactgcctacgtgctggggcactgttttaagcaggttgttgacaggttcaaatttctatggctctaatttagtggataatctccacatataaagtcttgacacttcagcatggttttgatagaacgaagtcagtgctaaataaatatctgttgggtcactaggctttgaagatgtcatctactgtttatgttcatgagctcttggaacatgctagagtattttgtgcagagagccacaaagtacaaaaataataatgaagcttcaaagccaaaaggcattaagtggagagatgcaagtcttacgtagcagaaagctaaggctgtgacattttttcaaccttacatcaatcatttagattttagccaatgagcaatcagttcatcatcttaataggatcacaagaaatagactgatgaagtcttctgctgtggaacatctgttcacgctctctctttattgttagcctgctgtcttttcatgcagtaaagaaaaaacggtaaactatccaggcgcttagtatatgaaaatttaattcacttttcctttatttcctgttcatattaaattgtcttactgtcatcatttattttatcatttattttggtattatcaccctcttgtagtgaacagaacacactaagagttactcatttaaggcctggtgaggtggctcacgcctgtaatcccagcactttgagaggccgaggcaggtggattgcttgagatcaggagtttgacagcctggccaacgtggtaaaaccccatctctactaaacacacacacacacacacacacacacacacacacacacacacacacactagctgagtgtggtggcgggccaatgtggtaaaaccccatctctactaaacacacacacacacacacacacacacacacacactagctgagtgtggtcgcgggcacctgtaatcccagctatttgggaggctcagaagagaatcgcttgagcctgggaggctgaggctgcagagagccaagatcgtaccactgcactccagcatgggtgacagagcgagactctgcctcaaaaaaggaaaaaaagaaagagttattcatttaaataagtacttataaggctgggcccaatggctcacccctgtagtcccagtgctttggaagcctgaggcggaaggatctcttgagcccaggagtctgaggttaccatgagcaatgatcacaccactgcattctagcctgggcaacagagacagaccctgtctcaaaaattaataagtaaaaataaataaataaaagtaaaaataaataaattctcatgaattaactgatctggatcttactcatcttatttaatactttagtgaactaaataggtgcctagatatttggagggggttctaagaaaatatactgaagcttggagaaattttaaatacttctaagaaatataaataaaaattgaaaaggcaaagctaattggataaaataagctttcaagacaaatactaaaaaagaacaacaactaaacccaggcagaaaaatcaaactgaatagctatttcatttttaagtggtacatcaatataaaataaaactaccatggaattttaacaggtttttttgaaagacctaaaagtcatctgaacaacaaatatgttagacaaaattttcccctcccatcttggtggggtttttttacacacagtatcactgtgttgcccaggctggagtgcagtggcacaatctcggctcactgcaacctctgcctcccaggttgaagtgattctcctgccttagcctcccaagtagctgggattacaggcatgagctaccatgcctggctaattttgtattgtggtagagaccacgttggccaggctggtctcgaacccctgacctcaagtgatccgcctgcctcagccctcccatcttgttttatattacacatacaagtccacactctaagcctagtagtagtaacctggcttcatgttaatgccctttcttttcaaggctaagataaacattgattaagatgagtgattacatggggaagttgcaataatgcaagaaaaatttctgtgggaagtatcctcagccaaatgatttaacatgtctgacataagtaacttttaaagggcttagaaaggacaggacctcagggtggttctaaagatcactgatatgttcggtggctggaaaaacaaaacaaaacaaaacactttaattcaataaataccaggcagttagcaagaaaattcctattgaaatgtttgaatttgtacacttatccctcaacagaaacaagtccaacaataatttcgagtatgttgttaaatatactaattgcaacaattcagcaaatcagatgctccattttcagcagatgtgcaaagttaactctgaccctgacagtgcagtcagtggtagagtcaccttatatttcctgttcccattccccaacaggtgtagttttctgtcagcctttcactcttactatagtcaactgtaactacatgttttatttgtctatctaaattaaacgttgtccttccatttgtcaaatgccaacataactcaggggcagaaatcttctattgtttcattaagttgtttgttatgtcatttttattcttttaacccactgctacatgtctgactagagagattaaaaaataaagtctgataaagtcaaggttttagttcaattttgcgagaaaaatcttagccactcatatcatctaaattaaatctgaggccaggcacggtggctcacgcctgtaatcccagcactttggggggctgaggtggcgaatcacttgagctcacgagttcgagataagcctgagcaatatggcaagaccctgtctctataaaaagtaaaaaaaaaaaaaaaaaaaaaaaattagctgagtgtggtggcacatgcttgtaatcccacctactcaggaggctgaagtgggagaattgcttgaacccagggcaaaggttgcagtgagccaagtttgcgccactgcactccagcctgggtgacagggcaagaccctgtatcagaaaaaaaaaaaaatctgagccaaaccttttcatgattttataaacccaacacagggcaaatccatctcagttgaataaactggtactaataaatttataaaaccactgaaaaagttctaaacaaaacccaaactcaagaataacctaaactggaaaaaaagaaaacaaagaaagtgaaactgtggagccaatatttttaaagattttggacaacaatgagaaattgttaagtaaaatatagcataagcatacaatgcaccatacatggccattggaaattgtgttagagaaatggttttcttctccaaatcccaatagggcattttttttcttctgattctatggttgacccaataggccactgtatttgacttgataagataattttagaatgcacctaagctgggcatagtggctcacacctgtaatcccagcactgtgggaaggcaaggcgggaggatagcttgagcccaggagttgcagaccagcctgggcaatatagtaagacctcatctctacgaaaaatttaaagaaccaaaattagctaaacgtggtgacacatgcctgtaatctcagctactcaggaagctgagaatttttttgtttgtttgttttgagacagtctacttctgttacccaggctggaatgtagtggcgcaatcccgttttactgcaacctccacctcccaggctcaagcaattctcgtgccttagcctcctaagtaactgggattacaggtgtgtgctaccacgcccggctactttttgtatttttggtagagacagggtttcaccatgttggccaggctggtctcgaactcctgacctcaggtgagttgatctgctcttgcctcagactcccaaagtgctgggattacaggcatgagccacaacgcaaccagccaggaagttgggaattgcttgagtctgagaggcagaggctgtaatgacccaagatcatgccgccgcactccaacctgggtgatagagcaagactgtgttccaaaaaaacaaaaaataaaatgaaatgcatctaaaagagaaaaaaatggacaatccagctacatttttgtaaaacatgacacaaggcaagttccttctatcaaaatattaagccagacacagtggctcatgcctgtaatcccagcactttgggaggccaagacaggaggatcacttgaggctgggagttcaagaccaacctgggcagcatagtgagactccatctctacaaaaaaagttttttctcaaatcaaaatagtgtaatattagcataagaaaagacaaacatcaataaagtaaaataaagttgaacaaaatagatcaatttttatgagagtgcagtttgtgataaagagagcattccatataaaatcgtgaaaggatacaaacaaatagtgttaaagaattggctatccattttgggaggaaaaaaaattagaaccttactttatgctgccacataaataaattccaagtgaattaaaagagaaaaacatgaaaaagaagattccaaagaaattaaaagaaaacatacgtgaatatggttatagccttggaatagcatagatttccttaagcaaggaagccataaaatggatacatttgactaaataaacatttaaaactttcaactggcaaaaagaaccataaacaaatttaaaaaacaagctacagaaaaaaaactatctccagcgtatatagcagacaaaatattaatagccataataacagcacctattagataaataagaccaaacctaataacatggacatttttttaaaaggtcagatatgaacgataattgtagggaatgactggtaatcatatgaaaacatattcaacctcaacagctaaaattttatttttcacccagattggcaaaaacaaaagattagtaacactgaatatagttgaagacatgcagaaatggaagccgtcattatcagttcaggagcacaaatggatatagcccttttagacagaaattttattctatcaaaattttaacttgcattctctacaacccaccagttccacttccaatacatttcagaaaaatatcctgagacaacaagcaaataaatagcacaacaatttcaaagaaagagtttaaactgtcctcatttcagggcatacacagagaaacatccccatgtgtacaaagtagcaagaaccaaaatgtttgcttgagcaatgcctgtattaagaaaaaactggaggctgggagcggtggctaacgcatgtaatcccagcactttgggaggctgaggcaggtggatcacgaggtcaggagttcgagaccagcctgaaaaacatggtgaaacccagtttctactaaaaatacaaaaagattagccaggcctagtggcgggcgcctgtaatcccagctactcgggaggctgaggcagaagaatcgcttgaacccaggaggcggaggttgcagtgaagcgcaccactgcacttcagcccaggcgacagtgtgagacttcgtatcaaaaaaaaaggaaaaagaaaaagaaaagaaaaaactggaaacctcagggtcaatcaatacataatggcacatccacaagatgaaagttaaaaagagtaagacagcttagtaagcataaagttcatgctggggtgatgaaataagctttggatttggatagtggttttatatagatgtatacatataacctatatctacataaaactgaacaaaaacaaaactacgtatttctataggcacacatatatatgtgcagatacctttaacgtggtcaggaagaatacatccaaatcattaacaggaaagtgagattcaggggcagggcaaaagggagtgtttcttttaacagtattgggtaaactttttaagataaaaatgtactcatatgtttacttcagtgatttaaaattttaagacaaaaaatgcatttattgacatggaaagctatttattcattctttcaataaatatttactggaaacttattatgtgtcaggcacaataaaaaaaaattagagatatatcagtgaagaaaacagaccaaaatctctgccctcatgaagcttatattttagtgtaaggaagaaagtataatactttttctaaatgtcataagtgatagagctggggaggaatgacagtgtggggtggttaaatcgggtagagagaaaggaggtttcactgagaaggtaacatatggacaaagacttgagggagctacagaaggaaagagcatgccaggcagagggaaaagccagcagaaagggcctaaagggagagcatgtgagagtgagctatgttctaggaatagcagggaggccagggtagttggtgccaagtaagcaagcaagaacaagtagaaggagaagaggcaggagagaggtcaacttcacactgcctgccactcccatgtacctctgtgagtaccccccacctacagcccttaaggaactatacttaccaggtgaccctactcctctgggggtaacaaaacgtaaaggcaatgttggtgggaatgtaaaatgatgcaaccacctgggaaaacagtctggcagttcctcagtgttaaacatagagttaccatatgggccagtatttcactcctcaatatatacccaagacatttgaaaacatatgtccaaacataaacttgttcatgaatgttcgtagtattatttataatagtcaaaaaatagaaacaaatcaaatgtatcaaccaattaatggttaagtaaaatgtaatatatctaatataatggaatattattcagccataaaaagaaatgaagtacgaatacatactacaacaaggataaccttgaaaatattgtacatgagaagatagacactaaaggccacatattatacgcttccatttatataaaatgaccacagaggcaaattcacagagacaagtgggtagattgtggttgccaagggctggtagagaaaaggtaatggataacgactactaatatgtacagggttgcttttgggggtattaaaacattctaatattagactgtggtgagagttgtactattctgtgaataaaaaaactgtaaactttaaataagtgagttttatggtctgtgaaatatatctcagtaaaactataaaaatggtacttatattcaaggacataactgtgcttttaaataacatttcaaatacagaagccaatgacaaaaaaaaaagagacaagatatctgggttacccttaggatatgcaacagaaggagaaagaaaataatttggctgttactggtttgtatcagttaaggtaatgttatgctttaacagataaatttctattttcaattgcttaatccaacagatatgtatttcccactcagatgaagtccaaacaggtgttcctaatcagtaggcaactctccaccatgtgattattcatgaagccaaaagccttccgccacatagctctaccaccttcaacaaagtcttcacaaatcattcactgtaggggatcacacatgggaggttttcatgggacagacctaaaagtggtacgtcccttccacccacattccactaattaaaatccggtcacaagaccccatccaactacaaaggaagctgcaaactacagtatggcacttcccaccattagtaacagagtgcttaaattagtattgccattcaccagaacttatattaacagtgaatagcagttattctacttaaaggaggcttcatgaatcaatagtagtgatactatgaacagtcatggaattctgtcaataaatatttactgagcacttattatcgccacaccacatttgttctaggtgaagaaatattttgaaacctgccctcacgaatctcataatctaaagtgtgtagatagccagcaataaaataaatacaactgagccttgaacaacatgggcattaactacatgggtccacttacagatttttaaaaataactatcttggaaaaatttttggagatttatgacaatttgaaaaaacttgcagacaaaccatgtagcttaaaaatatcaaaaaattaagaaaaaggtgtgttgtgaatgcataaaatacatgtacctattagtctatcatttaccacttttatatacaaatctattattaaaagttaaaaaatatcaaaacttatacaaacacagactgtacatggtgtcattcccagtcctgagaaatgtaaacaaacctaaagatgcagttttacatcataactacacaaaattaagtgtagtacatattgcatcatttgcaatatgaaatcattttgcagctatctcctgttgctattgccttgagctcaagtgttgcgactatctccgtaaaatgctgtatgacactaatcatctccacgtgggcaattcgtctctccagtaaaatgcataaataatatcacaataaaaagtgatctcccatggttcttacacatttttcatgatgcttagtgcagtactgtatttaataacaccgtaagacccatagaaagtaccgctagagatgctggacgtgctttcaagaagcagaaagaagtggtgacattataagaaaaagctggattgcttgatatgtacaatagattgaggtctacagctgcagctgcctccatttcaagataagtaaatccagcacaaggaccattgtttaaaaaaaaaaaaaaaaaagcaaaggaaatttgtgaagccatcactgcagctacgccaacaggtgcaaaaacctcgcattttgtgtgaattatgtttttatctcatgttgaaaatgcagcttttatgtgggtgcacgactgctgtagaaaggcatacctataaactttcatatgatttgagaaaaagcaaagtcattatatgacaaagcaaaagaaaggtgaaggagtccggtcgcggtagctcacgcctgtaatcccagcactttgggaggccgaggcgggtggatcacctgaggtggggagttcgagaccagcttgaccaacatggagaaaccccatctctactaaaaatacaaaattagccgggcgtggtggcacatgcctgtaatcccagctactcgtgaggctgaggcaagagaatcacttgaacctgggaggcagagattgcagtgagccaagatcatgccactgcactctagcatgggcaacaagagcgaaattccatctcagaaaaaaaaaaaaaaaaggtgaaggatctaaagctggaggatttaatgccagcaaaggatggtttgataattttagaaagtggtttggctttaaaactttaggaggagaagcagcttctgctgaccaataggcagcaaatgagttccccaatgccagttaagaaaatcattaaggagaaaggatttccacctgaataggtttctgtggaatttttttgagacagggtcttgttctgtcacccaggctggagtgcaatggcatgagctcggatcactgcaacctccacttcctaggctcaagcaatcctctcacctcaacctccctagtagctaagactacaggcatatgccaccatgctcagctaattttttttttttttttttttttacttttctgcagagacgaggtctcactacattgagcagactagtctgaaactcctgggctcaagcaatcctcccaccttggcctcccaaaatgctgggatttcaagaatgagccactgcacccaacctgaacaggtttttaatgctgatgaaagtgctctattttgggggaaaatgtgctacaaaggacattaattagtaaggagaagaaagtacccggatttaagggaggaaaggataggctaacttgactattttgagcaagtgcagttaggtttataatcaggacagcccgctaacccccacgcctcgaagggaaaagataaaagccagctgctagttttttggttgtacattaaggcctggacaaaaagaaccctttttctgaactggttccatcaatgatttgtccctgaagtcaggaagtaccttgccagtaagggtctgctttttcaagttcttttgatatttgacaatgcccccaagccacccatgagttcaactcaccccatgagttcaacaccaaaactggtgaagggcgtctacttgctcccaaacacaatgtctctaattcagtccctagatcaggagctcataagggcctttaaggctcattacacacattcctttatggaaaggactgtcaacactatgcaagagaaccctgatagaacatcatgaaagtctggaaggattacactattgaagattccattgttatagaaaaagtcctgaaagccatcaagcctgaaacaatagactcctgctagagaaaattgtccagatgtcctgcataacttcacaggattgacaacagagccaatcacaaaaatcatgaaagaggttgtagatacggccaaaaaggtcggaggtgaagggttaagatatagatcatgggccggacgcggtggctcacgcctgtaatgccagcactttgggaggctgaggcgggcggatcacttgaggtcaggagttccagacaggcctggccaacaaggtgaaacgtcgtctctattaaaaatacaaaaattagccggacatggtggcatatgcctgtaatcccagctactcaggaggctaaggcaggagaatcgcttgaacccaggaggcggaggttgaagtaagctgagatcgcggcactgcactccagcctgggcgacagagcaagactcccatctcaaaaaaaaaaaaaaaaaaaaaaaagatatagatcgtggagaaattcaagagctaatagatagcacaccagaggaattaacagaagacgacttgatggagatgaataattccaaaaccagtgccaataaagaagaagatgtagaagaagcagtgccagaaaataaatcaacattgacaatctggcagaagggtttggattactcaggactgcttttatgacaagatccctctatgatatggcactgaaactaaagcaaacagtggaagaggagttgataccatatagaaacagttttagaggaaggaaaaagcaaacattcagacagaaactataatgttatttctgaaaagttacaccacgtgtacctgcccctcttgccttcctttctgcctcctcccctcttccacctgtggcaccctaagacagcaacaccaacctctcctcttactcctcctcagcctacccaacgtgaagatgacaaggatgaagacctttatgatgatccacttccactcagtgaagagtcaatattaatatattttctcttccttatgattttctttgtaacattttttctccagcttactctattgtaagaaaacagtatgtaatatataacatataaaatacgtgttgattgactgcttatgttattgtggtaaggcttctggtcaacagtaggctattagtaaagtttttgagaagtcaaaagttatatgcaaatcttcaactgcgtgtggggtcaacacccctgtgttgttcaagggtcaactataatatgtatgttgaatgaaaacaaatgttaggagaaaaaaactgaacaagggaggaggacagggagtcctacttttaacagagtgatcaaagccttagtgttgaggtaacacaaaacaacaccagagggaaatgaggaagtgagccatgtgggtacgtgcggaagaatattcaaggcagaaaaacaaaaagagcaaagtctctgaagtgggagcttgtgtggcgtatttgaggccacagtggttggaacaaaatgatcacagcagagatgctaggagatgaactcaggaagctatcagggagtcatattttatatgaacttgcaggctgctgtgaagattttggctttggggaagccattgaaggattctgagcagaggaggaacataatttgatttatcttttaaaaggatcactctgcagctatgtgagaagaaagcaagagcagaagcaggaagaccaactaaaaagaccacagaataatccaagtgaaaggtgttggtggctaggtctaggacaggagaagtgaaaatgtggaggaagatgtaagatggatttggtgtatgagagaaagagcagtatctgggctgactgaagtttctggcttaagcaactggaaggatagaactgccacttatggaaaaagggaagtctgaagtaggaatggtttgaggaagaaaaattatgatgagcttcagtgcaaaatagggcaatatgattacttccctcaccactaaaggtttgttcttggagttttcaggaaaatgttttcaatcaacaaaagtataattactatctgtgtagtgtctccaatttataagctttttttcacccacgatgcttcatttgaacatcataaaaaacttttttagacagcaagaatggggccaattctttttttttttgccccttgggaacctccttgttggcttcaatcccatcttacatttcacgttctctaggtttaccaatcagccttgaaggcatttccccatagcaattcagtaatttatgctgccttgttttttaacattccaatttcaacacccacatactttccaatacaggcacttcaatgacaaattttctagctttctttaatgtatgtctttcaataatctcaggcataaataatctttaaaaattcatactataatgaatactatattgaatataggtaatatatattattataatatatactgaatactatactaaatactgtgtgtgtgtgtgtgtgtgtgtgtgtgtgtgtgtgtgtgtgtctattcatactataatgattcatactataatgagtttggaaatatcaggctgaccaccctataaatccctggtccacagttggctaagtatgaccacttcgcagcccggcttccttagcaattactgattagtaccaggatattgagcacctcctctttgccagataccaagacgactaaattgcagttttgaaattatctttcactgtaccagaatatgtcaaaagcatttaaaatcattctttatccttatattatcttataggctggaacggtagctcttccagagttcaaatatgattacattttcatcaattaaatgctttatttatgggagccagtaacatgagcacatgttgaaacagtatgtctttgttctgattaaatcaggagctatttgattcaccaacacaagcactgtcaaaacataccaattccaatagtattataaaaagattataggaaaagaccatgttcagttatgaaaagacttgaaattattctgtaatttcatggttgctgtttctcagctttctcatgtcaagtcacagatcagaaacttcatctcaacagaacaaatgcttgttaaccatttatcaagaaaaaagaaaagattatttgagtacctactatgtatgtgcctggcactttttatgtattgtatactaaataattaggcacacagaacactgtccaacacatggtaagcttaatatttaagtgtttattattttttaataatcttttatttaatcctattctgcttaactcatacaatgataattccattttacagatgaggaaaagttaacatgtcagttcatacacagtcatgcatcgcttaataatgaggatatgttctgagaaatttgttgtttggcaattttgtcattattcgaacatcatagggtatacttacgcaaacctagatggtgcggcctactatacacctaggctatacggtgtagcctattgcccctaggctacaaacctgtaggcaactgtaacacaatggtaagtatttgtgtatctaaacatatttaaacataggaaaggtgtagtcaaaatatatcataaaagataaaaaatgaggccaggcgaggtggctcacgcctgtaatcccagcactttgggaggccaaggtgggcagatcatttgaggtgaagagtttgagaccagcctggccaacatggtgaaaccccgtctctactaaaaatacaaaaattagctcggtgtggtagtgggcgcctgtagtcccagctactcaggaggctgaggcaggagaattgcttgaacctgggaggtggaggttgcagtgagctgagatcatgccactacacttcagcctgggagacagagtgagactccgtctcaggaaaaaaaaaaaaaaaaagataaaaaatggaacacttatatagggcacttatcatgaatggagcttgcaggactgggaagttgttctgggtgagtcagtcagtggtgagtgaatgtgaaggcctgggatattactgtatactactgtagactttctaaacactgcacatgtaagccacattaaatttgttttaagaatacttttcttccttccataataaattaaccttagcttactgtaactttataaactttttgatttttaaaatttttttgactttcttgtaataacacatagcttaaaatacaaacactgtatagctgtacaaaaatatttttttggtcgggcgccatggctcacgtctgtaatccaatactttgggaagccgaggtgggcaggtgacctgagatcaggagtttgagaccagcctggccaacatggcaaaatcccatctctactaaaaatacaaaaaaaaaacttagtcgggcaggcatggtggcaggtgcctgtagtcccagctactcgggaggttgaggcagggaaatcgctttaacctgggaggtggaggttgcagtgaaccgagatcgcgccactgcactttagcctggtgacagagcaagactctgtctcaaaaaaaaaaaaaaaattagcagggtgtggtggcgagtgcctgtaataccagctactcaggaggctgaggcaggagaatcgcttgaacccgggaggtggaggttgcagtgagccgagatcgtgccactgctctccagtctgggcgaaagagtgagactccatctcaaaatatatatattttttctttatatccttattctataacttttttctattaactttttatttacttgttaaaactttttgttaaaaactaacacaacagcctaggactacacacgaccaggatcatcaatatcgttgtcttccacctccacatcctgtcccactggaagatcttcgggagcaataacatgcatggagctgccatctccttgataacagtgcctccttctggaatacctcctgaaggacctgtctgaggctggcttacagttaatttttttttaataaataaaaggcatatactctaaaataatgatttaaaagtacagtaaataaaccacagttatatattatgatcaagtattatgtactgtacataactgtatgtgttatgcttttatacaactgccagtgcaggtttatttacaccagtaccacaacaaacacgagtaggtatctcactatgactttaggatggctactacatcatcattaggccataggaatttttcatctccattataactgtatgggaccaccgtcatatatacaggccaccattgactgaaacaccatcatgccatgcatgactgtagataggaagcagcaggggcagcatttgaaccctcatctgatcccaagcctgagctccttagtgtttctgggctctggggcttttcttggagctcagagaatacaaggataattgtgaggtatgtcttataccatagagtgatggccctagatgatctgcgctcaagttgttttattcattcattcatttaacttctaagttccatactgttctgcttagaatggtgagtaaccaagagtctggatggcacctagacagatgctgccatctataagcttctaaaatcttattctagtagggccctaaaacagattaattcatatgaaaggatacagtacacatttttaaattaaaacacatttccttattaattctttaatggaatggaataacactgaattaagaatggaataacactgaatttagccaaaaggctaaaaaaatcagtgtaataaacagccatcatcaaaaatgtcagaatcatcaggaaagcataaaaaacaaagtctttccccaacggagtaacaggctctgcctcaacccagaagagagctgaggggaagttatagtggttgacttagagagacccttgggaggtccaatcactcaccaaactttaactcgtgattataagagaggatgctctggggattttgctgctttgtattgttacattaaacatacaagcatttttaaaagctctatgttagaatttaaagatgcctagactatagacacatatgctgtacaattaattcactggaattttttttaagtttaaggccctataagaactagattatcagttataaatattgagaacttttggataggctaccacccctcaaaaatcacgacaggcaaccatacaggtcagtccctcaagaacacctcaagaacctgtccctcaagaacgcctcccaactccagggtaatgctgctgcgagggtatcctcggggaaacacaatggtgaatgtctgctgcaaaacactgagccaatacctaagaggcatgctgaacatttaacaacaatgatactaggaacaagtattagttatttagaaaaagtataaattatttagaacacaaaacaactcttcaggagcttttaaagtaagtgcttccaaaaaaggagtaaatctctggttactactagagatgtactacgtaacacattaaatctgtaaaataatttggcacaaaaagttaaatggacatgaggaaaaaaaccagcctaggttatgataattaattaggaatctaaacagacttatatgcaagatgtaaaaccaaaaccctaactggcagaatagcagtctacttacttacctgttatttccaaagcgcagcaggacacttggcagccttctgtttggttagtattagaccctagtcacaccttaatagttgtttttatagatttcagtacccccacacctttcaatctaacatatgtaaacattctctgaaaaccaaaagtatctaatgttaaatatatagaaatttttggttaaatctctacacctgttaaacagaaagattcctcttcctgatttcttttctccacttttctattctttccttaaaaataatttggtttctttcctaccactaaattattattttgtgaacttaaatgcaatattacaaaggtggccagttttctaagattaggacttaccaattccactttacagtgcttagtacaaaattattggtataattttcaatccttaataatactatgctactaatggtcatgttttcatgtgttataagaaacatgccttttgggaggctgaggcaggagaatggtgtgtgaacccgggagccagagcttgcagtgagctcagattgtgccactgcactccagcctgactccatctcaaaaaaaaaaaaaaaagaaagaaagaaagaaagaaagaaacatgccttccataaaactattcctactaatgttcatgttttataagaaaaaaataaggccaggtgtggtggctcacacctgtaataccaacactttgggaggctgaagtgggcagatcacgaggtcaggagatagagaacagcctggctaacacggcgaaatgctgtctctactaaaaatacaaaaattagctgggcatggtggcgcgcgcctgtagtcccagctacttgggaggctgggagaattgcttgaacctgggagacagagggtgcagtaagccaaggtcacgccactgcactccagcctagtgacagagctagactccatctcaaaaaaaaaaagaaaaagaaaaaaatagtgtttacataatgtataacttctttcagccttggacaaaactatcattgaaacagacgtctgaagtcatccaaacaggccgacaagaatttaaaacttcattatttgcaaattaacaacgaaaaaggtaggcttaaggcagacaattggttactaatgtctccttcaaagggaaaaaatttccagcaccatctactaaaactgttcggatatattccaaaggctagttgtcttttaggatttttcttgggaggggttgttcattttaattgttgcatttaaaatgttcaaaaaataaatgggcttagttggtcaaaacacaaccactcactcaggaaaaacatcatcataaaggtaaaaataactcaaagcatacacccgaagtcattaaaaggtttttcctcagttttctcttataggatgtgagataaatgcagtattattctctattaaagtataaaagacaactcgactcagttgtctaactcacattaaattcctccaaaatggtattttgaagagtatcacaggctcagccacatcaagtttggaattttgtgacacagagtcagatgacagaacactcagtccttcctcacttggaaacaaaaaccaaatgcttgaagagacttaatgtcaaatctaactatgcaaagtcttaagtttacttcaatttcatctcaaagcaatctttaaagaaaaaaaatcaataagccattcaaacaccagaatactacttttctcggaatctttaacaaaacgtcaaacaaattcagactgttggactgttaaacttcaaagagccaccttaatattttgaaaacatcaagaaaaagttgagcaagaaagagaggaaagggagggagagaagaaggaaagaaggatggatggaaagaaggaaggaaggaaaagttttctcaactttaacaaatactattatcaaagctaaggagttttggccttgggaattcagatattacgcataaaacaaggaaataaacctaatgaacaaacattactactatggggtgatgtcaaccttgcaattttggagagagattaatgaagtggggtgaagtataaagagaataattttttcacttcaaatgatgagtaatgaagttcaacatataaacattttttgtttgctcattttttcccaaataactactttacacccacattactgtctcatttgcaaacgtctgcatagtatcttcagcaactatacctagcactgcatttttacatacattaagccagctgcctggatgattttttaaaattgctctttgtttcactgaataactgaggctggtgactctaaaagttagagaaaactttaataagtaacacccagtccaacagtcctcaacagttctgttgtacacaccattcccatgtgccaacatttcctcaaataacagctctccattaccctacagtgcttttctagagaattcttccctacctgctgtggtttgaatgttgtgtcccacccaaaattcacatgctgaaacttctttttttttttttttttttgagatggagttttgctcttattgcataggctgcagtgcagtggcacaatctcagctcactgcaacctccacctcttgggttcaagcaattatcgtgcctcagcctcccgagtagctggggctacagggaggcgccaccatgcctggctaatttttgtatctttagtagagacgggtttcaccatgttggccaggatggtctcgaactactgacctcaggtgatccgcccacctcggcctcccaaagtgctgtgattacaggcgtgagccacctcgcccagcctgcacgttgaaagttaatccctaatatgagagtattaagacgtgtggcctttcaggaagcgattggatcaatgccattataagaagcttctgagagctgcctgccccttcttgctttcacattcccttccaccttctaccacatgaggatgcaccatcaatgaggaatggcacctccccagacactaaatctgccagcaccttgattttggacttctcagactccagaatagtgagaaaataagtttctattattcataagttactgagtctcaggtgttctgtcatagcagcacaaatgactaaaacatcatccatccccgaggaggagattgtccatttctgtgttccaacaccatcaatgacacagggataaaaaactcccacgactaccttctaggataatctattccacttctaagcagctccgccacaaagcctgtccttaacctgctgcaaagtccctatggcttctgcccattgctgttgcccactcagaatgagtctgtgttcattcactcacacagagcccttcacatagctgagagaactaacgttcatcaactgttcttcctaagcaggtcctgagctgcctcaccttcctagtccctcctctaaaatacattccagtttatctgtagcccaaaacagaatacaaaagaataaagtattgtttataatacaaagggtaagtgtttgaggatggacacctctattttacattacgtgattattacacattctatgtctgtatcaaaacatctcacataccccataaatacatacacctctatgtagccacaaaaattaaaataaaaaaaatttttttaataataaattaaaatgttaaagtgattttgatttctgctttatatcgtgtatttctgtgactaggccaaacaggtcatgggtaaatctgctcagttaattagactttgatattgagctcttggtaatcagtcttaatggaacaaaaactactccttcctcagtatgtttccttaaactaaccaataatttcataaaagcagatcatctttcagaaggaaaaactaagggaaatcataggtgggttagcacactccacaatgtaaaggaaacaataaatatacattcccatgcaaaattcaattctctctcttcaaaactaccacagcattttgtgggaccctctagaagagcatttcacctggagtgattcaggcctacctgctcctcagggtctgggccccaccttcatctttctctatgattttacactgtgcctgacagtggtgagcttgcaacttctgtctgaatgaaactgatcaggagtagttctggcagctatttagatagaattggagtctcagcactcattatttatcatactcatcctttaatttaaaagagggccaagaaaaccaaattatttaaagatttcccaatttctgaaaatataatgctgtatcagttgttttttttttaagcagctcaaaaaatagcacatagagcaggtaaaaagggtaggaaaaatttttttctatgcaaaagccttaacatttataaacttcaaccaaatccctataaaaaacatgtagtttttgcactgtgtagtccatatgctaaatggacatgtttagttacatgttttcttgagcagtactttttatttgtagcaaagctattacatcttatacattatattacacgtaaaagtccattttaaaccaaattacttcaaaatttgacctatattacatctggcacagactagctgttctgctatactgtttaaatgcctgctatattcgcagcagttactttataaaacacataatctttatgtgctagcagtaaatttctatacctttaagggataattctaggctaatcaattagtataccaaccttccctatccccgaccccattcattcacttggccctgaccatgctaagcatctgctacatataactcctagtaggaggtacaactatgtagaaacactacaaagttactgtgacagtatttaaaacagatgcactgacagccaaaaaaaaggggaaaaaaatcccatacaaaaattgtgaaaagagttaagatacaaaagaaaaaaataacagtaaaatagcaagcgctcaatataatttatgtcaattttgtaacttttcttatttatacacaagatcaaggaaagaacagaaaatccttttataacaataaaacagtgtaagagacagaagcatcgtaagtcaaagctaaaaaaaagcaaccaattattatatactcattacaaaataatacactgggaaaaggtcgaaactgtaattggctcttataaagtagtaattcaggatatatacagtctatgactgtaaagcacatctttataatacaagtagaacactttcatacagtttccaacagaagggtttattcataagccattactgcagaggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagttaaaattaaccaagactgatagttacatgaagatgtctagttattgggtgttttcccccgctctctggtcctggctgaggcaagcggatcacttgaagtcaggaatttgagggtaaaaccctgtcactactcaaaatataaaaattagccaggtatggtagcacatgcttgtaatcccagctacctgggaggctgaggcaggaggaacacttgaacccaggaggcagaggctgcagtgagcttagatagtgtcactgcactccagcctgggtgacagagtgggactccatcacaaaaaaaaaaaaaaaaaaaaaaaagatggtgtttaaatttttattccaggaacagggttattctttttatattccaatttcaaaagaaaaactctctatatgttctgcatcaagctaataccacaattaaaacgtattcttcacatgatagagaatttaaaataatgatgacacaactagatacttgataatattaaggaattattcattttacatgtgataaacgtattacggcttaaaaagtcatcattttagagatactgaattatttatgaaataatacttgagatttgctataaaacagtgcaatgagggacgcaaaattgtgaacgtgcatgagagcaaagtatagataaaacaagtgggccacgtgttgataattgtgggaaccaagtaacatgatattctctccgtttttccgtatgctcaaatacctccatgataaaaagtaagccaaaaaataaaattatagtaacaaatcagccttctcagagggcataccacagaagcagtagcatcataattagttgttgtaaacacaggtattaaagagcacacagtgactgacagcattatattcatggatgctgctaccctgctgaagaaactgctgcatttgtcagtaccatagaaaggtcaaaaaaaaaaaaaaaagaaaagaaactgctgtatttcagcagcgtgagaggtgattcccatgactaatatccaaaattacatgacattacatccaaaatacattttatatcttagaaatctttctgagaaatcaacaatacttaacaagtatggaatgactataagatcatcaccattagctagatatttccaattcctaaccattcttttcctcaacaacctactccttcaacgagtgctgaagagagaaacaatggtcactggaaattcatcttttaaagttatagatatgaggttttaactcaaaaagaaggaatttcatcaagtattagatcatattcagctactgaaacaaattcatatttcctcgtttcatgttctcaaggcacaaaatactttaccttcatggtactcaggagcatttccttccttccttccttcttcccttccttcctccctccctccctcccttcctccttcccttctttcttctttctctctctctctctctctctcctcctctctttcttttagatggagtctcgctctgtcgccaggctggagtgcagtggcgtgatctcagctcactgaaagctctacctcctgggttcaagcgattctcctgcctcagcctcccaagtagctggaactacaggcatgtgctaccatgcccagttaatttttgaatttttagtagagaaggggtttcaccatgttggccaggatggtcttgattctcttgaccttgtgatccccctgcctcggcctcccagagtgctgggattacaggtgtgagccaccacgcctggccattctttcttttttaaagcaagaatttcatttaatgacctaggtggctttattctgattttcacttttaattatggtagacaaccaaatgatagatctctgaaattttgagacacaacttcttgtgtacaaagagaaatgcagggttctccatcttaagcccctaaagccttcaggagccttcattcacctgtgtaacatagggcctccaccttgatgccagccaacacacacatgtgctaagctgaagcagccatccctggaaccggaaagaatgagaagggaacacaactgtctcaagtttgaggcttccttcttgacaacaatattcacagtacaaaagtactgtgcttagaggagacgtaagtcagataagctgtaacttttcacaaaatgcacaattagtataaagtttaataattttttttcttccagtgtaaattcagtttgtttactgctttgtagttttgaaaagtcaggagttctttttaaattcttgggagctggtctgaatgtagtcaggtcacttttcttatcaaacagcaaaaacttattcgagattacataaaaatgggaaatataaacacatgttacatacagtccgtacactttgagagcatgtcatgccagttggaaaaacctaacagcaacttacaatggtaaatgatgactaccaaatgctctgaataggctgtacgcatgatgggagtaaagtgaagagggggtttaagccatgtgggtttttttgtttgtttaagagacaggatctcactctgtcacccaggccgaagtgcagtggtacaatcatagctcactacagccttaaactcctgggcccaaatgatcctcctaccttatcctgccatacggtagctaggactacaggtgcatgccagcacatcctgctaattgttattgtagaaacaggattgggtctcactgtgttgcccaggctggtctcaaactcctggcctcaaatgatcctcccaccttggccttccgaagtgttgggattacaggcaggagccacagagcccagctgggatttaattttgaaaaacagaggagaggaagagaattccaggcaggaggataaaagcaaaaacatagagatgacaacacacaacatgtgtttcaggcacagtgactagaccaatttggctggggtactttttctcctttgttgtcatctttatttttctacctgggatgtaaacgatgtgaatatgggtcagaaaaatcagctgcacagaaacacctcagccaattgtaagacagagagagggtggacatgcatgaaggggcagtagcaattccagaccagccttctgaaagagcctgtggtccaagccggcaaccagaagggcactctgggtggggcaggcaggaccatgcaatgcaggttcttgggaggaaggatgaggaggagcagtcacagcagatgctgtggctgagctccaacaagtttattggactctgccttcaagctgctgcctgaagaagttgattagcccattggcggaagcatagtgagaggtcacttcaaggcaagcaacaagaaaagactagaaagctaggttggagttagcctggaggccttatataccaagagtttgaatttcagactgaaggcttctgaatgggattaaaatgacaggaaagtaagcagcagtgcacatatacagagatcagagactgatgttcaggacggaatggggaggaagagcctggaggttagttctcaggggatgtttactttagcaatcataaagagtccaggcctggcgcggtggctcacgcctgtaatcccagcactttcggaggccaaggtgggcagatcacgaggtcaggagctcaagaccagcctgaccatcatggtgaaaccccgtctctactaaaaatagaaaaatcagccgggcgtgttggcacgtgcctgtaaccccagctactcaggaggctaaagcaggaaaatcacttgaacccgggagacagaggttgtagtgagccgagatcctgccactgtactccagcctgggcgacagagcaaaactccgtctcaaaaaaaaaaaaagtatacaggaggatgtgtgtagattatatccaaatattacgtcattttatataagggtcttgagcatctatgaattttggatatggaggggtcctggaaccaatcccctgcaaacaccaagggaagactgtacttcatttatgtaagcttccacagtttacaaaggacttttgcttacataatctcattttaccttcagaacaatttgtaaagtagaacatttgctatatttcacaagtgaggaattgctgctccgggcagttccttttatgaccaccattccatgtttcattttatggctctgtctctcaaccagtagactgtaagctccatgagggtatgcagggaccacactgaattttgtttgcctttgtagccctggctgcctcatgaagagccctggtccctgatcccagcagacacatgctcactaaatatgtgacagatgggtgaggagcacatcccctctcccactcttgtttcaatgatactaaaatgctttatcaatcaaaagtgtttgggggctttttgtgtttgttttaaattattgttctgacaattaaaaggctttgacaattttaatacctctacttagcactttctaaacaagacctcttttcccccgctaggtaggaaaaaggaaaaatatacaaaaaaggaatatcaggctgcctgccaccttcaccgttgtatcaaaaagtcactctaagtgatatattagactaaggaccaaaaaaaggtcaatatttgctaattattttttcaaatatcttctatttctttgcagaatggaatgtatgctgaaacaaataaccacacatatgagtacctacagtgccagagttgagaaattctggcctagaacacttgtgccagaaaacaagaaaatgctccaagaataatggagacatgtcaaaaggacaaagcagcagcttgaagggcctcccactggccaagtctgagacaatttaagcatcaatacaaataataaaagattatagctcattgattaaaataaaaaacatgagttcatattgatataaattaataaatcaataaattgaaaatgtgatgaagaatgagatagttaacataatttggaagtacttatccataaaataccaattacaaatggaagaataatttagcagtagaaaaatgcaaaaaattgaaattgtatgtcacctactaggaggcaatgagacataacatcatttctgccatatttctgccaaagatacgcaacctgagtttaatcatgagaaaacatgagacaaacccaaattgaaggacaggctacaaaataactggcttataatttccaacccatcaagaccatgaaagtcaaaagaaggctgagaaagacttggcaactaaaagcaaagcatgtgaatctgaactgaatccttttgcttgccccacccccgcaaaaaaaaaaaaaggcggtggggaaaggagctggaaggtctttattgggactattggtcaaacttgaatggggaatgggggggtgtgaggagtatttgatggtaatataatgtgtcaatgttaatttcctgcttttgatggttatgttgtacttatgtagaagaatgtccttaccattggaaacatacacacactagggtaattccagagtgatggagcatcaggcggacaactccaacggttctggagaagaaaacaagttttctctactgtacttgtaactattctgttttgggctgtttcaaaagttttcaaaaacattttaaatgattagtatctctccaaaatgaaagtaatggatacaatcttaatacatacacacaaattctttccaacaagaatgttctctttgtaaaagtactaaataagtcttccatttggtcactagggaagtagtataaaatagtgttgcataacaaaaaagaaaaaccaggctttccatgtagtaacactgacttcaagctccagttcatcacatacaaatttcatgaccctaggtagacttttttttttttttttgagatagagtctcgctctgtcacccaggctggagtgcagtggcgcgatctaagctcactgcaagctccgcctcccaggtttacttacaccattctcctgcctcagcctcccgagtagctgggactacaaggcacccgccaccacgcccggctaattttttgtatttttagtagagacggggtttcaccgtgttagccaggatggtctccatctcctgacctcatgatgtgcccacctcggcctcccaaagtgctgggattacaggcgtgagccaccgtgcccggccggaagattttgtttacccttctgggtcttgatatcctactctgtaaagtgagaataccagccaggcatggtggctcatgcctgtaatcccaactactcgggaggcttgaggtgggaggatcacttgagcccaggagttggagatcaatctgggcaacatagcaagaccctgtgtctataacaaggaagaaaatgaaaaaagaaaaaacaggaagtgagaataccacttttggctgggcacggtggcttatgcctgtaatcccggcactttgggaggctgaggtgggcagatcacttaaggtcgggagttcaagaccagccaggccaacatggtaaaaccccgtctgtactaaaaataaaaaattagcccagtgcatggtgacatatgcctgtaatctcagctactcgggaggctgaggcaggagaattgcttgaacccgggaggcagagattgcagtgagccgagatcacgccactgcactccagagactccatctcaaaaaataaataaataaataaaagaatccctcactttgaacaacaaaagttgttaatctgctgagaatacaggagaatacaagggtgggaggaaatctggtgctagataatacaatccttcactctttcagtaagtttggtttttaaacacatgaatcacttattcattcaacaaatatttacagttgacccttgaacaacacaggcgtcaggattaccaactgccctcacaggaaaaaatctgcatgtaacttctgactccccaaaactttactaatagcctacagctgaccagaagccttactgataacataaaccgtggattaacatgttttgtatatgtattatacactgtattcttacaataaaataaactagagaaaacaaaatattagaaaaattataaggaagagaaaatatatttactattcactaagtggaatggattatcataaaggttttcatcctcacggtcttcacactgagtaggctgaaaaggaagaggatgggttggtcttgctgtctcaggggttgcagaggcagaagaaaatccacataaagtggacccatgtgatttgccctgtgctgttcaaggtcaactatatttggtttctatactatgctctactatgtagcagctacagagatttaaaacatgatccctttgcctcaagccaataggaaacaagctaaaagcaagcaatcataatgaaaaggaaggatgttttaagtagtaaaggagaaagaaaaaagaaactcaaatggattctctcattctcaacaaacaagcaagtgaaacttctttgggtaaagagagaacaaccagaaagctattctggctcttcagtgctcctactgcaaggagtgcaagggggtgtggtgcaggaagcctgagctacctatcccaggggaggacaaagggagacaaaggcatcaagagagagcagctgggcagtgaccgaacatggctgccaggccaggggaaagtagcacatgggtcctgactgaaccctctgtggggctggtaagccctttctagtccagagatgcttttgggaggaggaggtgagtggcagaaagaaaattatacaagaaattttcttaatgttctttacacaatatacatggggaaaatgcacaagggggtaattgtggagccatgtttcaaagtaagatgacattcacttaatttgtacaaccagaatacagtgtgtttttctgtaatgatgttatttatagcctagtacttgtttgacagtacctgactgagaaagtgacaaacatctctgtatatatagaacttaacttataaaacatgtttaaataaggtaatttgcccaaagcttctccattgaattttaattccacaatatttgttataccatatcaacaaaatgacaccagataaaaaagaccactaagctcagaaacatctatttggtatctgtatcttcggaactgtcttccactcagtatttaccaacacagttaaaaaccagcatatttacaatgcttctttaccagcctgctagcaacttgtctctatctactactgagcacctcctttgttcttggtacttcccaggggatgatggggtggcccaataggaagctcagtcttgccctaaaggattttacagttacagatagaatcactagagaaatttctgaaatgcaaggcttttcaaaattagctgccaaaaaagggagagttaactgtgggtcaaaatagctgcaaacagctttaccaaaagaaaggcataaatttcatcttcaaggacagacagaatcttggaaaggtagaggaaagggtggaaggcattcccagcaggccaagcagcatgcaaagggtaccaaggctggcatcaggctggcatcaggtcggcaaggggcagggtggaaagtatgctcgtgtgtaaggtggcaggagggatcaatctgctggcatagataacgaggccccacagaagagtacatataatacataaaagttctatagtacacaaacagcaccaaacaggaaagacttgaggagtgctacattttatagctgccaagtgacatatactcagttaaagggcagttaggaccagcagcagaccagcaggaaggtgttggactagcccagagatcaaaggctgtgggcttaaagcagagaagcggccatcagaatggtgtcaaaggattgagcctaagagacatttcaaagtaggaaatgacagaaaaatcaaagatgactccaaattctagcatgtgaaaaggaaaataaatactggtgccactgaaaatactgggatagtagttaagaagaactgaggtttgggagtgagggaggtgtaaaagactggtgtgttcaccatgactagtgaactctgtggtaatgagagtggccacccaagtgaagaagtcctggaatcagctacaaaccaggctgttgtcagatgacaaagtagaagaaaggttggattgtaggtttgcaagtcaactggcatgctgaaggtaactactaatcagaaaatctcacggagaaatgaacagagaatgaaggagagaccacaaaaaaagagaggtaggaactaacactttttaagtatctatgtgccagccactacatgagccactttgtataaattaaatacagaaaaaattgagaggtaggaaacctagaaagtttcctctcacaaagaggagtgcaccaatgacaaagccaaacatgaaaggaaattcaagagaataaaggctgagaaaagaaaggacactggccttgccactacaaaggttactggcaccctctgggagagatttccagttgtgtggtggaagccgaggctacgatgtgggtggctgagaagagaaggacagatacaaactgaaggccgtgaataagaagtaggcatttaagtcgctgcgcagcaaatggacaagattcaatggctgctaaaaaggacagaagtgccttgcagtgagtgctcttttttttttttttcccgagacggagtctcgctctgtcgcccaggctggagtgcagtggcgcgatctcagctcactgcaagctccgcctcccggattcacgccattctcctgcctcagcctcccgagtagctgggactacaggcgcccgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccgagtgctcttaatcctttgcttattttagtaataggaaaacactggccaacaaacccaaaagtcaaaggttagggcctacatatcatatgattcaaggtaatgcaattatgggaaaatggaagacacaatttagtttttgcaggctaaatttccatcaccagcaaatctagttcagctataaatataacaaattaacatacactgattggagcatatttcacctgctttatagttgaaaagctaacatctctcaaaactcaatgctaaagagactaataacaaaaatacaaaaaaacccataaaaaattataaatattttatactacctttcccaaaccgtaaaccatattttgaaaaagcatctaaaagaccaatcacaatcatctgaaaatctgctttaggaattgtggagctactggatttgattataatgttggcaaaaacacttgctgcttcaatggaaaatattttcatcaatatttccagtgatgggctctaagttgagatagtacaattcattcatgaaacttgctaagttacaatttatgcactagtttctactcaaaatggtaagggtaatcattcttcaatctttcacctaaagagtaaaactcttctaggtggacaacagggaacaggtaaacttagaattgccaaagaatattacgtcttgagtataactcttagtggtattgtatggctaagttgttcaaaacagaccagaggtgagtttctgctaaattcacttttctatccactgctagctggaatcaacttttttcacattctaggaaatgattactatatttgctcttgccaaaatgctctcaccattttgttactattagataataatccattaatagtaaatttaattacttcaagaaggaacacagtttatttataaagaatctttttttttttttttttttttttttttttttgagatggagtcttgctctgtcacccaggccggagtgcaatggcgcaatctcagctcactgcaacctccgcctcctgggttcaagcgattctcctgtctcagcctcccaagtagctaggattacaggcgcccaccaccacacccagctaatttttgtatttttagtagagatggggtttcaccatgttggtcaggctggtctcgatctcctgatcccaggtaatccgcccatctcagcctcccaaagtgctgggattacaggtgtgagccactgctcccggccaagaatcattttatttaaataaactgccttgcagtcagggaggaagagagctgacacttagtgcttaccgcactaggcaccatgtgatatgatacctcttccatcccaccaccatttgaaatattcccattttaaaggtcaggaaataagagactcaaagaagttatttaacttatcaaatatcacacaactagtaaatgacagccaaatccataacctaagttattctgccaacacaccgagctgcctgccattcaaaaataaaatatttacatgtaaggctttttccaaaatggatttcctcatcttctatcatttcttcttaggcatttcactgaatgtcctaaagcctcaattcaggaaagaattgagatcacttcttagaaagtttttaggtgaggcgcagcggctcatgcctgtaatgccagcactttgggaggctgaggcaggagaatcgcttgagcccaggaggtcaagtttacagtgagccgtgatcacaccactgcactcccgcctgggtgacagagtgagagaccctgtatttaaaaaaaacaaaacaaaacaaaacaaaacaaaacaaaacaaaacaaaacagtttctagaaccaccacccaatgaatcaactaacaagaagaaacctatctgagagcttttactgataacagatcttcataaaaagctctggagaccaacagtagtacatctagtctaccttataaactgtacaactatttttacaatattctttattttcgcaacacaaaatcaggtgtcacagtctctgacaggggtgagtcctaggctctcttgggactagactctaaaggacaggccctcagtgtgtgatggagtgagtgaatgaataaagacacagccagcataaatgttaatacagcagagagaaactatgaatctggaggacccccaaaatgaaagcataaagcaacctccctcaacaaatgtcatttaaaaagccagaatcatgtttgagttatataaaaagtaataggaccgggagcagtggctcatgcctgtaatcccagcactttgggaggctggcacagcagatcgcttgagcccaggagtgggaggccagcctgggtaacatggtgaaacctcgtctctacaaaacttagctgggcatggtggtgtacgcctgtagtcacagctactgaggaggctgagtggaaggatcatttgaactcaggaggcagaggttgcagtgagccaagatcatgccactgcactccagcctgggtgacaggtgagagagaccctgtcccaaggaaaaaaaaaaaaaatcattgtattttaattggcaataccccaattaaagctacaagaatggttatcataaaaaaaaaatagagaataacaagtgctgtcaaggatgtggagaaaccagaaggtaaaatggtataggcaatttgaaaaaacagtttggcagttcttcaaaaagttaaacataagagttaccatagacccagcaattccactcctaggtatatacccaagagaaatgaaaacaaatgttcacacaaaaacttgtatagcaatgttcacagcagcattactgacaacagccaaaatgtacaaacaacccaaatgttcatcaactgatgagtagataaataagatgtgacatagccatatagtagactattatctggtaataaaaacaaatgaaatactgatacacacacaatatggatgaacttcaaaaactttatgctaaattaacaccaggtccaaaagaccacatattatatgatatcatttacacaaaatgtccaccataggcaaatctagagagacagaaagtaaattagtggttgccttaggctgaaaaagcagggaaagggcataactgctaatgggtacaaggttttttttctggaataatgaaaatgttctaaaattagattatcatgatggttacactaccctgtaaatatactgaaaaccaatgaattgtatactttaagtaggtgattttcctcttattttttaaataagaaaaagcttacaattgtttgcttctcatttttcttcttcacacagcaaggcctgcagtagggaagacttatttcatcaagaacagtatactatggtttttctttgatttagaatactgtctttctagcaccctacttttagcagtaaaagaaaataaagttaggaatttctaacatttagaaaataatcattaataaattaaaggacaaagtgaaaaaaaaaaacaaaacccagaactttaagcttacacctctaactccaaagcaggaggaatttgcttggtccagctcagcacaccagacactactacactctctgagctctaataacacttaccatcatagtcttgatcatggattgcggtgcgaacctccagagattgcctcaagccaaagacatgtcaatctagctgaggtcagggtgaacatatatccaactttcaaagcatacaatcaatgtccaaccttcccaatgtggttgtatcaacacacataccacaagcgtgaataacagctccagtggctctacgtactcagtgacagtgggttttaaaattcctgcaaatctagtgagtgtgtaatgacatatccccgtgttttaatttgcatcccccaattaaagtgagacaatgccttttcttatgtttactgaccactggattccctcttttgagaagtgccttctcaagtcattttcctactgggctgtcttccttatttattgatttgaaggaattcctcacatattctgacagttctatgtgattatttattctcccattctgtggctcattttttcactctctttatgtcgtctgttgataatggttttaattttaatgtagtcatatttatcaaccctttcctttacagttagtgctttttgcctcttattttaagaaattcttccccattctgaaaccacaaagatcttcgcttattgttttgcctttcacattggaaatttctattttgattcacattggaaagatccaatttcctttttatttttcccatctgtaaaactgattattgttaactagattcgtctccagtgtctagacttatataaccactaagaaaaataggaacgaatgagatcctccttttgttgaggatctactatgctactatgctgagtactttatatacagtatacaaatatacagtaattctgcaaagtacattattactagtcccatcttaaagaaaatgaaactaaggctaagaaacacacccaagctgttagaagataaagatgggatccatgcctgtctaatctagtgcccataatatttctgcacaccatactactttaggtaagaatgtgatctctggataaaacaggaaatattttcattttgaggatgttgcagtcactttactctccaggtccactagtatagtgacacttattttttatttggcagttcttttattaattcactcaacaggtatttcttgaattcctactacctgctaggtactgttccaggatccagggatgaaatagtgagcaaaacaaaatccctaccctcttgggggtttataggctaatcagatcagaagtgtagtctcccatgtctattctacattaagtcttacacagttagtaaaggaaaccttcctccaacagaagagtgacaggactgcaacatgaagcactctcatggaacaagaaggaacttaaagagcaacttggagaaataccagtactcatatgaaacaaccccacgaaataaagcatcccatgcctcttcccttctcctgcagcttataccttcactcttcaaaaaaagcaatataattaccttaacaaaatgagcatgacttcttgtaaacatctatatacaccttgtgctgtttctaaactcttttccttctctatttaaaaaagatgcttttcagtgtgtggcaagtaacaataaactgctttttcatttctttaatacgaactggaagtctatgcatacttagaaaattgcatacttagaaaattgaagaataggctgggcacggtggctcacgcctgtaatcccagcactttgagaagccgaggcgggtggatcatgaggtcaggagatcgagactatcctggctaacacggtgaacccctgactctactaaaaatacaaaaattacctgggcatggtggcacgggcttgtagtcccagctacttgggaggctgaggcaggagaatcacttgaaccaggggaggtggaggttgcagtgagccgagatcgcatcactgcactccagcctgggcgacagagcaagactccatctcgaaaacaaaacaaaaagaaaaaaaagaaaaagaaaattgaagaatgcaagaagcaggcaagaaaaaaagttagttctgcagtacaatatgaaggccaagaacttcctttattttcccaccacctgcctggatctgttttcatccttcagagaaaggaaaatcccttccctgaagctctagacaccaccctgttcccatatttactctgtaacctagaaccttcagttagaccccatgttctacacccctatctaccataacagtcccataagatcagcacacaaacaggctctcatgttgctatctcaatagtaaaagaaaacccctttgtgccctccaagcacttctccatttctctgcttcctcctcacagcaagccgtctcatctcagaggcttgccttcatatggcatttcctcatttcctccccagtctggctacagcctcacctaactcactggtactgctcttgtccaggtcaccaatgaccttccaattgctaaatccaatggtttgctctcttatcttaccagatcccctccattctacacagtaaactgccacttctcagaggattttcttctctcaggtactgtgacactactctcctggttttccttcttcctctttagccaatcctgtctcctttgctgcctcctccagaatcacaagctctaaagcttggaattccttggggtttggtgctgtgttctcttctttttttcccatccacactggaattctcttcctaggtgatgtcatgcaaactcatggctataaatattatcgatactcatacctgtaatcccagcattttgggaggctgaggtggaagtattgcttgagcccaggagcttgagaccagcctggacaacacagtgagacttcgtttctacagaaaaaaatttttttaattaactggatgtggtggcctgtatctgtagccccagctactggggaggctgaggtgggaggatcacgtgagtccagaaggtccagagggctgcagtgagctatgattgtatcactgcactccagcctgggcaacagagaaagaccttgtctcaaaaaacaaacaaaaaaaagcacacgcatgtgcatgtgtgtgtgtgaaatcaatgattaagaggactcagtcactggtgtgtgtgtgtgtggggggggtatatgtgtgaaatcaatgattaggactcactcactgagctccagactcacatatccaactactcatttggaatttccattttaatgttacatgggcaaccaaaactttttccttctcaacccaactctccccaggtttccccatctcaatattacaggaccaacctagtcaaaaacttagaaaccactgttgatggcttcctcatcctcaccctgtccatgagcaagtcctattgagtctagccaccatgaattttgaaatcaaacacttctctccatttttcactgtcatcatcctagtccatgccacctagactattgcagcgacctccaaactgtctccctttccgcatttggaagtccattctccatagagcatacaggcattttttaaaacacaaagcaaatcatgacacaaacctacttaaaacctttcagtaactgactaaatagtaaaatcaaaactccttactgggatatacgaggccctgcaagatctggtgtccccacttaccacttcggcttctttccattcacactcccactgttggttcctagttcaccacagactccaatctcagggcctctgcaggtgctctacccctcacccagccttctctacacgtgactgcttcttgccttccacagcttagtctaaaaccagtacataaagatttttttttttcttgccgtggccagtgagtaccaagaaaaaaaaaagtaggccgggcgtgatgtaatcccagcactttgggaggccgaggcaggcggatcacctaaggtcaggagttcaagaccagtctggccaacatggtgaaaccccgtctctactaaaaacacaaaaattggccaggcatggtggtgcatgcctgtaatcccagctactcaggaggctgagacaggggaaatcgcttgaacctgggaggcggaggttgcagcgagccaagatcacaccactgcactcccgcctgggtgacagaatgagactccatctcaaaacaaacaaacaaagaaaaaacaaaaataaagaaaaagaaaaaaaggaaaaaagagacttttcactctattgaacacatccccatcttattttctaatacatcagtcagatttcctgctagcatttatcacaattactagattttacttatttccttactggtttattatctccctaccttcctgcaatacaagctgttgtcttttttgggtagtatattaaagccgatacatgtttgtagaatgaatggcagaaaaacaagtcgaggatggaagaaggagggagaaggggaaaccaagaacagagaacacatttccaatctatacccaggcttccacccagagttttgtaatacaggtttttccatactaagtaaaagtagaggccgggtacggtggttcacgcctgtcatcccagcactttgggaggcttaggcgggcggatcacctgaggtcaggaggttgagaccagcctggccaacatggagaaaccttgtctctactaaaaatacaaaaaattagccaggcatggtggtgcgtccctgtaatcctagctacatgagaggccgaggcaggagaattgcttgaacccaggaagcagaggttgcagtgagctgagatcgcgccactgcactccagcctgggcaacaagagtgagactccgtctcaaaaaaagaaaaaagaaagtagaggtcccctattggctacgttgagcctaacagtgatatataataaacttaatctattcgtaaaggacatctctaacaacaatcttttttacactcagtacatttctaacgaaagaccaaattcaattatcacttctctacaactagtcttgggagtaactagtatgtacctaaatttgctgaagtaaatctggagacaattttgcttaaaacctgatgtcaaggagtggaaaaggtaatatgaaactcaaatgctttatgcctaccctcattagaaaatgtctctaggaaagcaaaatgttaaagctgggtgatgtgtaaactggggatgtattatattatctctacttctgtgttatgtttaaatttttccataataaagagttaaataaataaaagtaaatgcctctatgaagtcaaaagacaacaagtatccatgggtcacagacatactcctggctcaagtgcactctgttgccatttggagatttaatttaaatcagttgatggttgctaacagtgtctccataagtcttatgacctaaggccttcatcagggcctttttgggagaatcggaagacacaaggaagcaggagtcccctttcacctgctctgtgtcacagccttccagccccagcaccaccaacccagcccctttctatgggagtttccaataaccacagctcaaaaacagcaaccgcagggagaaataaaatcatttacaaggggaaaagagaaaaagcacgcagaaggggaaaatattaatacattatttttgcttaaattcaaaccaaccattttcccctagaattctgatgaggtaatatttcttctaaagcagcacttcaaattcaggaagggattcatagaagactaaatgcaaaaagagcagaggccagcaaccccacccaataaagtttcttctctcaaagattcctcaccgctctctagaattcgtctatggcattaaataaaaagtggttaagaggtgaaaattaaggcctcacttactaggtgaaacaaagaacagaagaatctaagctactctagcaggtgtttgttttctactgtagaaacagcctagctggactgggtgcggtggttcacacctgtaatcccagtgatttgggaggccaaggtgggcagatcacttgagcccaggagttggagaccaaactgggcaacatggtgaaaccccatctctagtaaaaacacaaaaattagctgaacatggtggcatgcgcctgcagtcccagctactcgggaggctgagacaggagaactgcttgggcccaggaggtagacgctgcagtcagccatgatcacaccactgcactccagcctgggcgacagggtgaggtgctgtctcaaaaaaaaaaaaaaaaaaaaaaagcaaacataagaccctgtttctataaaaaacaaacaaacaaataaataaaccagaatgaagaagcaaaatacactatagacatacagtggaatattattcagtctttaaaatgaaggcgattctgacacgtgttacaatgtggatgaacctggatgatactatgctaagtgaaataagccagtcagtcacaaaaagacaaatacatgactccacttctatgaggtacctaaagtagtaaatttcatagaactgaaaaacagaatgctggttacctggagcggggtggagcgggaaatgggaagttattatttaatgtgtatggagtttaagttttacaagatgaaaagagtgatggagacggactgtggtaatggttgcacaacactatgaacatagtcataccactgaactgtatacttaaaagcagttaagatggtaagctttatgaatgcatttaataccactaaactatacacttaaaaatggttaagatgctaaattttattttgccacaataaaaaatttaaaaaagtcatccctaataaatagcttattaataacttcatatcataaatcatgtagttaccaagtatgtttagattttggtgtccttgttcataaagtgagaagaggaaaaaaagaggagcaacccgacctttaaatgacagcagggtcctgagtaacagatgactctaatcagatcaggagaggtcaatgtgatcctttatgtgacagagatctaatctgggacatggttgggcctaaacacagatttactgaactcaaggaaatgaacacttaatcacactaagagatcagggccacagtgaagatatgtttcctgtcttgttccatttctagaggctgagttcagttttgtggttcaacacatggatatgactaggctaaactgggatttaattcttagctttcttatatttcagtcatggtctaagatctcactctgtgttattatttggtggcacaacccaaactactcagtttaatttgttctacatctaaatttatctccatacatgaattaaataaataccatctgtgctggatagtgtatgctggtacttagtcccacatctacccttccagactctccctgcatcatcaggcctgaaatctacatttccaaaccccccgtcagctgtgctcccattaggctctggcagcagcactggcaggagtacaggttcctgcttggttgcagcgaactccagtagcatcagtgagaaatgcgggtttgtgggctctggtttgtaggcaccttctcccttttgttcctacagccctttctttttgtaaacaattcctagaattacatccctcttgaatgaaacacctggagtggtttcctgactagacactcgctaatagccctccaaattcaaaatttatataactcatgggccagggtagggagctatgctatgaaatactcattcatccattcattcaacaaattcttagtgagcaactactatggaccagatgctgttctaggtactgcagatatagtaggaaacaacacagacaaaaatccttgtcctcaaggagcttacattctagtgaaggagaggcaatactcaggataaataaataaaacacatagtgtgtaacacaagtgctaaggagaaaaaaaattaatcaggggcagggatatgaaatgttggagaagggttgaaattttagatacgtcaactgtctgcgtgtcacagtcgggtggtgtgcttgcttccaagtctggaggtgggtggttagagcctgttctatgaaattttagatacgcaggtcactgagatgattttgggggaaaaaaccccaaagaggtaagggagctagttactcacataactgtaggaagagcattccaggcgagggaagatatgtccaagagtcctaaggaggaagtctccttggcatgttcctatgtggaacagaacaggcaatggcgaggatatctgagagatggggagggccggccatgagagccttgttggctatgataaaggctttagccactgcagtaaattctgagcagagtaacatcatctgactcacttgctaacagggtcgttgtgtgtcaacaacagactgcaaggggcaaagggagaagtaacagggaagacagctaagaggctcccgaaataatccaagtcaaactgaatgatcgctgggaccaatgtgctagcactacttagagggtgctaagcaaattctgaatatattttgaactcccatctgggccttaaaaagtcaggggccggtccaacaatctcgctggaaatcatacaacagaaacttcgaagggactcctaccaggtgtaagaatataacgaatattatagaattatttaattatctttgtctaaagccattatattgtttatgttttgatatttaaccaaatataagaatataaaggctttggccattatatataagaatataaagtatacaatgactttagccaaaaataaataattgcaaattaacattctccaatagttattataggggaaaactaatttataacatgccaggttataaaacttttaatatttttatataagtattatagaaacagtacagaaatatgtaagtacctattaatccagtttttattaaactggtcaagttacagaaaaaacatgaccttcttaactgtattttcaagaggataattatcaaaatgtaaattttctagacagccaatgaagaaagaaatttagaactagaaaaaatctgggagtcccattcccttcatttttggactaaggtaacaaagcccagatatataaatgaagcctggtcattcttcaagcatcaaaacatatttcaggctgggtgcagtggctcacgcctgtatcctaacactttgggaggctgaggtggagggatcactttaattcaggaatttgagaccagcctgggcaatgttgggagactttgtctctacaaaaaattttaaaaatttaaaaattagccaggcatggtggcacacgcttatggtcccagctacttgggaagctgaggtgagaggtcacttgcgcccaggaggtagatgattcagtgagccatgattgtgccactgcactccagcctgggtgacagagtgaaccccgtcttaaaaaaagaaaaaaaaagaaattcaacactgtgatggaaatatttctagaatatatttttacttccctatcttcttaaaacagagactcctaaacatacttcatctttgccttggtaactctagcctctctaaagagcaactatacccagcccaggtgtgatgctggactttgctgactgctgcctccactatgcagccctaacaatctctactcatcttgctcccagctgatggtgtctgatctacacggaaggctggaaaacagttaagaaccatacatcagctttggtgcgggagctttataacaattattgtcagcacttgaaaactgattttgctttctctcagtgttgggctgtgttttgaagagctaatattgcgtgcaaatggatgggttaagtgatgtaagcacattgcttcagaaaaagttctacccccaaatgcaactgatcactttacagaaagtgtagttttaaattattaaaagcaaaattaattatctgaaaaaatattaacaccataaacatcactacatgaaaacacaaactgccacagtaatgcttatgtctcaagtaacagcttacaagtatcaacagtaaagtaataagctgtaataaaaaggcacttcatctcttcaaaacctgctatcccaccaaaattctccagtaagttaacatgaactaaatttttggtccctttcctagcattctaccaaaatcagtttaatttttaaaataataaaaatattttattgtactagaaaggaaagattctaaaaacacacaaaaccataagtcaagacagcaaacgactcacacgtagccactcagtgaggacagtaagtcttccttagcaattaaagagcaaatagaggaactcaacagagaatacaaagtaaaaaggctgaggccctttaaggatagctggaattcctaccaagctgcatgttcatggccacaagttaacagagtttaccctccctccctgtgcccccacagctgctcactgcagttacaggtaggtccctgtggggctgcctacagtcctagatataacagcccagagatctgtgtggttggttcttagccgcactctcaaaaaggaagagctggcaagaacctcaacaaaattaaataatagcttaagaaggaggcagcgctaaagataaaggtttgagaagggattttttttcttcctttagagacagggttttgccctgtccctggagaggctggagtaagatggtgcaatcacggcttactgcagcctcgacctcctgggttcagcctcccaagtagctaagactacacaatcgtgccaccgcacctggctaatttttcaattttttgtagagatggggtctcgctaggttgcccaggctggtctcaaactcctcgtctcaactaatcctccctccttggcctcccaaagtgctaggattataggcatgacccaccatgcccaacagggaagggaattcaaaagaaaatttcagggttactttcttattttacactagatgtttcctctattaagacctgaaatttttagcttattaaaaattcttacactaataatacaatatagaagtattcacaaatcactaactcactgccatttactcctacaaaaaatcctttctcaaaacaaaactctacaaatgttagcccattcccccacccccgttaaaacaccttccatagtagacgctttacacttttttgacaacacttaaacacaagttctgtatcatttcctatcctgattataagcttctctaggccagggaacttactcaattttgcattccctaaacccctggcaccactgcttcatgtcacagctacttagtgtctgctaaatgaattactatggtatcagatcatggcacctccagttcactaatgagaaaattcaactttttaacacagcaataacatttctgcctccaggaatactgtcattttcacaggagaaggaaattcagtgattcagtgcctaccatctgccccagaggtcagctatttctgacaagtcctagtgtgcacatgggccaatcaggctgcagctgccttttttcacaggcatggatggaagaatgagaaaggtcactaaagcagagtccgtatgtaaattcgttaggcatcatccacaggaaatttgcttcctcttaaaatcctgtgaaattaaaacatgcctttaagccattgtttcttccccctgttctttaacccatttatgctggaggttgcaaatttttttgtgtgaaaactcagaccttggtgatgaccttgagcactatgatataaataactcccacaagcttagcgttccagtaatggaacagtaggcataaatgggttaaactttggatagtccaacttgccaggttaccccattgtttacaaagcctttcacagtacaaaaaacttgattaaccctaattgcctgctgacgtctacggttgtttctttttctcagaccactctttttgagacagggtcttgctctgtcatccagggtggagtgcagtggctcgaacacagctcacttggaggcagattcaagtgatcttcctgcctcaaccacctgagtagctgagactacaggtgcacaccaccacactcaactaatttttgtattttttgtagagacagggttttgtcatgttgcccatgctggtctcgaactcctgggctcaagcaatccacctgccttggcctcccaaaatgctgggattacaggcatgagccaccatgcctcgctttcagaccacttcttgaagtcaccttagttccataaaacttgtgtgttgacatacagtgtgatactgtttctttgccacaaattcaactctacaagtcacatctctttgtctgccttcatgggtcaaaactacttactagctgggcatggtggcacatgcttgtaccactagtcccagctactcgggaggctgagatgggaaaacagcttgagtccaggagttggaggctgtaatgtgctatcatgatcatacctgtgtatggtcactgcattccagtctgggtgacatagcaagaccccatcttaaaaaaaaattacctgctagaacacagaataaatggcagaaagaaggccatagcagagcaaacacaactcagaaacgcccagtctagcactcgtggctgggaacccttgcagggaagtgcacaagtactctcagaggggacctgcctgcctgtcactggcttggtgtgaacactctctgagcaagtcacaagagttatgggctaggccgggcgcggtagctcatgcctataatcccagcactttgggaggccaagacaggcagatcacaaggtcaggagcttgagaagatcctgactaacacggtgaaaccccgtctcttctaaaaatacaaaaaaattagccaggcatggtggcgggcgcctgtagtcccagctactcgggaggctgaggcaggagaatggcatgaacccgggaggcggagcttgcagtgagccgagatgcaccactgcactccagcctgggcgacagagcgagactccgtctcaaaaaaaaaaaaaaaaaaaaaaagtcatgggctagaaatgtactaccatgggggagaaaaagaatagactaccacaaattgtcacactttttaggaaaatattttacagaaaatggcagtatgcagagcgttattgaagggttataaatatattctctgaggggtattctgaagttcttttaatgaaggataataactaagagcttgggctacaaaggcatatacaacactgtaagattcaactacagaatgcttcaagattccaaactcagtttctttagaaattctgcgccagaacaggagcagcatttttaaaattccttaccaagtagcccaggtaaaaaccaacttttaaaaacttagctatatttctgccaatgtacaaaagaataccacccaaatacagaaattgatacaatttgttaatccttgctgctgcaattttctcaaaacgaaaatacaaaagcaaagtatctgaattcataacaagcagcatacattcaggccttaggcttcaaaagcatggtcaacacctcagtagtctgaagacatcttcagatgctttagtctcccaagactcagctggggattctgcctatgccatcccctctgcaacatgtggtgggtggagggtggggagaatgggggtggtagaaggcctctccacgactctctacctccaactcctcttactccactgcacccagttcctctacccttggcatcttgggggcagggaggctggagaacagtctacccccacaaatacactaacttagaaaaaaaaacacttttaagtgtttagtattagaaatactaacttagaaaaaaaaaccagtttaaatattagaaaacttttcttaatccaagcaaattcaattatcattagtctatggtactgtttgcagcagcaaaaaaaaacccaaaatataaataaatatggaaacaaataaatatggtgcatccatgcaataaactactaggcaaccattaaaagaatgcagcagatctatgtgtacttggatatatccaagatattttcagtgaaaagagcgaagtgcaaaacaatgtctaaaatatatcaccatttgagtttttttaatatggatgcggaaatatatgatttacacacatagaatgtttctataaaaatacaaaagaaactgggaataatagtggcctacagaagggactgaggaactaggggtttcagtaaaaaggaatacactcttttttgatattcaaaaaaaaattttactatgtatgtgtatccctgtttaaaatgttttaaaggcgtacttaagtctgtgatgatgattttaaaaaataaagcaacagaagaaaaagtaatgcctattaaaagcaatctcatttttcttaactatttctaaagtctttgtggcacaatttgaattcagtaaaacaggggagactggagggattgggagtttggagaggtccctttcaccctcctcctttaaaattacagtaactttcaactggccataatgcaaaaaaaaaaaaaaaaaaaaaaatctacttgcttctccaacaaaaatatttggctccattgtaaccaacatttaaaagatacaaatacattagcaagtctgtgactaaagttcaattacattttatatgctaatatgaaatgctaatcatattttttatgagtcaacagttttacataagattattttgtttctaaactaacaactttagaattactgaagcatccaaattacctaaactcactccagtcaagcatcagttcagtaaaaaactaaagggttttcccccatagcttcaaaattcccaatcttctccatttccaagcatgatgcggggcaggggcaagggagatggcaggcaaagcctaagcctgtccaaccctcttcagactctgtagatggctcctcctggtttcagggatcccaactcctcatatagatacagccatcatcagcaatcccacattaagtgcattgattccattaacaacagtgggaggcaagtggctccactggcttggattctgaagctcaacctgtggcccatgcacctgcgaataacaacaggctctctcatcagtcacacagggcaaaggaagtggagctgccccaccccacacccacacagaaccagactgctgattgcctctttgtaactactgccacaaaaagtaaagcaaatgccctgcaattggatttttactaatggaaatgcatttgtcgagaatccaaagatgctcagttatctcggaaaaaaagttataacatgatcttcaaaaatgaagatgaggaaaggcattttgccaacttaaaacattcatcaaaatagatatttaaagcagcaaaatatgacaaaatactagtttctcattttttaaaaacctgaacattcagaactaaaactataacactgtaaaaaaaaaaaagtgtccagggataggaaaaaaatatttcttaatcatgtataaattggttatttattcatacctccatttacatacacatatttgccaggtgctcagtaccaggatgccatggtgattaaaagacagacacagtccctaccttcagagcttacaatagtaaatgaacacaaggaataatgcattggtgtatagtttatctctcccacaagggacaattaggaaaaacatcctgggagtaggttcacaggttttaatattctctatagagtggctttaaagcattttatgataaattaaaattaaaatattaaaatgagctaaaaatagaatatttcttatagtgaaaagtgtcactaagaaaatcaatggtgagaaaaaagtgcctctggaatggaggtaaggatgtctagggaaggctttgctgagctgaaccctccatgatcaaaaggaactaaatgtaacaaacttgatgtccagccagctggatacaatggctcatgcctgtaatcccagcactttcagagcccaaggcgagtggaatgtttgaggtcaggggttcaagaccagcctggacaacatggcaaaaccctatctctactaaaaatataaaaggtagctgagcatggtggtacatgcctatggttccagctacttgggaggctgatgtgggaggatctcttgagcccaggaggcggaggctgcagtgagccgggatcacacccctgcactccagcctgggtgacagagcgagaccctgtctcagaaaaataaaaataaataaaaattgatatccttgggatggacagaagacccatatgggaaagcaagtggaaaagtggtagaggtgggcagggaacaagaaacaaagtattgtaggccacacaagaagtttggattttattctaattacgatggaaagccactggcagcctctaagcctggaaatgacaagatgagatctcattaaacataatcatttcttgtttagaacataatacattttcaaataggaataacattataagtggatatgttgcagtattgcttccatgcattcattcagctataatttatttagtgtctactctgtgctaggttgtgtgcaaggtactaactaggaataaaacagcatctctgaccttgagttcacagtttagtagagatgagaaacactgaacaaacaatcacaattgtaatatttacaacagtggaatatgtggaatgctgtgagtgcccagagcaaagggtggttaatgcaacctgagggagtccaggagggaaggcttcacagaagccctgggccttaaaggacaaacagggatttctttagcagaacattccccccacacctaagcctctgatagaatacaagaaaatttggggcctaccaaagactctgccttttgaagtatttatgggccaggtgcaagagctcatgcctataatcccagtgctctgggaagctgaggtaggaggatcgtttgaggccaggagtttgagaccagcctgggcaacagagcaagaccctgcttctacaaaattttttaataaaatttgcttttttttttttgagatggagtcttgctctgtcgcccaggctggagtgcagtggcgcaatctcggctcactgcagtctccgcctcccaggttccggcaattctcctgcctcagcctcccaagtagctgggattacaggcacacatcaccacgcccagctaacttttgtatttttagtagagacggggtttcaccatgttggccaggctggtctcaaatgcctgacctcaagtgatccacccgcctcggcctcccaaagtgctgggactgcaggtgtgagccgccgcgcccggcccaacatttttttaatactaactttttttgcagccatttttacccccctcaactacaagcttttatcaaaattttgaaagagattttgaaaaaattccaaatactctctacttagattcaaaaattttaaatttcctaattatctttctatatacacaaagatttatacacacacacgtattttatgagccatctgaaaatgctgaggatatcatacctcaccctctaaactcttcagcttgcatctcccaagaataagcacattctcctttatgtataactacaatgccattatcacaccaaaaaagacaaaaaaaaaaaaaaaatcaccctggcgcagtggctcacgcctgtaatcccagcagtttgagaggccaaggcaggcgggtcacctgaggtcaggagctcgagaccagcctgatcaacatggagaaaccctgtctctactaaaaataaaaaaattagcggggtgtggtggcgcatgcctgtaatcccagctacttgggaggctgaggcaggagaactgcttgaacccaggaggcggaggttgcggtgagccgagatggcgccattgcactccagcctgggcaacaagagcaaaactctgtctccaaaaaaaaaaaaaaaaaaaaaaaaatcaacaattccttaatatcatctattatcaggtacttctttttaaatacaaaggactttgttgaaattttattgaaggaatgtgttttaataaactggttagatttattacttgcattgcattttgacatttttaaaatgtaataatactttataaaatttaagttaaggaatctttccttggcaagattcatcactggcacgggcatggtagctcatgcgtataatcccaacactgtgggaggcccaggcgggcagatcacttgaggtcaggagtttgagaccagcctgaccaacatggtgaaatcccatctctactaaaaatacaaaaattagctgggtgtggtggtgcgtgcctgtctataatcccagttgctcaggaggctgaggcaggagaatcacttgaaccaggaggcggaggttgcagtgagccaagatcgcaccactgtactccagcctgggtgacaacagtctgtttcaaaaaataaataaattaattaattaaaaataaatttaaaaaataaataaaaattaaaaacatattaaaagaataattgtgggccaggcatagtggctcatgcctataaacccagcattttgggaggctgaggcgggcagatcacttgagatcacgagttcgagaccagcttggccaacacggagaaacccccatcgctactaaaaatataaaaaattagccaggcgtggtggcacgtgcctgtaatcccagctacttgggaggctgaggcaggaaaactgcttgaaccctggaggcagaggctgcaatgagccaagatcgagccactgcactccagtctgggcgacagagcgagactctgtctcaaaataatgataataataattttggtaatcaaatataccaaaaagtgtgacagcggtccatgtgagactgacattttgggagcactgccttagcagaacaacaccctaagcggatggaacatggcaggaaaggatttacaggagagtgggttggtgaggctgcagaggccatgagagaagggaataagctggacaaatggactgggcctgagtgcttcaaggattccgcatgccttcctgaggagtttggactttacccggccaaatgtgggattttatgtgactaaaatcaagtttgtttagaaagctctacttggcctcagtgcttcaaggattccgcatgccttcctgaggagtttggactttacccggccaaatgtgggattttatgtgactaaaatcaagtttgtttagaaagctctacttggcctcagtgtagctggatggatgggagaggtggggaaggtagggagaccatttggaagcaacagaacaaggtttgtatttttcactgctaatatgtaacattttagttttatgggttgaataagcctactacattgataaatgaacaaaacaaaaacagtaaaactaaacaaagtttatcttgaaaatgttcatgttggtagaatagcaactttcaaaagagtcagcagagacttaagtaaattttttttaaatggagtctcactctgttgcccaggctggagtgcagtggtgccatctcatctcactgaaacccccacttgccaggttcaagtgattctcctgcctcagcctccccagtagctgggattacaggcacatgtcaccacgcccagctaattttttattaaaattgatggggtttcactattttggccaggctggtctcaaactcctggcctcaagtgatccgcccacctcagcctcccaaaatactgggattacaggcgtgagcaaccgcacccggccagagacgtaagtaaattttgaaaggagcccttcagcatttttgacagtctcagcatttgatgaagctctttttaatatctagtttcactttccaaggtgtctttccttttccttggcaaggttcatcactggcactagttttacatttatcagtcacaatcaaaatttaaatttccaaaggaaggaagtggggtacagaatagataaaatggtttaaaacatagagcatgccctcaaagcagtgctgacagcaactctgaggagctccatttatgcagaatccactgggaaggctgccccaagagccagccgccagtcctgcctgggaggagagggaagcagagaatgtccagctatcctgccgtgggacaggatgctggcccttcacccctactccactaggaggactctcattttattttacttatcgggcttcctagaaagatttcatttgaacaaagggttccacaactttaaaaacacttgaaaaccaaggagtcagaactgtacgttctaactccaaggctggcaattgaagaataagacctcaagtcccacaggaaagctcccagtggacaaaacaaacaccatcgctgaggagcaatgtaaagaaagagacctgggcaaacaggcccactagaggactggcgtctttggggtagaaggagaaattctattttggacctgtggattctgagatgccagtgtggcacccaacttggaagcccaacgggcagggatgtaggggtcttagaggagcacaggagctagacaaactctaaatgtggacaacttcattgagagagatgtaaatagaaagaagggaaggtcttaaaaggttacagaaggcaaagacagaaaggtctgcctcaagacaggtctttctggagaacctgaattctcctccaaggtagtctatatccaggagcagagagaggcactggctggaaggctgcaggtggcttacggggccacagaagggaaagagggaaagaacaaagtggattggctagggagcagctcaaagattagacagtgggtccaggcctgatggggctgggactctgggagaaaatgaaggtcacaatgagataaaagacgaggcatagggagaacagggaatcctctgaaggaggctgtagagaacccaacatttcaccagcacactattccggaaagcactcctgtcagacaaagtcaatagaaagccaaaaacaggagtaaaagtcaatggctaggagaggagctagggtgagggcagttgtgtcttaccgccctgactggctgcgggatcatgcagccctcctcaagcacttgctgcagaaaaggaagactctccctagaaggggaggccagaagagaccacccagccctctgcttcccttgtcatagccattcctgagaatggagcctgacaacaaagaaagtcatttgaagctcttctctgttgattgaggagcccaattgaatacttacaggaaaactgggtacagataatgcctaggagaagatctaagcctgtttcccaatttgcatatggtgttattcatattaacgataaagaaaactacgtatttttaagtgcaactataacttgattgaggactggaaagccaacattaaaagagaaataaaattaaattaatattaattacattaagagatcaagggattcagatgttttaataccatcataaacacctataacaacaataatacacccgaagtttctcaaatttctatctttagctagaccacccaaccctgctcattttgctcaatgataaaaatgaaaaccaggctgggcatagtggctcatgcctgtaatcccagcactttgggaagctgaggctagagaatcacttgaggccagaagttttgagaccaggttggacaacactgagagaccccatctctacaaaaaatgttttaaaggcccggcgcagtggctcacacctgtaatctcagcactttaggaggccaaggcggatggatcgcctgaggtcaggggttcaagaccagcctggccaacatgatgaaaccctgtctctaccaaaaaatacaaaaaattagccaggcatggtggcaggcacctgtaatcccagctactcgggaggctgaggtagtagaatcacttgaaaccaggaggcggaggtggccaagattgcaccgctgcactccagcctgggcaacaagagcaaaactttgtctcaaaaaaaaaatgttttaaaaaattagccaggtgctggggcatgcacctgtagtcctagctactcaggaggctgaggcaggagaagtgcttgagcccaggcactccagtttagacaactgtctcctaccctgtatctcctcccctaaccattgacttttactaccgtggctctatgctctattagacaacatcatgccaaagaaactgatactttctcagaaaagccttactaactctaggaaacaactaaccattcttaagaattgaatagtaacacaacgcacaataaaaatcaggcttcatgacatttactgtctattcttcaatggtttccagaaagtcaaaaacatccttgccatgaagaaaggacagtaattaagagatggcctccccccggtaacaaacagtattaggaaactcatcccacatttactacattaatacagccattaaaaataataatggaggaaaatataactctttaaccattctgaaagtacatacctgctcaactctctattacccttaactgtcaaacctgctttctctccaaccaggattggacatctatatttcacaaatacagaattaaagtgatacagcaaatctaaaatacaaagcattaattaggtggtatcattattatgtaagtcattaagcctttttaaacacgtactagttttctatcaatacagaaacaagagtgaaatatggcaaaacctcaactaaccagaacagctggggattgagtcactgaatatgcctttcagataggtgaaggcttatttacaattctgaacacacatatttttttggttaactgttctggacgacatgctttgacacaggcccacaccacgaatgtcagtgatcacacagtaagatggcatcctgagacccaaaaggccttactccttactcaatgttaccctggactcctgcaacctttgcttttatgttctccttgtcttccaccctgctgtcacaatctgctctgtttcttttgttcgaataagcaagtgtgcccaaactgtatctaaggacaaggtacctggttctctaggctctgctgggcacatacggagttcttccaagggaggtaaacaaatcctagcaaacagtattctgtgacctgacctccactttacctgctgtggaagtctttcaaataatttacttcctcaaaaaaaattctgacacatgctacaacatggatgaaccttaaagacattatgttaagtgaattaaggcaatcacaaaaggataaatactgtatgattccacttagatgaagtacctagaatagtcaaaatcataaagacagaaagtagaacagtggttgtctagggtgggaggaggggagttggggaatccctgtttcatgggtacagagttccagtctgggaagattaaaaaagttctagagatggatggtggtaatggttacacaacaatgtcaatgtacttaatgccactgacctgtacgtgtaaaagtggttaaaatggtacaattcatgctatatgtatataacttaccacaaccatacgtttacagagtctctctctgttgcccaagctggagtgcagtgatgtcatctcagctcactgcaacccccacctcctgggttcaagcaattctcctgcctcagcttcccaagcagctgggactacaggtgtccgccaccacacctggctaattttggtatactttttttttatttgatttcatttaagttccaggatacatgtgcaggatgcgcaggtttgttacatataaacatttttaataataaaaatttatatcctcattatatatcactatgttctagacaggcaatatgctaagtgcattggtgtgatcaccatctaaccactccaagagggttattttatgacgcaagtcaaaatgagaccaaaaggtatcttaaagttacaattcaaaattaccatatactatttttaacacagaaaaagcatattttagaagaaccgatccttaagaaagaacactagaaaaaactgagagacaggaaagcactctagtctggggagcaaattaatgtgaacagaaatgaagaaccagtggcagcccatgggcagccttactactgagcaaatattccatagtagccacctcaaatgcttttttaaaaactcttcagggtataaaaaataataatttggaattcaaatctgagtacttgttggctaacactttaaattgaatatcagcaagaaaaactcctgaggcattttagtaattgctaaatttctcatcccagctcatgttgtcattccaaatgtgtgactgtcccacactttcaactgccaacaaaccaccttccaactctcatctaagatcctctccaaataccatctcagacagaacccaagtttcccagataaacagatactgacacttaacaaccctatctgccccacatcagtttaataattaacctttctctagactaagcaaaaacatcaaaaaagaaccaatgcaccagaccagtatgccagttaaaaaaaaaaaaaaagacccaatgcacacagtactgtgcatcatgttggaaatatcaccttatagcctctctctgcatagtgacatgcttggctcactgaagttactcaactgttcaaaccacagagttcaacaggtacttaacacatcatttaacacacaatatacagactacttttttttttgtttttatttatttttttgagacagggtctcgctatgtcaccaggctgaaggggtgtgatcacagcccactgcaacgtctgtctccctggctcaagagatatacctgcctcagcctcccgagtagctgagactacaggcatgcaccaagacacctgaatttttttttttttttttttttttttttttttttttgtagagacagggcttccctatgttgtccaggctggtatcaaactcctggactccagagatctgcctgccttggtctcccaaaatgctgggattacaggtgtaagtcactgcgcccggcctattttttgtttttaaataaattccttgagtgactgcctgaagacaaaagagaactaaataaggttataaacatcctcttgaataaaagaaagaataattacatacacgttttcaggtgtctctgagttagaggaaaaggtttacaatcaaatcattaagacttatgcagtgaagtcatatgatttttctattaataatgtgtcagtgttcttatccttcctcccccttttgaaaagtttaaacatgaatctgcaacaacctgaccacattctttctattttaaatcattttccgcgaggcgcgggggctcatgcctgtaatcccagcactttgggaggccaaggagggtggatcacctgagatcaggagttcaagactagcctgaccaacatggtgaaaccccatctttactaaaaataccaaaattagccaggaatggtggtgcatgcccataatcccagctacttgggaggctgaggcaggagaattgcttgaacccaggaggcagaggttgcagtgagccatgatcgtgccattgcactccagcctgggcaacaagagtaaaagtctgtctcaaaaaaaaaaaaaaaaaaaaaaaaaaaaaaaaattcttttccaatgaggttagtatcccctgaagaatgggagactcctatcaaaatcccactccccaaactctaatggtttaaaatctcgcaagtaaccaaaatccccacacacttttatcccatttaataactatgtatatacagaaatattattttcaaatacaaaatatcccagttaggtaacgaatgctatatactaaaagaaaaatactctgccataaggaagttgtatcatttactcattacaagttcttttattttatgttattccaaaatattggttataagccaaataatccaagaaagcaaaattttggaaaattataagagaaaaaatgtaacattaaaaatattaaagatgtaaaatgtctgcctaaataatggccttttggtttttggactgtatctatttacttaatgtgaacataacatgacgccaaaataaaaagccaatgaagtttgtatagttcatcttttctacagactttagagttaaatgatacctgctgctacaccaccattccacagctaaacccagtctaggtatcactgtgaaagcaaaagtatactacagaagcaggaagattatggataggcaaatcatactgggttggttggtttgttttttgagacagtgtcactctgttacccaggctggagtgcagcagtgcaatcatagctcactgcagcctcgaactcctgggctcaaaggatcctcccacctcagcctcctgaagagctgggactataggtgcccaccaccgcgcctggctaatttttttatttttttggagacacagggtctcccttttctttcatccaggctggcctcgaactcctggtctcaagcgatcctcttgcctagcctcccaaagtgctgggattataggcgtgagccactgtgcctagccagcaatcatttttaaaaggaaaaatctgagtttacaacaaaacagcaaaaaaaggaaattccctttcattgtgtattttgtttctcgtgtatctctttagttgcttctcttaaaaatgtaatagattttaaattaaacaatctgatcacataaaagtcaagaaatttaaaaagagccacaaaaagaaacaatgtatcaataatagctaagtcatcaattactctcttggctaatgaggctgtgaatcttgggtggagtgaccaaatccagcttagttgctggtcagtcagttggctggctagcttaacacgggaaagacagaattattcagcgaaatcatttcacaaaagaaaaccttttaactttgtggactattccccatggatccctacaccacaggccttagaacattcccaacttttatcacacagatatctttgcagtaaaaaacacaagcctttgttaggaactaacaaaataagaattcacttacaacatctaacccatctcctttacagtaggaacaagaaaaggcacaagacgacattggtgaaggaaatgcaaattgttgcagcatttgcttcagtggagaatatttaaaagtccaccttcctagaaagagggttaataaaaaaaaaaaggtatcttagtcatgctgatttttttaatcacacctgacataatttttagttaaccttttgtttttgctttcattgttgcactttaaatgatttgataaaccagctgactatcctgtatatataagtcaactgctgtcattgaaaaggttgttaaagctttacgcacacattcttaattcacttaactttaagaaaccaattttcattcaattttctcagcaaattctaggcattaagaaactgattcatctactgacaccttaaactctaacttgttaggaaaattcatgattcattcttcaaatctgttgtctacaaatatatagtacctatattctaaaaatgggaagtcatagattaataccattgtctgtgaacataaggactcccaagaactaccaatcgtaacctgcaaagtattgcccccactgaaaagtgaccttctaagaagttcctcaggacagaattttaagttattctggattacaaaaaccctaagaatcattataaaagcaaagggtcatggccaacacggccataactccaagtttacatacaagctatcctcagtttgttagtattgcccctttaaccctcaaaagggtcctgttttgaggcaaaactcatctgtggtgacagaagtcagaattgtggttgccttggggagggggaatgtgtttactgaatggaaaggatacaaggcctgaaaatgttccatatcttgatctgagtgtggttatcagggcatatacatatataaaaagtcattgaattgtacccttaagatctttcggtaggttatacatacctccataaaaatacattgttaaaaatctattcaaataatcatataaaaccattctggatctagctaccaagatgttttttccaaatgaattttaataaagacacacattgcgagcacttttatgtagtacctctcaaaatatacactgtgatttctaagaatctttcagttaagaaagccaccgaattttcgaactgaaagcacccccaaacatcatctgtttatcttaatgttgcaaataaggaaaatcaaagctacaatgggtaagaaatgtgcccaagataaggcagttagtcaatgacaacggtaataacagaactgtttcctgatctctggccgtttctaccaggccgtaacttttctgacatcgcaaacaaatcttaactccgaatctacctacggcctaattcaacaaatgcctcaaaacgctagtcaacaggcctcaaagtgtacacatgaagacacatcttccttcatcctctcgccagttgacaaattaatgattacacgttcaggcattttacccagatgcaataaaattaagaatgacatcttagaaaatgtggttcaagagaagacatacgcagggattgacaaaatccatcttacttcctttcgaatctctttgatggttacttggttctcaaacacagatcactgctaacaggactcaaaaacaccacttgggaccatcaaccagtgctgcttcgggcgacccgctgggaacacccccacctgacccaagcgtccaccactccttgagcacaagctctgggggtgacctgtgcctgccggcttagttttagaccctacgggaacagctgacatcttgtgaaaaacttagcataacgtacatcctttccgcgggaatttatttctgttcgcacaaggcgtttctgctccgcacagagcaggccttgcttcccaggacgccgctcgcccctccacagcctccttttcagcgtccaaaatcggactttaggaacagaaatcgaaacggtcgcggacctcccgagcggcaggtcggggcgctgccgggtcggcgcggggtccagcggcggtgcccggcgggccgcggcgcgggagaggcccgctcacttcacaacggcggcccggagccaccggttgcggcggccactagacgctccgccaccgcgcagcgaccgcccgggccctccgaagttccgaccggccgcgcgcccggccccagctgcgggttcgcgccccgcccggagcgagcccggggggcgggtccgcgggggctcggcgggcggagcgcggggcgcgcgcggggaggggcgcgcggcgggcccggcgcgccggggaacttgggcgcccgccactgccgccgcccggccactttcctttcacgcctcccgcgggctgacgcgcgccgcgctgcctgccaggggctgacggccgccgccgctctccgccgcggcgaggcgcccaggcgcgcccctgcagccggccggccggcgcgcgggaccgcggggccgcgcgcgggcgccgcgctccccccgccccgcccccgcccccaacgtgccgccgccgccgcccgttggcgcctcagcccgcgcgcccgccggcgcccggcggtttcccgttggcaaagttgcgcggccgcttcgaaggggacgccgtacggtcccccgccccggcgccgccgccgcccctccaggccgccgcgcgggaaggcccagccggtggccccgcttttttacctgcccggagttttcgcgcgcgcgctcgctcgatcgctcgcttttccccctctcgcgctcgttttctttctttctttccgtcttttcgctcccccgcgcggaagctttttcctcccgtgctgcccgcgctcgcccgctcgcgccctccttcctgctgggttcggcggagcggggcggccggcagctctccccgcccccctccacccgcgctccggcggaggcggcggcggcgctccgcgctccgactcattccaatat

SEQ ID NO: 1019 - DNA, 141753 bp, Homo sapiens
taaaatttgctgtaatatttccttatatttgtagagctgtttagaattcacccagtttgcaggattaaaacattttcaaatcttgaggaagaatgattgggttataaatttgcaggtgattaggataaaaaaaattcagcaaagcaaaccatttaagggagacaacctatgtatgtttttcctcactcctcatgactagaatagtgcagcaaacgctattattctataatagctagcaatggaatagtaagtgaaaattcacctggagtttcatgttaacttgagctgggctaaaagacacacttaaaagaatactgagttgtttaaatgggaatcctcggactaaagattatattcaatttaaaggattagctgaaaaaagtctaagtgtggctaggcaaagaggtttccagaatccttaaccacatctcagtatttatcctgccactgaggacactgctaacagaaactccatgctctgcgttaccctccaaaacatgttttctgtgctgtgcttctacactggagacacctggaaagaaggacaaatgggcttcgctgtgggtccatggaacacttactgattttcacccaaagtaaagaccttagaaatgaaacagaggtagacaaacaactctagagaaaagtaaacacaaaataaaagtcactgaagtccctctgagaatgaataggaagagggcaattaaacagaaatactaacagtcttggtgatgttacttaacacaggcagcctcggctgggtcaagatggagaacagtaacagtagagttctcagatcaggtcagttaaggaactggtgtaagtgccccatataatgtttttaagaaagcaaacagtttccccccctccaaattctgtcataattttagtgtttatgtagcttaaaaatggcatcatacaaaaaacctcatacatggctgtaagctcaattatcaacagaggtagtaaacaaaggaactcctaagaatcgattttaaaatgatcaaagtgtgactatacattcaaaaccctagagccacataatcatccccaaaatgaactgttttaattttaaaaagtttaaaaacacaatgacaatgaagcactgatatgccttaggaacagtcccaaatcagtgctgacttaaagctaagtcctctctttccaagaaaaagaaagcagagaacaaagttcaatctacaatgggagggaacagaatgaaaacaaccaaaagggtgctttccagcagcctaggttattctttgttttcaggccacaccactggaaatgcttttcttcttatataagtcttttcctcacaacctttattttttaaaaactgccatctgctgaacaagagatgtccacatttccaccagcaggtgatccacttctgtgcacagtttttgcttcctcactgtgagtcctccttccccgaaagtgcaaagagagcaagctgatacctgcaggccccagagccccaggactattccagctccacttataaagcagggtgaaggatttgctgcatttgtgcttcaaagatccagctcactttggttgtccttctcagttggcaaactgctcataaaaagcaaacttgatcctctctatgtgatggcaaagtttgatggcagggcccaattttaagtccatgcattcttgaacagtgggaagggtaaggagcaacagggcctgcccatcaatttcctgttaaagcataaaagacaaattatctgtgatgtgcacatgaaaggcagcttgatcatgacagcctctcctcactttagctctgtcaaaactggaatccctatgctttcctttccttactttttcgtcttaggtatcacacacttccttttaagtgactccatagtcttccacactaatgaagcttcagaattaataaagttttactgaggacaataaagttttaccaaggataagaatccattccagagtctctgtcccatagaaatttagtaaactgactagccctgtaactggcaactaattgtgccatctttttagagggttccttctaaatctgaaacaaaggattaactatcaacttcaatgttttcctactctgtaacattcataaaaacccgataagctcttgaatctccctaattttctaaacaaaacttatttcaatgtttaaggccactgactgtgtttcagcaagcttgccttaaaacttatcaccactctagagcctaatgtgacagatgctatttttttttaaacaagcaaatcattatttttgaaaagatgtggacaattaagcatggtatgcttgatattggagggatggaatcaaattcttaggaaaaactggaatgcaatgataatctccttcaactatgaagcaagtctgataaataactttttatcatctttgactcctaaaaatggaattaagacaattcttgtcttttggatcaaaacatttttcctaaaacttgtaaataaattgttgactattacatccataatttattgctaaagagacattactaaaaattataggtatctgtgattacctggtctaggaatattcttgctaatggagcacagtcagtggatctgatgaaccgcacaacgtctgccacactccacttcaaggggttactgtccaggtgaagcctttcagcaacttcgatccttatttccttcattccccacaacacaatcaaaccaaatggtgttacggctattttattctaaaaaagtctctctacctaaattcataatctttcaagacatgatttaaagtggtcttaggacatgatttctcccagcaaagatggcaaagacccacgtgcatcaggtactcaggaaatgtctgtcttttataatacgaagtatcaatgggaaagaatttatctcaaagttccagcacagataatttagacaatttaactaagaaaaacagggtgctgaagagaaggggatgataattccattgagagaaggcttaactaaactaccaggaggaatctttactgcttctgttcatggaatattcttaaaaagcaatctagtttttgaacactaaattgttctttagtgttatacatatgttataaaatgttcatatgtatatagtaaataatatattaagccaaatggcttaaccagaatcaaaaggataacttttttctacaaaaccatatatattatgaaacatattaaaaaggcagttttcccaaaaataaatgacaagctacaaataagctagcaatggggctttttttgttgttgttgttaaaacaagcagctactctgagagagactttccccctataagtagatgatctcaactaatccttgaaacacatgtaaatcactgcatttggggtcactttacaagagaccctggaaattctacataagtctgtattgaaagaagtagaatgtcaatatcactaataatcatattccagatggaaattccagagagaaagaaagaaaaaagaaactattttttaaatggtacctttggtgaaggaggtttattttcatcgtcagaaaatgaaaaggtgcgaagctccctttttctcctttgtctatctggaggcagcgatgtggatatctcactttgggtgggagaagaggagcatgactttttttctgacatttctgattcttcctgtagctcatcctgctgctcggatgtactgccttcacttagggaatcatcatccccttcatctgggtcatcctcatcttcacccccacttccctgcaggaaaaggagagaagtctcattgaaattcaggacatcaatcccaggtttcatatgattaaaaaaaaataataaagaaagaaaagaaattcaggacaaaccagttcttgggccacaaaaccatcttctattggccagagatctgagttagaaagacctgcaggtattctgtgtccatactataaagcagtggtcacttggcttcaagacattacaggcacatcacagatctcatacctggggagagcccgctggggtattatcaacagatgcagaggagcgtttcttcttatgaacaaaaacatttttccgcctctttctcctcttactggcttttttcagggcacaagctaagttactatgcccaccaggtggcctcccaattcttttatttttcttctttccgtaatagtgtgctaaatgtggatgacaaagaaaaatgaagtagcttcattatttttgtgtacctcaaaaccacaagagattttattagcatagcaaaaaacaggtacattgtatttgattggggtttaaattccatagagtggaataaacagatctgaagtgcacggtttgactagtactgaatgatccctccatatcaaagtatatagaacatcttcaacccagaaagctcccatggtcccttcccagtcagtaccccttactagaagcagccactattctaaacactatcactatagattagctttgcctctatggaaccacacagtaagcacttttttgtgtgtgacttttttttttttttttttttgagatggagtcttgctctgtcgccaggctggagtggagtggcacgatctcggctcactgcaacctctgcctcccaggttcaagcaattcatctgcctcagcctcctgagtagctgggattacaggcacacaccaccatgcccggctaatttttatacttttagtagagacggggtttcaccatgttggccaggatggtttcaatctcttgacctcatgatctgcccgccttggcctcccaaagtgctgggattacaggcatgagccaccacgtccagcagccatgtgtgacttcttctactaggcataatgtttttgagtcgtgtgttttattatatgtttcttttctatttggatatctggttgtaccagtgctatttgttaaaaagaatttcctttctcccttaaatttcttcatctctcttgttgaaaatcatttaaccatgttaagtttggctctatttctggaccctgtggtctgtcccattgttctatttttttgagacagagtctgtcacccaggctggagtgcagtggcgtgatcttggctcactgcaacctccaccgcctgggttcatgtgattctcctgcctcagcctcctgagtagctgggactacaggcgtctgccaccacacgcccagctaatttgtgtattttcactagagacggggtttcaccatgttggtcaggctggtcttgaactcctgacctcaggtgatctgcctgcctcggcctcccaaagtgctgggactacaggtgtgagccaccgcacccggcttgactattctttaatgccacactcttgattattataactttatggttaaaaaaagagagagactaagtcttccaactttattcttttttccaaattgtttcagctattctagatcctctgcattttcatataaattttagaatatacattccagaaatgaaacatacatattctagctgagttatgtattaaagtaatatcaaaatataatacaattttgtgaaaaaaatggaaattttctaaaggatacgaatccatttgacatcattcaaattactaactgggaaaaattataactgtccttctaaattctaggctaatttcaactatattattgtgaaagataaattcagacaaaaggcacaataaaatccacatatcttcccctcacatatcttccttcagagtagtgtgcttatatatgcatttacatgaatagtatttttcactcagctcctaataattgcagtttcctaaactaagtgctgagtctgatacaagaagctaagataattcctactcttaaggagtttacaatccaataaatataaatagaaactagaaggttagacttataagattttgtaatttaaatactgattagaaagctcgtcatactaagtatggaccttggatcaatagcatcagtggcatctgggaacttgttggaaatgcagatagatactcaggacccagatacccacagacctgatacatcagaagctccattttaacaagatccttcagtgatctgcatgcactatagtttaagaggcacagatccctaaaagaaatctttccattttaacaaggtaaaaatcctcctctgtagtgattctcccaagtgacatagggcttgtaggatttaaggaaaggtaggatcagaattttgtctttgggtggcaatgccttgacaaggctccaaattgtaaatttcatcctatgtgacccctgccccagtttctcaaagaagataagcaaggacagcgaataggtgctatgacagttcaaggtgaggttgcaactacctcctctcctatttccacctccccaactagtgtggcttcattgctgctcttcagagacactaagcaagcttctgcctcaagcctgtgcccttgatgccccctccccagaacactcccacccagctctctgcacagctggctcctgtttccttcaaggtgttacctgtcagaaagacttccctgaccccttgcataaacagcaccccacctcccagccttcctcactgtcctattttgcttgcccaccttgcttcactgttccccacagtatttctctaaatactgacccctctctaaatttcttcccttgtttgttatctgtctcccacattaaaggtaaactcactgaggataggaatttgttttctttattgttgtatcccagtgctagagcagcataagcacacaatgagcacaaaatatatacttgcagattgtatgaatgaattacatatcctattagatacaataactaatttatatacatgctatatataaaagttggcacactaaagcccatgagtcaagtctggcccatgacctgttttggtatagcccccaagccaaaaattacccttacattttttaaagggttctttttttttggagacacagagtctcgttttgtcacccaggctggagtgcagtggcgcaatctcagctcactgcaaccttcatctcccgctttcaagtgattctcctgcctcagcctcccaagcagctgggattacgggcaggtgccaccacacccagctagtttttctatttttagtagagacggggtttcaccatgttggccagactggtctcgaactcctgacctcaagtgatccgcctgcctcggcctcccaaagtgctgggattacaggcatgagccaccacacccggccaaaagggttcttaaaaaatgaaaacacaacacatagaaaaagaatatgtgacagaaagcatatgacccacaacatgaaatatttatcatctggccctttacagaagaagttcgtgtgcctctgctatatatgaatgtctgtaaagtaaaaaactttccaagatgtaaggtatggtcagctgctatggttaacacattggaaaaacatgactcactgtatttggtctttgtaagtacagaacagttctcagaacacttatccagaaccatccgtggaccgaagaggttaggacagcattccagtttgatacaggtttgccggcagaattcagtcacccgatctgctgttttcactatctcaacagtagcccgataactctttcctttatatctgccattggaagacatcagatgccaaatatattgggctaatgattacccagagaaaaatcaaacatattaatacacctaaaaaatatttttgcttcttggaatattctatgtcctttatagttcaagggccctgaaaacaacaaggaagttctgcatattgaacttaaatcaaattaaatctggtaagctatgacaactaaaagctgagttatttaaattagcaaaattaagctcctgctttctgttcctaagttaaggttttcaaatagtaatttcactaactgctctaaaaagaaaagtgacttttcactaagtctttctttacccttggcagtgatcctcagactgttatccaaggaccagtatgacctgccaattgcctgccatccatccatgacaagatcagaaagcaagagtacctgtttataacctttcacagtaatttgaaaaagtaattttatgtctcttacatctaataacaaaaattgttcttgcatttttatgtcttaaatttcttatttcctttttgtttttgagatagagtctcgctctgtcacccaggctggatgaagtgcagtggcatgatctcagctcactgcaacctccgcctcccaggtcaagagattctcctgcctcagcctcccaagtagctgggattacaggcacacaccacgacacctggctaatttttgtattttgagtagagacagggtttcactatgttggccaggctggtcttgaactcctgacctcaggtgatccgcccacctcagcctcccagagtgctaggattaggggcgtgagccacggtgcccggtcttaaatttcgtatttcttataattcattctatcatattttataaatgtattgatccatgaaagaatggaaatctaaaaaagaaaaacaagcctgggccttcaccacaaatagctgaaaaagccctgcctaaggaaacataaggcttctgatattatccacagaactgattctgtgaattttttttgttgttttttgtttgagacagaatctccctctgtcacccaggctacaatgtagtggcacgatctcagctcactgcaacctccacctcctgggttcaagcaatcctcctgcctcagcctcccaagtagctgggattacaggcgtgtgcaccgtgtctggctaatttttgtatttttagtagagacagggtttcatcatgttgaccaggctggtcttgaactcctgaccttgtgatccgcccgcctcggcctcccaaagtgctgggattacaggtgtgagccactgtgccacgccgattctgtgactttttaaagacaagtaaaagtaaagagtaaaaacaagtagtccactcacttggcttttaggacttccccacatccgtgccacacagagtctttgtccagctggagctcccgaaggacacggctgggtttgtaggctgcattgataagtaaagtgaggacctgagctcagttttaaagcagaaacacagattgggaaggagaaaagcagaccattagaatcttgtcatctcttccttaaaatgttaagattatttaggaggttaaattctagtcatatgaattaacaaatgttaacaaaataatagtatcagagatattacagccacccaaaggtgcagataagagagtaaccagatccttttcaacattttttaaatgttacggtcaggaaaaaaacaggtaccatgattttcaaattgctccagaacatgcttccaaatgctttcccagccacggtacacacagaaaattatatttgtttggaccactgtgtagacagctgagccttcttgtggctggaggagtctggtccagacgctctggcttccccagatcctgacttgccaccctgagggctgaaaggtctcttatctgttacttgcagcatatcacactggctgggaagaacagaaagcccagcagatgtgtagctttatcacggtcgctaggttaatgccacatagccacggcctttcagtcatagagtaacctcacagttcacttttgtatagttctcttctggtctctgacagaagacctttctaccctgacagaggtgaacctgctgtgtgaagagttgtttacgtgaatgtttcctagggaggagaaataattacataccctcttcactgtccaaaacatgagaaaagttagtaacttttgataaaacctagaactgtcacatctatggcatgtggctccctgtagaaatgaccataggagaatgctgtgaaatttccaagttattttgctctaggccagaaccttacctctctaaggaccagaacacagttcccaggtcctacacattgaggcagctcagcaattcttcctttgttaagatatggccctgagaagcaacggtggttgaagtatatctttggacagcaatattttccattaatcataactgggaaatgaagaaaaacaaatattcaaaacagtcattctctaccccacgtttccaaagctgaactgccagggaagaaaaacgaagcacatgtaccattatattaatataaagtttggaattacttattttgaagcttaacatgttgtctgagaatgctcttaagtaacttacagagcttatcactctgctgaaatcaaagagggtcctgaattaacatgctgattagttcctaggttactgcaaaattgatagaagaaccctatcttctattaataaagaaagtggagggtgtattttaagaacacatgaggattctggatgatcaatgatttcttttccaggtcttcaaaaaccaactttcaatcatctattctggaatatttatagaaattgttgaatattattgagaattagtttgtctcctaaaaaccaccaaactaatatgttggcagcctttgatgttgtgagagcaatcccatctctgagatttctcagagggctaaaagtatgctgtgaccacatctctaagttttttttgtactgtggggtataactgggtctggagacccttttcttcaactatttgtctgtatcaatactgtccttcaatttaatgtttttaaaaaatcccctcatagtggtaggcatgtcagctgttgaatgtaaaaaattcaaagacactaaaatactgctataaagcacagagaagctcttctaatagatatgcctgttaatccaatgttaaggaaagatatgcgcacactgcccattgttgataggatcctgcagttcataatgttttctctttaattaagaatagtcacagccaggtgttgtggctcatgcccgtaatcccagcaatttgggaggccaacgggggagcacatcgcttgagtccagtttgagaccagcctgggtaacacagtgaagccccatctctacaaaaaacaaaaacaaaaacaaaaacaaaaaaatcagccacatgtggtggcatatgcctgtagtcccagctactcgggaggctgatgtaggaggacagcttgagcccaggaggtggaggttgcagtgagctgatatcactgcactgcactccagcctggatgacacagcgagaccctgtctcaaaacaaaacaaaacaaaaaaacgatggtctatcatagtggccagtatgctggtgctcacatttccagttgaaccctgcaacccaaatgcctcttttcagaattaaggcactcatacccctgctgctgggtatgttggcagcttacagttcccagttttatgtctattctggaatcaccctgaactgggtactgctctcagcaggagagggccaccttgccccttgtgaggtggggagggagcagtggcttacttccaataactggtcagtaaagtgtggccaccacacctgaattaggatcaactctgagtggttagatcagcttcagggctcccagtggaactagaagaaacttctgttgcaactgcatcatggttcaacttatctctctgcccaatcctacttcctttactccttctaaggagctgttcccaaaaatactccccaatgaaactcctgaatgcatatgtcagagtctcagactctgtttcccagggaacctgacctatgacaaaacccaaaccaaaaggccttggctgaggttgtgcagaagatattaatgtcttaaattctgtggtttcagtaggcattcgaatggccaggaaagcatcaaaagcaaggagttacacagtcctaaccctctatgtacaaatgatgtaatgaaaaggcagtaggtacaagagacggaagtacgggtttctaatttgtgaaagacttcagtttcatttctggtctttctactcataagctgtgtgatctctctgagcttcgatttctcttctaggcatttactaaatatcacccaaatgcgcaatctgtgctagaatacacacagccaggatgctaaacattacacaacaagcacgtggaagttaagaatagttcaagagaggaccctggacaaaaggcttgaacctccagcaaggatttttctctcatttatcaggcattaattgcctctgggacaatttctttttccattgctttatttttttcacataaactgtgaaatttatatacaaagtatgcatatcataaaaaagggttttaaaaagaataaacttctacctctcaaccatctagcttaagaaagaacactgcctggaaaacttcaggttctttagctaaagtcaaggatggtaacattggccttctgagccgttggcacacaacggttgatcagtaaagaatagctacaattattagaaatggacggaactatcagcctagagatgattattaaactaaacacatcttagacagttataactctaaagtcacaattaagagacccctctatgaagacacatactatacatcaaatgtactgttttaagttattttcagatatagtccattaaaagaaactaagtcttcttttccttaagatgacatgtgcttatacctgactctgtggagttcagctcctgattcctcaggccctcgtggacagtcctcgaggatggtactctgggtcaagaaaacacagtaaaatagtgagataattcttaagatcagtaaagtgtgaggcttagtttccttcaaatctaagaagaaagcaaatgtggcatgttcgcaaaatctgtaacagaaggtactcccttgatgatactttttttttttttttttttttttaaaagaacaaggctggatgcggtggctcacgcgtaatcccagcactttgggaggctgacgtgggcgggtcacaaggtcaggagattgagaccatcctggctaacactgtgaaaccccgtctctactaaaaatacaaaaaattagctgggcatggtggcaggcacctgtagtcccagctactaaggaggctgagggaggagaatggcgtgaacccaggaggcagagcttgcagtgagccgagatcgtgccactgcactccagcctaggcaacaaagcaggactctgtgtcaaaaaaaccaaacaacaacaacaacaacaacaacaacaaaaaactacaacaacaaaaaagaacaattgtttttaaaactatatatagggcataatgagccaatggacagtctgtatatagcattgtgatactacatgttcaaactttctcttcattcactgggcaaaaaaattacaaaatttcttgtgagatgcttaaatcacaaataaactactcatttttcaacagtcaaagaacagaaactttatatagggttcgttttcttcgtccatcagttttcaaattaaagacaaattatgttatttaaaaaaaaacagaggcttattctgtatgtagcaatcactgaaaaaaggctaatttatcttttagaatgcatcctaactaaagctttggatcagttttggcaactaagtcaaggaaaaatccaaggtcagtcttttttttcattgttacctcacttctctacttggtataaatgtctatggcctttctctccacttctgttgttagttttattacccacatagttacaaaggtttaggtagttatagaatttgctatatacagaattgtttcctcctactcaaattcatatgttgaagccctagtgctcagtgtaactgtattcgaagatagggccttggggaagtaattaagattaaatgaggtcataagggtaggctataatccaatagcattgatagccttacaggaagagaggggtcggggggtgccggggagagaaagatttttccaccatgcaaggacacagccagaagacagccatctgctagccagggagaatgccctcactaggaagcaatctaccagcaccttgatcttggattttccagcctccagaatgtaagaaaataaatttctgtggtttaaagcaggggtccccaaccccagggccacggaccagtacccgtctatggcctgttaggaatggggccgcacagcaggcaagggagcattacggcctgagctcggcctcctgtcacatcagcagcagcattagattctcacaggagtgtgaaccccattgtgaactgtgcatgtgagggatctagattgcatgccccttaggataatctaatgcctgatgatctgaggtggaacagtttcatcccaaaaccattccccaccccagtctgtagaaaaactgtcttccacgaaaccggtccctggtgccaaaaacgttggggaccgctggtttaaagccaccgagcctgtggtattttgtatggcagccccagcagattaatagagaattcaacacccaatgttttaaaacacacatatacacacagaaacatttgtacttttaaggtttgaaggcactactaattaactgtttctcaaaagctgtgtgtgcaggtatgttacaaacgaagaatttcttgatgggcacaaagccactcctttgaatgtgccttttcttttagagctgtcttctaccccagctttatttttttccactgtgacaaatcataccctaatttacaatttttgctcttccttaatgaataccagcatgggcactcttattttctttcttttattcaactatcttaaggctctaaaagccaaagaaaactcaatttagacaccatcttgagaatgcattttacccttttgtatataatgccattttagaaaatgcatatactgcaaagagaagtatacaaatgatcaaatgttgaattaaaaaattatgcttccatctgagaaaatgaggaaatataccctctgaaatagttatttttctagatattctaacttgtaaactgttcatattattacgttacttactgtttttctggctgaaccactgcaattttcctctgtttatatactgtagaaagaaaaaaatatataaatgccaagaaaaataaaaagacaaaggaaaattcatatgtgtattaaggttacattagcatatttaaaacctggttctgtgtgagtgtgtgtgtatatatgtgtgtgtgtatatatatatatacacatatatatagtactataaattaatgcttatgtctgaatatctagactgaggcacattttcttagtagggatctttatacaaagagcaaaaataatattttcaaggctccctgggtcagtaagtgttgggaaagctcaatgaataaagttggacccttacctcagatcagtggtccccaacctttttggcaccagggactggcttcatggaagacaatttttccatggaccagggggtggggggtcatttcaggatgaaactgttctacctcagatcatcaggcattagatcgtgcaacctagatccctcacgagacagttcacaataagattcttgctcctatgagaatctaatgccgccccgatctgacaggaggtggagctcaggcactaatgctcactcgcccgccactcacctcctgctgtgtggtcccacgggttggggacccctgcctcatatcatatataaaacttaacccaaaggggatcaaagatctaaacataaatgtaagggttaaaactataaaactcttagagaaagttttataggagaaaactataaaacttattcttaatagtcaaaaaatggaaacaattcaaatgtccatcaactgttaaatagataaacaaaatgtgtcagatttatagcatggaatattattcagctatataaaggaataaagaacggacacacactacaacatggatgaactctgagagcagtacactaaatgaaagaagccagtcacacaagaccatgatcccatttatgtgaaatgtctagaacaggcaaacctatggagacagaaagtagattcgtggatgctggagtgggggttgattgctaatgagtatagggtttctttctgaaatgatgaaaatgttctcaatctgactatggtgatagctggtacgtcaattgtaacaccagaaagctgtttaaaaagggggaaactgggttgccactttcgaggttaggttgcagaaagactctggcttccatcttcctcaacctctcttgctctcttgcttcctcactctgacagaagccagttgtcatgttgtgagctgccttacggagaggcccacatggcaacgaactaaaggaaggctccagccaacacccagcaaggagctcaggccctcagtccaagagcccacaagaagatgcattcttgctgctatggtctgaatgtttgtactctccaaaattcacattgaaacttatccaccaatgtgctggtatgagaagatggggcctttggaaggtgatcatgtcacaagggcagaaccttcatgatgcagattagtactcttataaaagagatccacagagctagtagtcccttctaccatgtgaggacacaacgagaaggtgccaactatggaccaggaaatgcaccctcaccagaacctgaatctgccaacgcctggatcttgggcttcccagtctccagaactgtgagagataaatttctgttatttataaacttcccagtgtatggtattttgttacagcagctagaatgcactaagacacttgccaataataatctgtgtaaagctgggagcagatcctccccacgttgagccttgagatgactggagccctggctgacactttgagtgcagcctgtgagagactcagatccagacgacccacctaagttgcacccaaattcctgacccacagaaactgtaaggtattaaatatttgttacaataaataatttcctatgcaggaacagagaaccagaatgtcattttttttctctgaaatgtccagattagttttaattggcagcagccacacagaagattatttaacaatcaatcctctaacccagaaatagacagatacctcgtgctcggcgaggagtgctgagggggtggccgttggtttcacaccagcccaaaggaaatatatccatggattccacactcacaatacattcaggtataggcttcttagaacctgtttagatttaaacaaacaaacaaacaaacaaacaaacctttttttagaccattaaataaccttcttcataaactattttctagataatgttctactcttataataatgcagacacaagtctcttgacacagaagtcatacattttcatgtatgataaacattatgaaaaaaaactgtcttccatgtaaaactgtatcaggaccaaaatgggtagagaatatacagggtgacacttaagctagggaacagcaaataagaaactggaactaccactggtatcattcagatggttaataaatatcacagtcatttcagacaaatggaaaccaaatggcaaaggtgacaattttactcaatgagaacatcagttctggtacttcaggaataagccagaaaagaagaacagtgaattcaaatcaggaagtgatttggcaagctgctgaacaaggattgcataaaagtctacattcgatattatccttgacatccgcattaaatgccaattctacaaatcagaaacagtaggtaccttctcaaagtctgactatttggcagcaggataaaaaagctgctcagggcatatatggtaaccgtagcactgagtactcacgcagcgccttgcatccacaaacctgtccaattattgaatattacttttagcacagtttaccatttctactctatatactttttggttctattgggctgcagcaaccaaaatattatctcttcaataagctaggtgttaatgtccatgctcatataacttggtcacatcaaaatatatgctatttgacttatgttttccccttccagaaaataggggactctgtagtaaagaatttttattcatattcatttcctaaaatttggaatttgaaagccaaggacaggaaaataaatatttcgcttagagtcttgcattacaaaagtctctgaacaagatccctatttaactaatccattaagtttaacaggcaacattacaggagtaaacaggaagctcaaaggagagtggccacaggaaggcttctagagtgctggcactcaccctccagctggagccacaggtaggagcctctcactgcagtgatggtagcaacacacacttcttcagggagaatggggttcaccgcctcgagcttcatgttctccttaaattcatgttcagaaattaactagaaaatgaatgaatcaaatcaatttactggattaacacagtattaactcacgtgctcagctagaaaacctttttcaagtagtacttaatccctaggtttaaagataacatttattttgcattgttttgctttttaatgaagcaaaaggaaaatgtctgcctttcctggtgttataggaagtatacaggaagtacactctttgatgtcagatattcctgcattattgctacttgtatgaccttgctcaagctgtataacctctttttgcctcagtttcttcacctgtcagatgaggttgagaactcccatctggctgtgctattacaaggtatcaatgaaatagtctctaaggttctgtgtcctgaaccaagtggctatcaacactgttgactcacttcccctcatataaagcaccctatcataccacaaactgcctggttcatacttgcatgtgtatcataagaggcagttaggatgaagaatgtttatcaacagtgggaaagggtcatttaaaacagaaaaatatccagcatccgtgtcaaaatggacaactgaacatctgcgtttgagtgttctctcttctgacatctaacttaaaaactaaagttgtttttggtttgcttctattttgaagacaaaaacttaacatctatcttaagatggatataacaggaaaggaaacaacattttataagctaaaatttagaacagggtctggaaactaagttaaaggtgactctaagctggcagtaaagaaagctaagaactggaagaactgccaggtactaggcaactggaggtagaggagacagtcaaaacaaggaggatttgttgaaaacatttaagaaacatttaggttatgccattggctcctcgactccatgcattagggaaaccattccttcctctcccctacagaaggtgagatttatcctctggacagggtaaaagagaagatgcctaggtaagaggacacaaggaactgctgagggcatgtatgtcgtgaccaaaacagcggttagcctatggactgctgagaggcccagccctccgcctctacccaccaggcaggggactagaagatacttcttatggtgatatgataagcccaggaagaaacacataatgatatggattcaggtttccccaacaaatggccaatcagattccaccctataggaaagttcaaggttgacaagctccatctacctgctcagagctttcaatcagctcttcctttcagtcacccattcttaaatatagcaacaaccaagaattaccagacacctaagaagatgaaagttaggaccaaaacagacaagcaacttggaaaaagcagtgattatgcaagaagaaaacttcccaaaaggtgtgtgtgtggggggtggattaattaacagcctctgagagataagaaaaactattgcatccttagagcaagaatagtatgatattaaaaacaaagaagtacctgtaatcccagcactttgggaggctgaggcgggtggatcgcctgaggtcaggaattcaacagaagcctggccaacatagtgaaaccctgtccctactaaaaatacaaaaaattagctgggtgtggtggcgggccctataatcccagctgctaaggaggctggagaatctcttgaacccgggaggtggaggttgcagtgagccaggatcgtgccattgcactccagcctgggcaacaagagcaaagctccatcaaaaaaaaaaaaagaaagaaagaacaaacgaacgaactattcagagttccagaaaataaaaaacatgatgtcaaaaattaaaaactcaaaaggaaggccgaaagacaaagtttaggaaatcttccagaaaataaagcaaaacgactaagaaacataaaacaggataaaaagatttaaaaagcagaggtttgatccagagggccacaaccaaataaaagaacttccagaaagagaaaagagacaaaacggaaggaaggaaatcaaagaagtgatttaaaaaaaatttcccaacacagaaaggcatgaaggtccagaaagaaagtgcccactgagaacctagcacagcggatgaaaacaggctcgcatcaaggttcatcactgtgaaaagtggttctataccttccagaaagggtcgggggaaaagcaggtcatctacaaaagaacaaaaataaaaatagctttatagcttttaacttcttgatagtaacactagaagttagaaaacaactgagcaatgttttccgaattctcaagcaaaataacttccacattgagccaaactatgaagcaagtcagtagagtgaagacattttcaaatatacagtgtcaaaaaaaatttacttcccttgtaccctgttacaggaaggtactgagagatggggatccatcaaaacaaggaagcaaaccaagaaagaggaggccatgagatctctacaaaacaagggaccccaaatcatacaaaaggggagtgggcaattccctgggtgacaagggcatttccatgattaaaactacatggcaaggccggcacagtggctcacacttgtaatcccagcactacgggaggctgaggcgggaagatcatctgaggtcaggagtttgagaccagcctggccaacatggtgaaacccagtctctgctaaaaatacaaaaattagccaggcatggtggcgggcgcctataattccagctactcaggagggtgaggcaggacaatctattgaacccgggaggcggaggttgcagtgagctgagatcgtaccactacactccagcctgggcgacaagagcaagattctgtctaagaagaacaaaaaacaaacaacaacaacaacaacaacaacaaaacccacaaaaactacatggcaaacctttaaagagcaacccatccagacagagagtggaggttgctaagagggatgtctctttaacaaaagtgttaggaatgacagatttcttgatgtgactgcttttgataatgagagactactgggaagtgtggacagcagcagcaatagataaaattaagtaaattaaaaacaaggcaattattattgaggataaaaatttttaaaaagaaacaatcataaaatactgcagtgccaggtgcagtggctcatacctgtaatcccagcactttgggaggctgaggtgggcagatcacttgaggtcaggagttcgagaccagcctggccaacatggtgaaacctcatctctactataaaaatgaaaattaggcgagtgtgctggtgggcgcctgtaatcccagctacttgggaggccgaggcaggagaatctcttgaacccgggaggcggaggctatagtgagctgagatcgtgccactgcactccagcctgggtgacagagcaagactctgtctcaaaacaaaacaaaacaaaactgcagtgctcagctgtaatatctgaatgcatatcataatgtaaaaactcattttgtatttaaccaaaaattgtaatataactctaaaggaagaagaatgtggtaagacagagaggaaaggtaataaaaaataattaaatgctcatttatcataatttagaaccaacagactcagcaccataagacagggtgaatttaatttgttttaataaagtcaaagtttttaaattagaaccaagtgacatgtctaaaataaatgactcaaaagatagaaggtttttattttgaaaatgaagaaatacaaataactagaattacagtgagaagaacaggaagtagttatttctgggaagggagactgtgaaacggggtagggcagggactgctattttaccttctaagccttttactgctacatggctctttaaaccacatgcatgtattatttggatagaagaatttaaataagcttaacaatttttctccacttaatatttcaacagtttttcctattattgaaccatgaaaaataatcataaaatttcaaattcacgatttcagctaagaaaaaataaaaccaataaacttataaaactaacttaattagcaaactaactgattcacttctgcagtaaatgtattttcctttagaccatgtgattacaatcaccactgtgctcatctggattaagtgagatgattatcttcagagcaataacatggaaagcaagggaagcacagcagtccctgcagccctgccatagtggccatgaggccgtgggggtcctcaccggagggaagcacctctggggagcagcttcagcaccacactgtttgaggtagtcagcccagtcaaagtcctggcttgggtagcctaggtggggacaaatgaacaatgagtcacactaccacaccacatacgcctgcctggcttcacccctcaccaagggtccactcacaacttccagtgatgctagtctgacaactttgatcattttagaggggcgaaaagcattctataaatctagagcactgttaattttataaaatagagcaactctggtcaaactgtaataagacaatcagactctggataaatttgtaaactttcaaatttcaaactaggcatttattttgagcactattttatatgattagttgctggcaatttaccaaaagaatttaagacagttatgactggatttgatttgtatatataaatccactcttattgtcaattctaaagggactcgggctctcaaggaaaagagacagcaaatagtattagttaatctgcaaagacgaagactttttttctttgttaaagctgtttcctgaaatgtgtctcagatatcactgatacaaatcctcttgtcattttcagattcatatattacagaatatcaatgcttttataatctaaatcatgtatttatttcagaaaaatcaagcttagcaccccacttaagtctactgaggttcttgatggaagcatctccaagctgctgctgactcagcaccatctacatgcaaagagctgagcgaggcccaactgcctactgtgtctgagttgctctcagcctccagagagcttaatgtctcacaggcaaaaaaataggctactcaagtctatgccctctgacagcccaacagtccctgcctaccgaagactggcaccatgttctccctttgccccaacctcaatgcctgacagtacattttctgccattttcagttatgtaatctactaccttccctctatttacaaagacacagttgatttgtctataacaacactgaaagcttcagtatttttaacaactgttccttctttttcacatagaggtggcaagcagaataaagaacttgggatatctagagcgtgcctgcaaagcaagaacttccttctatggctgttctacaccacaccctccaaccaggcattcatctgctgtgttcactgatggaggagactctaggaagttctgttaatatttccccctatttgccccttgaagggaccgagttgtactcattgagcttgtcactctccccagggataagctcaatgcctggcttacagcaaacttcacatgaatgtttgttgaatgaataaaagctgaatggaagacaaaggttctgagtttatgacccttgttaacaagaaagagtacttccagcccagtgttccagcagtcaccatttagaaaagtgatgctatgctttactgaaaacctactaataacatatatagactgccaatcaaataatctgatttgctaatattaaaaaatcagataaacatctgacatattctagattctctaagtttaaaaatattaaaaatttcagtcaagctcaactaacccattaattaagggccttgattaaaggatcaaagactatattttgcaaagttgcaaatatcaggaaaatgagcttttattttcctacctactccctgagttctactcttcaccataaacttctctgtagaaagtcccctccatgacaaggctcagacacctaaagataatcagtaatctaccttctaactctggctctacggcctcttctcacaagccagcccccagtgcttgctgtgcatccaagctcacccctctgccacccctaacagacataaaagggactaaggagccagcacgaacccaggttggaacctggttttccagggggttatgaggacatagatatcaaagtcagaggatagaacgcactctctttaacagttttttagctcagtttgtaactttcaaatatgtaaatacatggaatctagacctttccttatacttttctcagaccccaaaaacgttaggaacaggctagggcaggaggagagggacaaaagatttcagcaatgccatctgacatgtctcatttcaaggagaagctctcaagtgacaattcagaagacagcgaatgtgcacctggaggggggctgatgtgtaggccattcttcagactccactgcacagggaagatgccaggactgtcggcgtggcacacaaaggatcgccgtgcgtggttctcaggacgcaagtcatccatttccaccagaaagtacttctcatcaaaaacctatacatgcaattaatagatgaaatagacaaatgcacacatatatatgtgctttctccttggcacagccaaacatattacaaaagttcatactcatgtgggtattaataatactaaacactaaatgttagctctgtgttatgtaatacatataattactgttttaattaaatgcttttcatgtatcaattcagttttaatcttaacaactgaatgaggtaagtacatatacatatatatacatatatacatatatatacatatatacatatatatacatatatacatatatatacatatatatatatatatacacatatatacatatatacacacacacacatatatatatagtttgtttgtttttttttggagacagggtcttgctctcttacccaggctggagtgcagtggcatgaatttggctcaccgaagcactgcagtcttgacttcctgggctcagttgatcctcccacttcagtcccttgagtagctgggacaacaggcatgcaccaccatgcccagctaattttttttaatttttgtagagactcggtctccatatattgcccaggcttgtctcaaactcctgggctcaagcaatcctcctgcctcagcctcccaaagtgctgggattacatgcatgagccaccacacctggcccaagtacctttatcaactccatttcacagataaggagaatgagttcaaacagaggttaaataacttgccctgggttacaaaacaaagaagaagcaaaacctggatccaaagccatgtagtttggctccaaacaaaatttattctaagcttagtgacaaacttagtttaagcttatgctactatgtattagtttttcaaatcctagcccagtttcaaatgccaaagaacgaactttatttatttatttatttagagacggagtttcgctcttgttgcccaggctggagtgcaatggcacaatcttggctcaccgtaacctccgcctcccgggttcaagcgattctctcacctcagcctcccgagcagctgggattacaggcatgcaccaccatgtccagctaattttgtatttttagtagagatggggtttctccatgttggtcaggctggtcttgaactcctgacctcaggtgatctgcctgccccggcgtcccaaagtgctgggatgacaggcgtgagccaccacacccggccaaagagataactttatgaacttcctctggcttcccactagccctcccttcagactctaggtagggccttctggccccacctgcaggctcagaatccctccttgctttgagaataatcttcttccaagacagggaaaacttaaatctcaataggtcagaggatttagcacccaggcaactattcctctagtcacattcaactttggcttctattttcagtaaatgtccttctgctctagttggaaactgaaattctctcgccaatgcctcagttgtagtgactgagcagggccttgataaccttacttcttagttttgtcagtattccaaaagattaaatctgaatctggaatacatagctggagccagtccactgccagaacttttaacactaactgcctgatccccattcatctcctcattccaatgagctctgcatctggttagacgttgatgagactgcctgcctccaactttacagataccctggcctcctaaaggagttaaatctcctttacttatatgcagctaggcctgccccaaagaatgcgtcccctactagtccagtgcccaggcccaaggctgctttggctagggctaccaagctctgaaggaggaatgggccacagcaaactggacaaatacaaaacgtgcacagaagtaattctagctgcacggcctagaaggaaaaatgggttggatcaatagagcttaaagatcaaaacactacccatttcctaaaccagtcaccttgacagggattcttaccaagagagttatctccattttaccttaacaactgtagcaggagagatcccaaaaggagaccaggggtctacagcttccaatttcatgtttacagagaatgtatgaatgccaataacttgtttgtcctgaaatgcagacaccaaaaggggatgaaaacatagtatctgtatcaatcttacactcacatgtagctgtgattaacagaaatgtccagctctggtaaatcctatagttttcttcttttttttaaatgtgcaaaactatccaatataattttctactctggaaaaaactatccaggaaaaaacaaaacacacagaagtgcttctactctctacattcaaagacaaggaatatctggagaaaaaaacaaatttattttatcagttaagactatgtagttaagggtaaaaaagaaaaggttcaaactactttaggagaacttggggagaaaatctagacaactgttagaagaaaacaaggatgatcatcagtccagccttaacacaccctcctccttcagagaccatggcattcttaccgactgcaggggctgctttacactttcacctcctgcgttgctttactctactgtaaggggagcaataccggtctatcacatgttttgtttttaccttaaataagtaagatggtaatggctcttcctcttcctctttcactttggccaaaatctcttgccactcagcttcattttttagatgtctaatggctttaataaaacatgacaacatgctttagatgatgagaaacttatactttttacctgtcctgaaagcattcacataaacaaaaacaagtcactttccactggaactagaaaagggttcaagcccacttatatccctttacattcaaagaacttgcaccttaacttcagtactttgctctatgcagagcctggacagcttggctctatgaaaatacctacagtaagatcataatgattgttgtaatccataaaattgtaatataacatccaaattggggcacataataataaatgcaaattgatttaaacagtaactctagaaataccaatattattggtatttcttttaatcaacaatttgctgtgacccaattttctatgtacctagctaaatgctccctagataattttttattttatcttggtcaagggtcagtatgggttggcacagtagtctatgaggtatatcaatatgtgtggtaaattataaaagcaataaaaagaaaagaaaagtaggcacttggccaggtacggtgtctcacgcctgtaatcccagcattacgggaggctgaggtgggcggatcacttgaggtcaagagctcgagaccagactggccaacatggtgaaaccccatctctactacaaatacaaaaattagccgggtgtggtggcatgtgcctgtaatcctagctactggggaggctgaggcacaagaatcgcttgaacccgggaggcggaggttgcagtgagctgagatcatgacactgcactccagcctgggtaacagagcaagactctgtctcaaaaaacaaaacaaaacaaaacaaaaaccaaaagcagaacaacaacaaaaaagaaaaataggcacttaatttaacaactccatataaactgttttgtaatagctctattatgagaactaacaaaggttttcataatatgcagaatatattttttcagcctcatagatattaataacatagcatgttaatgtcacagaagaaaaatgtcctattactcttcacctgaagggggctgaagctcatatccctgttgagcagcccaaccaacgtgatgaagaaatggatccaagtaatacaaccaatgttcataattgtcagaactttcaagtccttcataacgtagcttcagccttcctccaatgttttctactacagtaacaatccaagtgcttaaagagtcctggaaagcttgacattctagtctggatcctggagcaatgagatctaaaggattcctcccattacggagctgtaggattaaaaagtaaaacaacccagtaagagaaattaacataatatttttgaaaagccaacttataaatgatctcaaaccagcctttgtattttttacccattcaaaagccagtgacactaaattgtctatcatcatacaagcctcttacagtattatttctaggagatatgaaaatgtttatcttaaagaaaatctacctataatgcagtaaaattactctaacacatctctatctctaggactatgttatgtagtttcatttagtaagaatttttaaaatatcatcattcctcatctattataaaacaaatatggtccaggcatggtggctcacacctgtaatcccagtactttgggaagctgaggtgggcagatcacttgaggtcaggagttcgagaccagtgtggccaacatggtgaaaccccgtctctactaaaaatacaaaaattagtcgggcatggtggtaggcacctgtagtcccagctacttgagaggctgaggcagaagaatcacttgaacccaggaggcagaggttatggtgagccaagatcatgccactgcactctagcctaggcaacagagcaagattctgtctttataaaaaatttaaaaatttaaaaaaagcaaatatcaaaataccatcatcatcattaaagagaaaaaatcaaacaaaagtcaaagtcaaagtcacctgtaatcccacctcaaagaaagaaccacaagaaacactttggcatacactctttttctccatacaagtcaatatccacctctgccagtctgtctgttcctattttttgaaaaatggaaacactgtatactgtttcttaatttgttcttcatttagtacatcataggtatctttctataatagcacatataactcttcctcatgttttatagtattttatgatattttacattgtaaatgggcaataatttatccagttacctacagatagtatttcagttgtttctggttttttattgatgtcacaacaatgttcaaatgaacagagtaaaagcttttgattacagtgatggaaaggaaaagtttaactctcactatctagaagtatattaaaaactacaataaagaaaagaaattcattatcaagttatcacttaatcatttctaatacacaaccttacatttttttcctagtaaaaactgctctgtgacacttacatatccagatatgcaaagggacatatgaaaaagtggaggaaaagatttagagctaaaagtcagcatggcagagtcatggtcaaaaaagagtagaatagtttatcaattcatccattcattaaaatgttactgagtttttagtatgtataaggccctggctaagcataaataaatgagtcagagtataaaaaataaaaaccagtttgaaatagagtattcaccaatcaaaatttaaaagggaatgtgaatggatgacagaagtaaatgtaaccataaaactcttagaaaatacaggagtaaatcttcttgaccttgggttaagcaaagccttcttagatatgataccaaaagcacaagcaacaaaagaaaaaaagataatctggattatatcaaaataaaaaatgtttacgctgcaaacaataaaaagacaaaccatagaatgggaaaacatattttcaatattttgaaatgcatgtatattttgaatgcataatacattcaactcaataataaaaagacaacccaatttaaaaatgggcaaagaaatgtctccaaaaaggatacagaaatggcccataagcacaaaaaaacatactcaacatcaacagtcattacagaaatgtaaatcaaaatgagatgccacttcatacccacttagtcagctataataaaaaagataacaagtgttggcaaggaagtagagggatgggaaccttcatacattgcatttcacatatgccacaaataattttaccagtatgacagaaagtgacaagatataacttagaaatgtcataaccaataaatccatttcacaaaatcaagagatctatattcactaacaagcttaaaggccacactaatttaaaaggactgctgaaaagcaggtggaaggcagaagtgcaatagatccaatgtgttccaagcaaaaaaaaaaaaaaaaaagggtgggttggggggactccaagtcacctggtgtgggagttacaaatgtccaccctcaagcagaatcgacctctgctcagtttcagagtgaaagccctcagaaggtcctattttccaactgtataaaagaatctgggaaattagattttttatgtgttagcaactaattcagaaaatatttaggcactaagcaagccaccagtttgcaacctctgagggtaagtttaaacttcccaatacctatgcctatgtctctaataataacgtttattttcttcagagtggtaaataagcaaccgattttaagattctttgaaagatcagatgggttttccatgctgatgtggcatgtagtaatactcacgccctctagcagcggaacaggaggactacatgctcctatcagggtctgccgcagaaactcatcccagtcagatactttatctctgatgcctagatgagggaataaatgactgattactcaaaatgccagccacagaatgcagagaaaccgaaatcagtggagatggtttaaaggtatttcacattttaagatctaagagtccaacatactgcttgagagcttgaaaagataaaacaaaataaaaccaaaaatgcttctctagatggagctactttctggttagtttattaagagttgtatacaaaacaaagagaatagtcccaactacctattcctataattttacccagaaggtaccttactttattttttatgatggaaactttcaaacatacaaaaagaaaaatgatctaatgaatcctaagtgccctggcgtcaacaactgtcacctcatggccaatctgtttcatctaaaccaggatttacaagctacaactcgagggcttaatccagcctgctgtctgtttttgttaataaagttttactggaacatggccatacccatttgtttacatattgtctgtggctgctttcacactacaaaggtagggttttagcagctttgacagagattgtatgactagtaaagcctaaaatatttactatcttgccctttacagataatttgccaatgcctggcttataccctcacactccacccatgcccaaccaaggatcagttagaagacaattccagatagcatataatttcatccatatatatattttagtacatatttctaaaagaaaatattttcttacaaaaccacaataacaacatcatacctttaaaaaattaacaataattccttaatatcaaatatccagtctatgttcaaacttccccaattgtctcataaacagttttgtcaatttgtttgattacatcaggacccaagtgagacgcacgcattgcaaatgtctccttgatttcttttcatcagtaggtttcttctccttcctcccctcccgtgtccctactctctctttttttactccacatttattgagacctggcctttgttctctatggagttttttagagtctgatttcattggttacgtccctgtggtgaccagttgttctactgttccctgtatttgccataaatcagtatttagagctagaagcttgatcaaattcaggttagactttgcggggtggtgagggtgaaagaatacttcacaagtggaataagttatacccttccctcaagagcatgaagaggcacatatggtctggctgtctctccctttgtgacattagcagcttttaacggttactacatagatgcactgattcattacgggctcaatggtgatattctaattgtattattccttcttcatttactaaccaaagaacttccataaagaaaaatttctctacatcaactatttgattatgctgaggtagatttcatagaaagaaggctttctttgaacatatacttgattgtctttactctttctctatatttaccaccctttaaaataaacagttgattggcaggcatcttccaagagtggctaatgagggttttgtttcaaaatttcactatgaagtcatacattaaaacaaatacatttcaagccattacagctgttgtccttacgacactctatcttcaaccagaggcagtctcttcaggttggctcctgagaccttttggcatgacactagtaaagagccactgataacttttttgctttttggtatgacaagatgttccaggatcatctaggaaattgcctgacctagtgcaggactcagctacttctgcaagaagccccagtttatttccatggaaatggtatttagagacctgggcatgctcattgtcactgggttagtgtttctcggccttttcagtgtctagagttaatgcatttcttcttcttcttacatcacaatacttccaatacaaattcagaaagatagtgctttcatttaactcatccatctaagctctatttcctttctataacgctgaaaatcctagttctcaattacacatttcttttttttttttttttttgagacagagtcttgctctgtcccaggttcacgccattctcctgcctcagcctcctgagtagctgggactacaggcgcccgccaccatgcttggctaattgtttgtatttttagcagagacggggtttcaccatgttagccaggatggtctcgatctcctgaccttgtgatccgcctgcctcagcctcccaaagtgctgggattacaggggtgagccaccacgcccggccacacatttcattctttatttgcttttgcctaccatatacaaacaactatttcaaagtaacaacattaagtctaccaccaacagtaggattactaaaaataggttaagattttttctttgcatttttttttgttattgttgtccttagaatatataaccctaactggggacatactttcatattttactgtatttttaagtcactgaaatagctcctctttgtgtggttatcccataagctccatatacagttaggtttccttgatttttaggaattgctttctaaacatttaattttgctttctagttgcataaaatatttacaaggttcaaaagtcaaatctacaaaataaaataaggtacattcataaaatttagcttctattcctacctccttcattcttttcccttctttccccataggtaacttttttctaaatgattcattcttttttttttttgagacggagtcttgctctgttgcccaggctggagtgcagtggcacgatctcagctcacggcaacctccgcctcccgggtccaagtggttcttctacctcagcctcctgagtagctgggattactggcacacaccactacggttggctaatttttgtatttttcgtagagatggggtttcaccatgttggccaggatggtcttgatctcctaacctcgtgatccacccgcctcggcctcccaaagtgctgggattacaggagtgagccactgcgcctggccaacgatttactcttttattttgaaaaaaataagttcacacacacacatttgtatcatcatatccttgagctctcctcctcctcaagtctgtacacatttttctttttttcatacaataacatatcctgagcccactccttggttgtatgcagaccctcctcctttttattgctgtctatagctgcttttcttacaaagtatcctttgtcagctatcaagactgacagctggtttcttttctactggcagttgcctgtacatctttgtccttttatttttactttttcgtagtctctctgcttaggtatgtctcctatacagaggacaagagtggattttgctttatgaggcaatctgaatttatttgtttacttctaataaaagagtatgcccagtaacacttattgatattattaatatgcatggcctaaatttcatattgttaaatgttatatacttcgtgtatatgtagttttttttactatgtgatctatcccgtttacacatatagtttctctttctaagtctctttcgtcatatagaaaggttcttatttttgttctacggattacctttatataacacttttagtcctctctatttttggactactttctattttgttgttgttgtttctataaacaatactgaagttagctataagcccttcgttttctctccttcagcatctcatttcaggtactatccttttactcccagttaacatttaaatagttatattacatggcaataaagctgtttttttttttaagacaattagtgggcttatacaactattcacgttttccccattcttgtcccatattttttatagtaataatgtaactacattttcagagcatacagctattatataccacagtgtctcccttacaaccatcatttagtttaagttctatagctatacatatatttaatgtttcactaccatttcccatgctaatgttacctcattaatttgctcagctgaagctcattccctagtggacgccttaggaagggctcatgggaacaatattacttagttcttacctgttcgtaacagtttgcatatagcctttagatctgaagttcagtttggctagatataaaatccctgtctcatattttctctttcattacatttcttaagtacattacattccattgtcttttgacataaaccattgttaataactctgatgaaaatcttgttttctttcctctataagaaacttggtctttctcctaaatagccgtggtattattttttgctttaaagttcaatactttcattagaacaattttgatgtagctgccctcatttgattttcctacatacatagtaatccctttcagtatgtattacaaggcctcttttatttctgtaaggtttacctgaattatggtccagcatggtagccggactacacctgcaatcccagcactttaggaagctcaggcgggcagatcactagaggtcaggaatttgagaccagcctggccaacatggtgaaaccccctctcaactaaaaatataaaaattagctgggcatggtggcatgtacctgtagtcccagctactcaggaggctgaggcagaagaactgcttgaacctgggaggcagaggttgtagtgggccgagatcgtgccactgtactccagcctgggtgacaaagagtgacactctgtctcaaaaaataaataaataaatgtttacctaaattatagtttatagtattttattgtttcattgcttcagttttcttcttcaaggacttctactgcaggtatgttaaatcatttttacctagctgtataaggtgtttctcaagtcctttttatttctttgtttggtttttattttaaaatttctttcctttttttcatctgtttttcttcagatagtatccatggtgctgactcattcctgtgctcattttaactaagtcttcattttcaatattcttttatttccagttcttgcctaagttttactttttctcttttcaaatcttcccttttttaatcctttcatttctgaatgtttataaattttatttataatttttttcactgtttctattattgttgctacttttttgttaccttattttgaaatgtttttatctgacacaatgttcacctcttctgtggttgtttctactcttttttcactgtaataatcttgtatgagattcaactgaaatccttttctgttgttcacatttaaacgagatgcattttcctacatacgttaggatgagatggtaggccaggtggcttcatgtctctagagctctctcttctattgttactcacaaagtaaaaaaccttcacaaaggagaagcccacagacatcccaggaccctaacactcagatcttcgtttccaaataccattcttcactaaaagaaaagacttcttggggaaatggctgatttcagggctgagacagcaaaatgcttcttgagccaaaaaataagaaactgcttaaagaaaaataaggacatattaaaaggatacagtagcccgcttgaaggggtaaccactcacccaatctaggacagtttcaggatcaaaagaaatataaagtaaaggattataacccattaaataagatcagaatcatgagtctacactgataaacatacctacatatacacatacatacataaatggaggaaagggggaagctctttctatagtatagtagaaagccaattaagaaatgtagaagaaattttttaaaacaccatttggtaattattgaaaaaataattgtttcagataaaatttataaatggatactaagaatagtgggttaaagtgtgaagagtaatgggatattttcataatctccaagtatcttccaacaagacactaactaaaaagcaaaaaataatacctttacgatgaaaaaacttggcatatacgaacctaatcaagtgatggaagttaattttacctgtaataaggcaaatcaatagcatgtatcttctgatatcatgcactggaagggcacagcttttgcatttttcctaccaaaagtgaacaacctgaatgtaaggaagcatcagacaaacccaaattgtgggaaatctgacagaatgactggcctgtactcttcaaaaatgtcaagttcaaaaaagaaaaacaatggttaagaaaacgagagagacacgacaactaaatgcaatgtgattctagacaggaatcttggaccaggaaaagaaatacagcataatgaacattattgggaccaggatagaatgaacattgggaaaactggcctgtaactttcaaaatatcaaagtcatgaaagacgaaaaaccctgaggaactgttccagattataggaaacttatgagacatgacaactgaatgtaacacatgatctgggatttttctttaattaaaaaagagttattggccaggcgcggtggctcacgcctgtaatcccagcactttgggaggcagaagcgggcagatcacctgaggtcaggggttcaagaccagcctggccaacatggcaaaatcccgtctctactaaaatgcaaaaaattagctgggtgtggtggcgggtgcctgtaatcccagctacttgggaggctgagggaggagaactgcttgaacccaggaggtggaggctgcagtgagctgagattgcgccattgcactccagcctgggcaacagagtgagactctgtttcaaaaaaaaaaaaaaaaaaaaaaaagttattgggccaggtgtggtggttcatgcctgtaatcccaacactttgaaaggaggaacgcttaagaccagcagtttgagactggcctgggcaacacagcgaaactctgtctctacaaaaaagtttaaaaattagttgggtatggtgacacacacctgtagacccagctacttggcaggggtgaggtgggagaatcacttgaacctgggagttcaaggacacagtgagctaggatcacgccactgcactccagcctggctgacagagcgagattctgtctcaaaaaaataaaatagaacgaaattatcttaaatgttattggaatagctggtaaaaactgaataaggcccaggcatgatgcatgatggctcatgcctgtggtactagctattagggaggctgaggcaggataatcacttgagcccaggagttggagaccagtctgggtgatatagcaagaccctgcctcaagaaaatagaaatgaaaataaaaacaaaaatactagaaagtgatataaatataaaaataagaccatgtttattaaacaatgttccttttaaaaaactgagtactatctgtaaacagtattgtatcaaagttaatttcctcattttcatattttactgtaacatgaataccttgtttttagaaatacatacagtatttttgaataaaagggcatcatgtctaaaactgactctcatgtggttcattaaaagaacatgagtaaagcagtggagacaagataaagtaaacatcatatatgtcaccattaacaacatttggaaacacttggcaaaaagtctccaataattttccatatgattctcataactttttggtaaatctgaaattatatcaaagtaagaagttaaaagaaaaataccaaaagtctggtattttctttcttttgagacagaatctcactctgtcacccaggctggagtgcagtggcgcgatctcggctcaatgcaacggccgcctcctgggttcaagtgattctcctgcctcagcctcctgagtagctggaattatagttgtgagccaccacacccagctaattgttttgtatttttagtagagacggggttttgccatgttggccaggctggtctcgaactcctgacctcaggtgatccagccgcctcagcctcccaaagtggtgccattacaggcatgggccaccccgcccagacaactcacgtattttcttaaatccggagtcctcttatctttccccacctttatctcacccttctctttcttttgcctttattgtctctcttctgcttaatttggtttttactccttctggaatggtgcttgatttagttcatttaagagttcctagttaccagattgcttgagggtatgaggagagaggacaataaaaacaaaagaaaatcaacagcacatcagtctggcccaacgggcttaaaaacaaccagatctacaaatctcaaactcagagaacctcacagtctgaaaggatgatatgcagctagtgttccctatgagcatcataaaaacctgaggctttatgtagcaaagaaaataattttaaaagacagggaaatgtgtattattccttataaatattttcactcaaaatgctaacctagaaaagctgggtaaacctatatgctcgagagacttaaaacctcaagactgtggacaatccaaattttcttacagtaaaatcacgtcacgtcttgataggaagtatttcattaccttctggggcttcaagggtcttcttattctgctcacaccacccaatggggtagagatcagccttcctgatgtcacaccagaaatctgctctccgatcctccccatagccatcatagcggagaaggagcaactgctcacaggtagtgataacggtggcaacccagtaggtctcaggatctgttctcacagccacctccagcttcatcccaggagcaaatccattttgcaaacgtgtgtccaccttaacagggaaatgttattaagcaccagacaagtatcttaaatgagtatttctttgaccaatgttcttttttaagacttacaattccgaagcactaaatgcaataacatctcaaggaaagcctgagaaattccaattctaacttacagaagcaatccagataaaacaaacgaatagcaatgctgctctgttccatctgacaatgaaggaactcaatattttcaccaaagcagtctattatgattacagaaaatgcttcctattaagtatataaattactagtcaccattttaatagctttcaacacattgtttacaagaatgatttctgcatcaaccaacaggaaatttatgatgctagaaaagtgagaagacaaaaataaaccataatgataataaattagtacaatatgtaccatatacagggagccatatttcccagtttccctaaaagtctatgtttccaccaattactcttaaataataattaataacatcccccctttccctctcaaaagtgttctaatttagatgaaacattatatggtcacaaaggtctgggttagcaaatctggaactattaatactttatgtgtatactaacattaaataaatatactatgaataataagagccaggtttctcaccatgggaaaaagaagtgacaaataagcaaagggaagcctgtggtgttggactggaatcagatgcatctgaacagggacatgatgatggattggtaggcagatagagacagacagacaggcagatagatggatggatggatggataaagaaatgaacgaataatagagatggagacaaccatacacatgtatttcccaactctgtgaattgagagggactagaaataatgacatgtagtcacagtaagcaaatatagtgtacaaattttgatttctttcttttcttttttatttttttgagacaaagtttcgctctgttcacccaggctggagtgcaatggcgtgatctcggcttaccgcaacctctgcctcctgggtacaagcgattttcctgcctcagcctcctgagtagttggggttacaggcgcccgccacaacatccagctaattttttgtatttttagtagagatggggtttcaccatgttggccaggctggtcttgaactactgacctcaggtgatccacccacctcagcctcccaaagtgttgggattacaggcgtgagccaccaggcccggcctcttttttatttttttagacagggactggctctgtcacccacactaaagtgcagtggtgcaatctcggctcactgcaacctcaagtcatcctcccacatcagcctcctgagtagctgagaccccagatgtgcgccaccatgccttgttaatttttgtattttctgtagagacggggttttgccatgttgcccaggctggtctcaaattcccgatctcaagcaatctgcccatcttggcctcccaaagtgctgagattacagtcatgaaccactgtgcctggcccaaattttgatttccaaataccaccttccaattaaaaaaaaaaaaaaacaaggacttcagggaaaaaagcttattccgattctgggataggaaaaatacaattagagcctggaatatcttgtgatgccagaaagtaaggaaatgatcaaaaaattatgggagtatgttgaaggaacatacaagacaactagaaggatctcactggctacatctgggacaatttgagcaataaaataaatagtgagagtaatgcattataactaatagatttaaataagtatccatgagtccacactgatataaattaggggagaggggacagatcttccttagagtagaaaaccagttaataaatattgaaaaaaaaagatggaaatagaaaatcactagtagacaaacatcacagaaataaacattgcaagagccgggcgcggtggctcacatctgtaatcccagtactttgggaggccgaggcaggtggatcacgaggtcaggagatcgagaccatcctggctaacacagtgaaaccgtctctactaaaaacacaaaaaaaattagccaagcatggtggcgggcgcctgtagtcccagctactcaggagacaaaggcaggagaatggcatgaacccgggaggcggagcttgcagtgagccgagatcgcaccacggcaggcaatccagcctgggcaacagagcgagactccatctcaaaaaaaaaaaaaagaaaaaaagagataaacattgcaggcaagaattattgatggactctaaaatactatgatgagaaacaggatatctgcaaaatctcaaaggttctcccagtaagattcttattaacttcaaaggggaaaacagcaacattacagtgaaaaaatctggcagatgccacgtaactaaccaatcaaagtttgcatcagtatcatgcagccttgatttcatacaagttaactgcaatatcattcctacaacattattaccaaatctgcacaaattcaatccaatcatgagaaaaaaacaaatccaaattgaggaatattccacaaatagttgacatgcaatataggctcatcaaaagtgtcaagtccataaaagacaaagaaagaacgaggaactgtcatataccagagaagactatgaagacatgacaaataaatgcaatatggcaaccacagccactggaaaatgcaagtggaatcctggagacagccagagagggaaagtcccacattctgtgtaaaaagtcctcccccgctagtcactacctgttctatcactatcctaaacactatggttatattgactatgtttccacactatgttaatgaaattatgcggtatgaatattttttgagtggagcttctcttgtcgaacattacttacgagatttattcatgctgttgcatgtaacagtagcttacttcttttcactactgtgtagtattccactatatgaatatgtcacaatttattcattccacttctactagttactagctatttgggcagttcacagttttgggaagctacaaataatgatgccataaacatttttgcttgtcccttggtacatacatacatgaatttctaaaatacataacaaccaaactgttttccaaagaagttgtaccaatttagtttcccaatagcatatgagaaatccttttgctccattcctttttttttttttgagacagagtcttactctgtcacccaggctggactgcagtggagtgatctcggctcactgcaaactccacctttcaggttcaagtgattctcatgcctcagcctcccaagtagctgggaccacaggcacgtgccaccacacctggttgatttttgtattttttgtagcaacaaggtttcaccatattggccaggctggtctctaactctgggcctcaagcgatccacctgcctcagcctcctaaagtgctgggattacaggcgtgagtcaccacgcctggctccttttgctccactctaaccaacatttttctattttcagtctttttcactttttttttttttttgagacaaagtctcactctgtcgcacaggctggagtgcagtggcgtcatctctgctcactgcaagctccgcctcccaggttcacgccattctcctgcctcagcctcccaaatagctgggactacagatacccgccaccaagcccggctaattttctgtatttttagtagagaccgggtttcaccgtgttggccaggatggtctcgatctcctgaccttgtgatccgcccgcctcggcctcccaaagtgctgggattacaggcgtgagccaccgcgcccagccccttttttcacttttaaccattttggaaggtgtgtcatgtatcttattgtaattttaatttgtatgatctgattattaatcaagttgacaacctttatatttattagtcatttagatttcttttgggaaatgcttaagttccttacccatttttaaattcagtctatattgtgggcatcagttctttgacagttgtgttgcaaacatttttctcattttcactatgatgtcttttgataaacagaagttcttaaatttattgtagtctaatttatcaatatttttcctttaaaaaggtagtgattttctatatatgtattttttttttttttcctcgagacagcgtctccttctgtcgcccaggctggagtgcagtggcgcgatctcagctcactgcaacctctgcctcccgggctcaagtgattctcctgcctcagtctcccaagcagctgggactacaggcatgcaccaccatgcctggctaagttttgtatttttagtagagatggggtttcaccatgttgtctaggctgctctcgaactcctgacctcaagcaatccgcctgcctcggcctcccgaagtgctgggattataggcgtgagacaccgcacccagctgctttttctgtatttttaaacaaatcttttcctatctttaaaggtcataaggatcataaactatattattatctaggagctatcatatttagaactaacatacacctggaattaatgaagttaatatgaagttaaatatgggtaagggtttatttgtttcaacatgtgtacacaattaaaccagcacttttcccgaccactataagtcatcaactttgtaataatcaagtgtccctacaaaagtggatctgtttctgatttacttttccttaaagtagcactatactatcttaattaaacttgatatctagtacagcaagtcttctcattttgtcttattctttaggtgtgtctggctacccttgatccacgatatatccatataaaaatcagaatcagcttgtcaatttctacctaaaattttatatatatgtactttttgaaatttaatttgtttgcagtaaatctacagacctagttagggaaaactggtatctttacaatagtgactctctcattacatgaacaaggtgtatcccttcatgtataatggtctttattttacatcagtaatgaattggagttgccttacaattattattattattattattattgttattattatttttggagaccgagtctctcattctgccgcccaggctgatgtacagcggcacaatctcgggtcactgcaacctctgtctcctgggctcaaaggatccccccaccccagcctctgatgtagctaggattacaggtgtgctccaccatgcctggctaatttttaatttttttttttttttttttttgtagaaaaggtctcactatattgcccaggctggtctcgcattcctgggctcaagcaattctcccaccttggctcccaaagtgctgggattacaggtgtgagccactgcacccagcatccttgcaattttttttacatttaatcctagacattttatgtttctgatgttactgcattttcatttagttccaaatatttcaaagtttcccgagaccgcttcttttatccgtgttattcacaagtgtgttgtttaatctctaagtaactagggactttccagctatctttctgttattgatttctagtttaatttcactgtggtttgagagcacactgtatgatttatattattttaaatttgttaaggtgtgctttatgggcctgggtgtggtctatctttgtgaatgttccatgtgagcttgagaagaatgtatcttctgctgttgttgaagtagtctatagatgtccattatatccagttgattgatggtattgcagagctcaacaatgtccttactaattttctgcctgctggatctgtccattttcgataggagggcgttgaatttcccgactaataatattgaatccatttgtttctccatgcagttctaccaggttttgacttgcgtatttttacattctgttgttagatgcatacattttaaggactgttacgtcttcttgaagaactgacccctttattattatgtaatgtccttctttttttttttttttttttttttttttgagaccgagtttcactcttgttgcccaagctggagtgcagtggcatgatctcggctcaccgcaacctccgcctcctagattcaagcgattctcctgcctgagccttcctgagtagctgggattacaggcatgcaccaccacgcctggctaattttgtatttttagtagaaacagggtttctccatgttggtcagactggtcttgaactcccgacctcaaatgatgcactcatctcggcctcccaaagtgctgggattacaggcgtaatgtcctaacattccttgctttgaagtcagctctgtctgacattaatacagctaggtcttttttttgttagtgttagcatggtatatctttctccatccatttacttttaacctatatgtctctttatatttaaagtgcttttattatagacaacatatagttgggtcatattttttgatccactctgataatctccatctttttaacagtgcatttagaccactgacattcaaagtgattactgatatagttggattaatatctaccatatatgttagtgttttctatttgttgccttcttctttgtttccattttgtctttcactctttatctgccttctgtggttttaaacaggcattttatattattccactttgccttcttagcatattatatttcttttaactgtttttagtagttgccctagagtttacaatatacatttaaactaatccaaatccaatttgtgattttaaaaaacccttataataacaattctaattctgccatttcttcccctgtatcattgctaccatttatatatgtaagcatgccttagcatatatttatacataagcatacataatcaaataaattgttgctgtcattactttttttgtttgtgttttgagatggagtctcgctctgttgcccaggctggagtgcaatggcgcaatctcagctcactgcaacctccgcctcccagattcaagcaattctcccgtctcagcctcccaagcagctggaattacaggcacccaccatcatgcctgtctaatttttgtatttttgtagagacaaggtttcaccatgtcggccaggctggtcttgaactcctgacctcaggtgatccacccgccatggcctcccaaagtgctgggattacaggcgtgagccaccgtgcccggctgctgtcattattttgaataaactgttatatgttccctcaataaagaataagaaatattaggccaggcatggtggctcatggcataatcccagcattttgggaggccaaggcaggaggttcccttgaggcaaggagttcaaaaccagcctgggcaacatagcaagacccatctctaccaaaatatatatatatttttttaagttagtcaagcatggtggtgggtgtctgtagtctcagctactctggaggctgaggcaggaggactgcttgagcctgaagctgcagtgagctaggatcacaccactgcactccagtctgggcaacagagcaagactcttatcttaaaaaaaaaaaaaaaagaaaaatccaaggttttcttttacattttaaaattccttctccaaaaaaaaaaaaaaaaacacacattccttctctaacactcttttttccttcctcagaaaccatgcaagcaaggatagagaggactgaaatagttaaggcatttaaagcaaaaagccactaatttagagctgtgtatcaagcaaaattatccttaaaaagtactaaagattttctcaggcaaacaaaaattaagggattctgtcaccagtagacctgtcttgcaagaaatattaaaagaaattctttttttttttttttgagatggcattttgctcttgttgcccaggctggagtgcagtggcatgatcttggctcactgcaacctccgcctcttgggttcaagtgattctcctgcctcagcctcctgagtagctgggattacaggtgcttgctacgactggctaatttttgtatttttagtagagaaggggtttcatcatgttggccaggctggtctcgaacttctgacctcaggtgatctgggccgaattaaatgaataggttgggctatttaactgcagcaggaacatgcccttaaagacacagattgctcatgctttagtttgtgtctaaagaatgcctttaagcggttttctgccctgggcgggccaggtgttccttgccctcattcccataaacccacaaccttccagcttgggcgttagggccattatagacatgttacagtgctgcagagattttatttatggccagttttggggccagtttatggccagactttgaggggcttgctcccaacaatgcaatatgaaataaaatccttatctgaaatatgtaattctcaccactttaagagagatataaatgaacaaagaataatcaaaaagggcagctaacatgactgagtttttacacacggaaaactaaaaatagtgggactcgctgtgcatggtggctcacgcctgtaatcccagcactttgggaggctgaggcgggcggatcacgaggtcaggagatcgagaccatcctggctaacacggtgaaaccccatctctactaaaaatacaaaaaattggccgggtgtgatggcgggcgcctgcagtcccagctactcgggaggctgaggcaggagaatggcaggactctttagcatataaagacaacagctaaaagaatatggtttatattcacagacaacactgactgtgcatcagtgtcttcacaaatcctagaacaaaagaagtatgccctactgaacattgctatgggctaaactgttcaccccaaaatttgtatgttcaaaccctaagctccagtatgactgtttggatataggccctttatgaaggttgtcttagtccatctggggtgctacaccaaaatatcttaggctggaaaatgtataaacaacagaaatttactgctcacaattctggaggctggaaagtccaagatgaaggccccaggggattcagaatctggtgagggttcactttctgcttcaaagatggtgccttcttgctgtcttcacatggtggaagttgagcaaacaagctctctcaagcctcctttataatggtgctaatcccattcatgagaaaaaacctttatggccgaatcacctctccaaggccccacctcttcataccaacgcaatggggattaggtttcaacatataaattttgggagggcacaaacatttagaggtcataaggatggagccctgatctaacagaattggttcttcttcctttaagaagagacaccacagaactcttactgtttctaccatgtgaagacacagcaaggtggcaactatctgcaagccagaaagagggccctcaccagaaagcagctacacacctaggctttcagtctccataactgtgagaagataaatgtcagttgtttaagccacctagtctatgatattttgttatggcagcccaagcagactatgacaaatatgaaataagtagttttagaattaattattctgtgtgttttaagagggagtttgagtaaacaggttaaaaactaggtctaggatgggcacagtagctcacgcctgtaatcccagcactctgggaggccaaggcaggaagattgtttaagcccaggagtttaagactggccgacatggtgaaacaccatctctactaaaaattagctgggtgtggtggtgtacacctgtagtcccagttacttaagaggctgaggtgggagggtcacctgagcccagggggttgaggctgcagtgagctatgatgggcgatggagtgagacactgaccccctacccccctcaccaaaaaaaaaacctaggtctagatataaattataaacaaaatttggggtactttcttacattctaaagtcattacacagggcaaatatgttgtcattgacaaggcattaaactgggttgttagggcataaaaccaggctgcacaggccactaatatgacatgtaaatatgcatgtcatacttatgttctgctcagtaagagtgacagcaaataatgctattgaaattactttcaatgaatgcaacaaagtaaatgtaacaaagtacaataatttttttcaatttatgacaaggttttttgacaaaagtaaaggaatattcataaatggtcaaaaagataagtcatgcattgagtagcagaaaatacacaaaaccaaaaaggattttagaatatggcaagtgtgaccaggcacagtggctcatgcctgtaatcccagcactttgggaggctgaggtgggaggatcacgcggtcaggagatcgagaccatcctggcaatggtgaaaccccatctctactaaaagtacaaaaaatagccgggcgtggtggcaggcgcctgtagtcccagctactcgggaggctgaggcaggagaatggcgtgaacccgggaggcggagcttgcagtgagccaagatcgtgccactgcactccagcctgggcgacaaagcgagactccatctcaaaaaaaaataaaaaaataaaaaaataaagaatatggcaagtgttcttactaagggtggcaggaggaaagaaaaagctcttaaattacttcaagtaccacaaattaaaataactttaaattctctaatgataatacagagattcgaaataaagggatataacaccagtaaggcaaatatagttattgcttacatgtttaaaagacccatagggaactgctgtggaccctgtttcttctagataatcttcccagcttaattctacctcttccataccagagccggcatctagaattaaaaataaaacaaaaacaggtgaatcccaattaaagaaaactcaaggtataaaaatataaacttaataaacctaactttacagaatttacttcacaactgattttgcacaaaagaattaagtggggttttgttttgttttgtttttgttttttaaatgataggtgcccttagtgcactgattgtcaacgaatcttcacagaacagcagtttgacatgctatctcttgctgaagaggcacccaaatctagagttcacccaaatggatcacataaaactggtaggagtataaaccattactatcactttggactgaaatttagtattctaatgtcaaacattgaagacacttaataagcatttcaaacttaaattttcaacttgatcctttcttagtactctcagagtgaaagatactcctagtaaatattttaccttaataaaaaaaaaaaagtgtcattatccttgcccccctccctttttctccataccttatatccaatccatagaagaattctgtaggtactatcttcaaaatatatccaaaagctagaaagatctcctaacgtcacgactaaatcaactagagaaccaagagcaaacaaaccccaaagctagcaggagaccagaaataatcaagatcagaatagaactgaaggagatagagacacgaaaaacccttcaaaaaaataaacaaatacaggcactggttttttgaaaaaattaataaaatacctgtaatcccagcactttgggaggctgaggtgggcagatcacttgaggtcaagagttcaagaccagcctggccaacatggtgaaaccccgtctctactaaaaataaaaaaattagccaggcatggtggcacatgcctgtaatcccagctactcaggagactgagtcaggagaactgcttgaacccaggaggcagaggttgcagtgagccgagatcgtgccagtgcactccagcctgggtgacggagcgagactctatctcaaaaataaataaataaataaataaataataaaatagaacactaactagactaataaagaagaaaaaagagaaaaatcacatggacacaataaaaaatgataaaggagatatcaccaccaatcccacagaaatacaaacaaccatcagagaatactataaatacttctatgcaaataaactagaaaatttacaagaaatggataaattcctggacacatacaccctcccaagactgaaccaggaagaagttgaatccctgaatagaccaataatgagttctcaaattgaggcagtaatgaacagcctaccaaccaaaaaaagctcaggacagatggattcacagcacatttctaccagagatacaaagaagagttggtatcatttcttctaaaactattccaaaaaactgaaaatgaggcactcctccctaactcactttatgaggccagcatcatcctgataccaaaacctgtcagagaaacaacaacaaaaaataaaacttcaggccaatattcctgatgaacatcaatgcaaaaatcctcaataaaatactggcaaacagaatgcagaagcacatcagaaagcttatctaccacaattacgtaggcttcatccctgaaatgcaaggctggttcaacagacgcaaatcaataaacgtagttcatcacataaacagaactaaagataaaaaccacatgattatctcaaaagacacagaaaagcctttgaaaaaattcaacatcccttcatgttaaaaactctcagtaggctgggcgtggtagctcacgcctgtaatcccagcactgtgggagaccgcggcaggcagatcacgaggtcaagagatggagaccatcctggccaatgtggtgaaaccccgtctctactaaaaatacaaaaattagctgggtgtggcggcacgcacctgtagtcccagctactcgggaggctgaggcaggagaattgcttgaacctgggaagcagaggttgcagtgagctgagatcacgccactgcactccagcctggtgatggagcgaggcactgtctcaaaaataaataaatacaataggctgggtgcagtggctcacgtctgtaatcccagcactttggaaggccgaggctggtggacgacaaggtcaggagtttgagaccagcctggccaacatggtgaaatcccatctctaccaaaaatacaaaaaaattagccgggtgtggtggcgtgcgcttatagtcccagctactcaggaggctgagagagaagaatcacttgaaccggggaggtggaggttgccgtgagccgaggttgcgccactgcactccaggctgggcgacagagcgagattccatctcaaaaaatcaataaataaaataaaataaaaactctcaataaactaggtattgatggaacatatctcaaaataataagagccatttatgacaaacccacagccaatatcatactgaatgggcaaaagctggaggcattccccttgaaaactagcacaagacaaggatgccctctatcaccactcctattaaacatagtattggaagttctcactggggcaatcaggcaagagagagtgataaagggtattcaaataggaagagaggaagtcaaactgtctgtttgcaggtgacatgatcctatatctagaaaaccccatcgcttcagcccaaaagcttcttaagctgagaagtaacttccgcaaaaatctcacgatacaaaatcaatgtgcaaaactcacaagcattcctatacgccaacaacagacaagcagaaagccaaatcatgaatgaacttccattcacaattgctacagagaataaaatacctaagaatacagttaacaagggaagtgaaagaccccttcaaggagaactacaaaccactgctcgaggaaatgagagaggacacaaacaaatggaaaaacattccatgctcacagacagaaagaatcaaaatatcatgaaaatggtcatactacccaaagtaatttatagattcaatactattcccattaaactaccactgacattcttcacagaattagaaacaaatttcacaggaaaccaaaaaagagcctgtatagccaagacaatcctaagcaaaaagaacaaaggtgaaggcatagccctacctgacttcaaactatactacaagcctcaaaacagcatgatacttgtacaaaaacagacatccagaccaatggaacagaatagagaactcagaaataagattgcacatctacaaccatctgattttcaacaaacctgacaaaaacaagcactgaggaaaggattccctatttaataaatggtgctgggagaactgactaagccataagcagaaaattgaaactgggattccttccttacacctaatacaaaaattaactcaagatgcattaaagacttaaatgtaaaacccaaaattatacaaaccctagaagaaaatctaggcactaacattcaaggcataggcatgagcaaagatttcatgacaaaaacgtcaaaagcaattgcaacaaaagcaaaaattgacaaacgggatctaattaaactaaagagcttctgcatagcaaaagaaacaatcaccagagcgaacagacaacctaaagaatgggagaacatttctgtaatctctccatctgacaaaggtataatacccagaatctacaaggaacttaaacaaatttacaagaaaaaacccaacaaccccattaaaaagcggacaaaggacatgaacagacaccttacaaaagaagacatttatgtgggcaacaaacataaaaaaaagctcaacatcactgatgattagagaaatgcaaatcaaaaccacaatgagataccatctcacgccagtcagaatgatgattattaaaaagccaagaaacaggctgggcagggtggctcatgcctgtaatcccagcactttgggaggccgcggcaggcggaccacttgaggtcaggaattcaagaccagcctggctaacatggtgaaaccccatctctactaaaaatacaaaaattagccaggcgtggtggcgtgtgcctgtaatcccatctactcaggaggctgaggcaggagaatctcttgaacctgggaggcggaggtggcagtgagcagagatcacaccactgcactccagcctgggtgacagagtgagactctgtctcaaaaaaaataaattaaattaaaaagtcaagaaacaacagatgctgttgaggctgcagagaaataggaacacttttacactgttggtgggaatgtaaattagttcagccattgtggaagacagtgtgccaattcctcaaagacctggaaccagaaataccatttgacccagcaatcccattactgggtatctacccaaaggaatataaatcattctattatgaagatacatgcacatgtatgttcacggcagtactattctcaatagcaaagacatggaatcaacccaaatgcccatcaacaatagactggataaagaaaacctggtacatatacaccatggaatactatgcagccataaaaaggaacgagataatgtcctttgcagggacatggatggagctggaacccattatcttcagcaaactaacacagcaacagaaaagcaaaccctacatgttctcacttataagtgggagctgaacaatgtgaaaacatggacacatcggggggaaaagcatacattggggcctgtcaagggggacgggggagggagagcatcaggaaaaacagttaatgtatactgggcttaatacctaggtgatgagttgataggtgcagcaaatcaccatggcacatgtttacccatgtaacaaacctgcacatcctgcacatgtatcccggaaattaaaaacaaacaaaaaacatatttcaaatcgaatcacttcccaccatatctactggctatctctagtccaaggtctaaccacaatatcttccacctttcaattacacttaaaatctaaaatctgtgggacactacaaaggccgtacatgacctgatccctggctgcctaccctaccactttatccccagccagactctccaggctcaccacactcgggtgacaatgaggttcctgccattctttaatcatactctttctacaaaccctctacatttgctatccctcaactcaaagaatcatctcccagtgtccttcatgctccatttcattcaagtctctactcaaatgttcgtcttcagaaaggcaacagtatccatctttaggctctgcttcccttttctttatggcattcattcctattgacaatatacctgttagatcataaactccataaagtcaggaatttgccacctagattcttacaatactcttgttaagtgagccaagactcaaatactctataatccaataatctcacttcacataaactccctaagagcagggatggttgttttgttgttgttgttgttgttgttgttcattgacgtattccttcagaacaatgcttgttatatagaagactctcaataaactgctgaatgagtacaccctaggggaaaccatactccacatgaccacaaggaggtaaatataaggatgttcatcacagcagcatttgtaatatcaacaaactggaagcagtaagtagaatagataagttatggcaacccttcaatggaatactactacacagcagttgaaatgaatgctagcgttgacacagataagtctcaaaaacacacatcaagcagaaaaggcaagtgcagaatgaaaagcacagctaggtttcaaaacaaaactttgcagtgtaatgtttatgaatacatgcatattaatataagagtgtaaagaaaaggatgaaaagaatacgtatcaacttcaacaaagttacctttggggataaagagaaggaaacagattagaagggaagtacaaaagaggcttaaactgtattatgtttcacttcttttaaaaaatgaaaatgcatgaaaagatgttcaacattactaatcattagggaaatgcaaatcaaaactacaatgaaatgccatttcacacatattagaataactataaacaaaaagacaaaaaataataagtgttggtgaggatatggagaattaagaatggttgtatatttctggtgggaatgtaaaatggtacagccactatagaaaactgtacagtacttcctcaaaatatttttaattatcatatgatctatctatctatctatctctctatctatctatgcatgtctgtgtatatacccaaaaagaattaaaaagagggactcaaacatgtatttgtacacaaatgttcatagcagcaatattcacaataaccaaaaggcagaggcaacccaagtgtccatcaacagacgaatggataacaaaatgaatgtggtatatacatacaatggaatattatttagccttttaaaaaaaggaaattctggccgggtgcggtggctcatgcctgtaatcccaacactttgggaagccaaggcagaggacagcttaagcccaggagtttgagaccagcctgagcaacagagggaaatctcgtgtctacaaaaatatttttaaaagtaagctgagcatggtggtgagtggctgtagtcccagctacttgagaggctgaggtgggaggatcacttgcaaggttggggctacagtgagcagtgatcacatcactgcactccagcctgggctgttagagaccccatcctcccaaaaataaagttctgacacatactacaacattgataaacaatgaagacattatgctaagagaaataagcccgtcacaaaagacaaatggatacctacagtagtcaaattcatagaaacagaaaattaaatggtgggtgctaggggctagggaaactggggaatggggagttactgttgaacaggtatacctttccatttggaaagataaggagatggatggcagtgattactgcccaacaatgtgaatgtacttaatgccaataaactatacacttaaaaattgttaaaacggcctgtaatcccagctactcagggggctgaagcaagagaaccgcttgatcccaggagttcaagactgtagtgtacatgattgtgcctgtgaatagccactgcactccagcctgggcaatgctgcaagaccccaccgctttaaaaaaggtgaaagtggtaaattttacattatggacattttaccacaataaaaaattaaaaacatattgaacattaacatttattaaatatttatgctaggcacatgattgtttgttgtagtcttttccatagttttaatgtatttgaaatgttttcattagaaatacaagccaataataaagacagctttgagggcaacttgaaagtacaggccagcagaaagtcaatttacattactaaaacttaacaaggctgggcattcgtggcccttagcaaggactctaggtccttaaatagcatgttaatttaaaaataaaaaataagtaacaattaaaatgatgaatcactcaactaaaatctctcacacaatgctgagaagaaacaagactaatgatgtgatgagatgatgagcaagatatatgagagtttattaaagaaataaatgcataatccttaaatatatgaaaatgtgcaaattttgttttaagagaaatgcaaattaaaacgacagagatatcagattgaaaagaattccaaagtgtgacaagcctcaatggtgaggctgtaaacaggtaaagcataatgacacaacctctgtggaagaaaacttggcaatatccaacaaaattacatatgtatttaccttttgatccagcaatcccacttctaggaatctatcccaaagatatgctggcaaaaatacaaaaagacatttgtacaaagccattcattgtagcactatttgtaataccaagactggaaataaccctgacgtccatcaataaggaaatggttgaataaatatggtatatgtattcagtacaggttgctgtaaagcaatgagaacaatctctatatactgatgtggaataatctccaaaatatactgttaagagtaaccacactaccaaacagtatttttttttgtatccctattttttgtataagatgggagagaggccaggcgcagtggctcatgcctataatactagcactttgggaggccgaggtgggtggatcacatgaggccaggagtttgagaggagcctggccaacatgatgaaaccccatctctactaaaaatacaaaaattagccaggtgcatggtggcacgtgcctgtaatcccagctactcaggaggctaaggcatgagaatcgtttgaacccagaggcaggggttgcagtgagccgaggttgtgccactgcactacagcctgggtgacagagcaaggctccctgtctcaaaaaaaaaaaaaaaaggagagggagatgtgagtatgaggatatatgtatatacactcacatatattagtttatatttttaaaaatgaacaacaggagaataaattaaaaagtaataaaactggctatatatatggaaaaagagaaagaattagtaatatcaggttgaagttattttattttattttattttattttatttttgagatggagtttcactctgtcacccaggctggaatgtggtggtgcgatctcggctcactgcaacctccacctcctgggtacaagaggttctcttgcctcagccttcctagcagctgggattacaggcgcataccaccatgcccagctgattttttgtatttttagtagagatggggttttaccatgttggccaggctggtctcaaatccctgacctcaggtggtccgcccgcctcgcccttccaaagtgctgggattacaggcatgacccaccgcccggccaattttgactttagaaatatgcaggctcattatacaatttagaaacaattaaattgaaattaaaaaaattctataaatttcaaataaactgaaacacatgagctaactgttggtgggaaaaccacaagaaaacaggattcctttaagtaatgttatttatttttatttgtttttgagacagggtcttgctctgtcacccaggctggagtgctgtggtgcaataaaagctctctgaagcctcaaccaccctggctcaagcaatcttcccacctcagactcccaagtagctgggactacaggtacatgccactgcacctggctaatttttttttttctttttggtagagacagggtctccctatgttgcccagactggtcttgaacccctgggctcaagcaatcctcctgcctttgcctcccaaagtgctggattacaggcgtgagccaccgggtctggcctatgccatattaaaatacaatactctgactataaacaccagtggaatatatttaaaagcaaaaactataaagaaatcttaaactgcacactgtggttgatatctaaaatgttggtattattattttaaaataattagaggacttctataggataaaaacaaagaataatattaccatcattagcaaacaagacatttctaaaagggaagagatacaagcataaaatcaaagaagaaaaaactttgtaaccctgttttatttttgtttgtttgttttgtttttttgagatagagtttccctatattgccccagctggccttgaattcccaggctcaagccacctcagcctcccaagtagcaggactacaagtgcatgccactgtgcccagctaaaaccctgtacttttaaatttacattgtaagtatcaatgtaaaaccattattttctttacttttcaaaagatgtgtattttcatggctgggcatggtggctcacacctgtaaatcccagcaatttgggaggctgaggcaggaagatcacttgaagccaggagtttgaaaccagcctgggcaacataacatagcaagaccccatctctacaaaaattaaaaaattgctggggatgatggcatgtgcctgtgttcccagctacttgggaggctgaggtgggaagatcacctgaacttaggagtttgaggctgcagtgagccatgatcatgccactgtactccaccctgggtgacaaagcaagattttgtctctaaaaaatagaaaataattttaaatgtgtattttctagctatgtctgtaagtaaggcctagaataaatgacaacctagtatcaaattagcactccagcacccagattgtggtctctaaatatcatacctactttaaagaaaaaaaaagctcctcagagaaacagcggattgcaagtttggggggcaggatatgttcaggaggtacttgggaatcttactggtccagaaagcaaggactaactgtatcaaaggtacatgacgtcacatcagaagaacacaggaaccagtctgaaacaactcttgctgctctagaatttgatcatcaaatgaatgatgacagcaatacattcaaactcatcaaatgtatacatatacatatacgtacttaaatacatgagttaataatatttaacacaaaggaaaaatcaacttctgaaatggcagaatgattattgcagtgaacccactctcccataaaagaaccaaaggactggctaaccaatgaaaatcatcatttcaaagtcctaaaattaaccaaaggcagagaacaagctaaaaagcatcaattcaagataagccactaaacctcagttagaagagcaaaatgcgacattttaggttgagactattcccttccctcttccttctccagctcaaaaataaaattttagagctgaaaataacccaattaattaaaaaaaaaccctctatggataagttcaacagcagaatgaagcagacaagaaagaatgagtaaaattgaagacaaaacaacagaaaaaacccaatctaaacaacagagagaaaacattaaaaaaaaaaatgaagagagtctgagggacctgtgggacaataagataagcttaaacccaaaaaatatatacaccagactcaaacttccaaaaactaaaggcaaaaaaaaaaaaaatcttaaaattaacaacagagaaacctctcttttaaagcaaagcgttgcgggtgggaggtgggagagtgtccaatgacagcagatttctcatcagaaaccatggaggccagaaagaagtagcacaattattttctgagagctgaaagaaatgagctttcaacccaggattccatatccagcaaaaatatccctcaacaatgaatggggaaatcaacatattctcaaatgaaatgaaatgaagacaatctgtcactactagacctcctttaaaaaaaagactaacggccgggtgcggtggctcaggcctgtaatcctagcactttgggaggccgaggcgggcagatcacaaggtcaggagatcgcgaccatcctggctaacacggtgaaaccccgtctctaccaaaaatacaaaaaattagccgggcgtggtagcaggcacctgtagtcccagctactcgggaggctgaggcaggagaatggcgtgaacccgggaggcggagcttgcagtgagccgagatcccgccactgcactccagcctgagcgacagagcaagactccgtttcaaaaaaaaaaaaaaaaaaaaaataggactaaagccggcgcggtggctcacgcctgtaattccagcactttgggaggccgaggcgggcggatcacgaggtcaggaaatcgagaccatcctggctaacagggtgaaaccccgtctctactaaaaatacaaaaaatttgccgggcgtggtggcgggcgcctgtagtcccagctactcgggaggctgaggcaggagaatggcgtgaacccgggaggcaaagcttgcagtgagccgagccgagatggcgccactgcactgcagcctgggcgacagagcaagactcccgtctcaaaagaaaaaaaaaaggactaaagccggcgcggtggctcacgcctgtaatcccagaactttgggaggccgagacaggtggatcacagggtcaggagatcgagaccatcctggctaacacagtgaaaccccgtctctactaaaaatacaaaaagttagccaagcgtggtggtgggcgcctgtagtcccagatacttgggaggctgaggcaggagaatggtgtgaacccaggaggcggagcttgcagtgagccgagatcacgccactgcactccagcctgggtgacagagcgagactcagtctcaaaaaaaaaaaaaaaaaaaaaaagactaaagaaaattctctaaatagaaatgaagtgacaaaagagagaatcttggaaaatcaggaaaagaataaatgacaacataaagagtaaaaatactgaaaaatataataaattttccttctctcaagtgttctaaattatatgtttgacagtttaaacaaaaatgttaagcatgtctgatgtggttctcaaaatatgtagagaaaatatttaaggcaattataaataaaagagggtaaagagaagtaaaagtaggtaagatttctatacttcactttaataaaatgaagattgtgataagttatatatatatatatatactataatacctaaagtaaccaccaataagtgctacaagaggatatactcaaaaacactacaaatcaaaatggaattctaaaaaaaagttcaagtaacccacaggaaagcagagggaaaaaaagaacacaggagccagtctgaaagaaatctcactgctctagagaaacaaacaaacaaaagcagaaaaaataaataagcaaaaaaggcagacttgaatccaaacatatcaataattacattaagtataaatggtatacatacatcctataaggccaaaatttttaaaaattagtgtatgctgtgtcaagaaccttatttcaaatataattatacaggcatgttgaaaagaaaaggatgaaaaagatataccatgcaaatgttaataaaagaaagctggaataggtaaatcctagagacagaaagtagattatggatgtcagagtctgggtggaaaaggaaatgatggctaatggtttgttgtgatggaatgttctggaattagatagcagtgatggttggaaaactttgtgaatagactaaaaacctctgaattatgtactctaaaagggttgattttatggtatgtgtattgcatctcaaaaaacatatttcaataaagttttttgaaaaacctcaacaaaaaaaccaatctttattaattaaaaataaaccaattgataatgagccaaagacatgaagagacatttcactgacgaggatatgcagatgccaagtaggaacatgtaaagatgttcaatatcactggcggccatgagggaggtacaaattaacaccaggatgagctgtcactacccacctatcagaatggcttaaacaaaagtaatgacaacaccagatagcagtgaggatgtagagaaactagaactctcatatactgctggtgagaatgtaaaatggcacagccactctggagcataattttgcagttttctttactaaatatgatctagtgattgtgctgctgggtatgtaccccagaaaaataaagtattatatacacaattgttaatagcaacttatgtgttggtaagagccaaaaactggaaacaaccaaaatgtactacaatagatgaatggttaaccaaactgcagtacattcatgactgctcctccacaataaaaaggaacaaactgtcaatatacgcgagagcttggatggatgtcaagggcattattaaagcccatctcaaaaagccatgtactgtgttattctatttatgtaacattctttaaatgacaaaattacagagatggagaacaaattaacagttgcctgggattagggaaagtcaggggaaggaggataggtgtgggagctctttgtggtgatggaatagttctgtattttgactgaggggatggttccaggaatctacacatgtgacaaaatgacatagaattgcacattctttatactaacatcaatttcctcagttttatatcatattatagtaactaatgagagaaactgggtgaaaggaacatgaaatatgtcagtaagtactatctttgcaaactcctgtgaatgcataattacttcaaaataactagaaagtaatcatcaaaattttaatgctattttaaaaaagaagtctgttcaaaacagtttctttttttttttttttttgagaaggagtctcgctctgttgcacaggctggagtgcagtggcgcgatcctggctcactgcaagctctgcctcctgggttcacaccattctcctgcccgagtagctgggactacaggcacccgtcaccacacccagctaattgtttgtattttgtttagtagagacggggtttcaccgtgttagccaggatggtctcgatctcctgacctcgtgatctgcccacctcggcctcccaaagtgttatgattacaggtatgagccaccgcgcccggccttgttcataacagtttcttattttttcagcaaacattattagtagcccctagtgccaggttctctgagaggtacagaagatggcaatgaaaaacaacttaagacttcaaagagcttccagttcagtggtagagaaacagacaatataacacaggcaagtaatataattgtgcatcctagagaataaattctgagaataaaaccaatacctgcatcaagctgctgctccccgttcatttccacagcatataggcaggctatatcctcccaaaacaaaggaaaggcctatggttctgctaggatctgaagattacttgcaggtttcaagcatctgttcaatgggtatccacgggtccaaatgaaagtgctgaaaaatgaaaaagaacacattaaacagcctgaagcccaagtgtgctcactcactcatcaaacagggcactcgactggttgagagatgacataagacaaaaacatactggcagaatagataggactggaggaaaaaattgataccttttctaattttgaagagtctgtatgtgtatgtgtgcgctcatgtgcgtctgtatgtgtagagaacgcacactatcgagatcttgataataaatctaaaactcacaacaaagtaagatgcatatgaatcattaccctttaaatttacattaccatacttagcaccatgattcctatacacaaaactccagttcctaatggtctcctagggagacaggggagttagctttcaatgctgtcttacacaacgaatatgattcaggatagagtattactttatctaattttccatctcatctatctagaatattatgcagatccataaatatcaactgtattagcctacaattataaagagaattcctccaaaataagctttgaacctgcttattctttttttaaaaaacagctttagggctggaagcggtggctcatgactgtaatcccaacactctgggaggctgaagtgagaggattcctttgagcccaggagtttgggaccagcctgggcaacatggcaaaacctcacctgtactaaaaatacaaaaactagctgggtatggtggcgcacgcctgtagtttcagctacttgggaggctgaggtgggaggatggcttgagtctgggggacggaggttgcagagccaagatcgcaccactgcactccagcctgggtgacacagccagacactgtctcaaaaaaaaaaaaagaagaagaaaagctttattgggatataagccacataccaaaatttcccattttgaggtacaaattaataatttttagtaaatgtacaaagtgtaaccatcataattgaatttgagaatatttctattatcctgaaaagaagccaaatgctcacttgcagttccttcctattccatccctaagctcaagcaaccactcatctcctttgtctctacagattttgcctttcccaaacatttcacataaatggaaccatatgaaatgtggtctttcatataaccttggttttctttcacttatcatgtttttgaggttcatccacgttgcagtatggatgaatctatttattcttgctttatatatacatgtaaaataatctaagatattaatctaagatattatcttaatatgtgcctaacagattagaaagagtaaatgaaagggagaagagagctgctacaggaaggcatggcatgaactaactgcaagagcgacaatacagaaaactatagcattgggatgggtacttaacagcacagctttgggagtgatattctgcaggatcaagcaattctatacttctcaaaagttttgagtgtgtattagagcccccagtaaatgattctcataagcaactttaatcatgaagaaaaagcttagcttttaatacatccttataccacttttgcctgaaaaggtaccagctacctaaaggacaatagcttaaaatgggtagggatggccaggtgcgtggctcatgcctgtaatcctagcactttgggaggccaaggcgggcagatcacttgagcctaggagtgaaagaccagcctgggcaacacagcaaaaccctgtctcaaaaaatatatatgaaaattagctgggtgtggtagtgcatgcctgcagtcccagctacttgggtggctgaggcaggagaatcgcttgagcccaggaggctgagggtaaggctgcaatgagccaagatcatgccactgcactccagcctgggcaatgagagtgaaatcctgtctcaaaaaaaaaaaagtggggaggtaaggaaacctaggttctagtgccagctctactgataactagctatgcaatctgatacgctaccgtattatgtccattttttatctataaaacaaataaagatctttttcagattttaaattttcatttcataatgagcgtagaaaacgttttgataactattaaaattgtggacatcccacttgagataaatgccaattatcccaaatcgtatcacagaatataagcaccgaaacccacactttcaaagatgggaacaattgaaaagaaacttgagagtgatgtttaaggcttctaaatgtgctctcttccctcagtttacttttctaccccaagcccaaaacatccaaactgtatcactccacctaccaatttattcatccccatatacttatcaaacaccagctccttaccaaccactactgtaggggtggggtaaagtaatcaagagagatatggttcctgctttcatggagcttattttcaactgcagggagacaaattaagccaacaataaaaaaattatttaaattgctagcaagtagaagtactagatgataagaaagaatataaaggcaggtctaacctaaggtcactgacagtgtccctgagaaaatgatacagcagctaggcaaaagggggagaaaaggaggactattccaggcaccaagaacagcataaaccaaggctctacagtgggaaggacctgaaggctgctgtggctagagcatgcaaaccaacagaataagtggcaaataaaagactgaacaggaagagaagggataacagcaattaatatttactgaggactgcctacgtgctggggcactgttttaagcaggttgttgacaggttcaaatttctatggctctaatttagtggataatctccacatataaagtcttgacacttcagcatggttttgatagaacgaagtcagtgctaaataaatatctgttgggtcactaggctttgaagatgtcatctactgtttatgttcatgagctcttggaacatgctagagtattttgtgcagagagccacaaagtacaaaaataataatgaagcttcaaagccaaaaggcattaagtggagagatgcaagtcttacgtagcagaaagctaaggctgtgacattttttcaaccttacatcaatcatttagattttagccaatgagcaatcagttcatcatcttaataggatcacaagaaatagactgatgaagtcttctgctgtggaacatctgttcacgctctctctttattgttagcctgctgtcttttcatgcagtaaagaaaaaacggtaaactatccaggcgcttagtatatgaaaatttaattcacttttcctttatttcctgttcatattaaattgtcttactgtcatcatttattttatcatttattttggtattatcaccctcttgtagtgaacagaacacactaagagttactcatttaaggcctggtgaggtggctcacgcctgtaatcccagcactttgagaggccgaggcaggtggattgcttgagatcaggagtttgacagcctggccaacgtggtaaaaccccatctctactaaacacacacacacacacacacacacacacacacacacacacacacacactagctgagtgtggtggcgggccaatgtggtaaaaccccatctctactaaacacacacacacacacacacacacacacacacactagctgagtgtggtcgcgggcacctgtaatcccagctatttgggaggctcagaagagaatcgcttgagcctgggaggctgaggctgcagagagccaagatcgtaccactgcactccagcatgggtgacagagcgagactctgcctcaaaaaaggaaaaaaagaaagagttattcatttaaataagtacttataaggctgggcccaatggctcacccctgtagtcccagtgctttggaagcctgaggcggaaggatctcttgagcccaggagtctgaggttaccatgagcaatgatcacaccactgcattctagcctgggcaacagagacagaccctgtctcaaaaattaataagtaaaaataaataaataaaagtaaaaataaataaattctcatgaattaactgatctggatcttactcatcttatttaatactttagtgaactaaataggtgcctagatatttggagggggttctaagaaaatatactgaagcttggagaaattttaaatacttctaagaaatataaataaaaattgaaaaggcaaagctaattggataaaataagctttcaagacaaatactaaaaaagaacaacaactaaacccaggcagaaaaatcaaactgaatagctatttcatttttaagtggtacatcaatataaaataaaactaccatggaattttaacaggtttttttgaaagacctaaaagtcatctgaacaacaaatatgttagacaaaattttcccctcccatcttggtggggtttttttacacacagtatcactgtgttgcccaggctggagtgcagtggcacaatctcggctcactgcaacctctgcctcccaggttgaagtgattctcctgccttagcctcccaagtagctgggattacaggcatgagctaccatgcctggctaattttgtattgtggtagagaccacgttggccaggctggtctcgaacccctgacctcaagtgatccgcctgcctcagccctcccatcttgttttatattacacatacaagtccacactctaagcctagtagtagtaacctggcttcatgttaatgccctttcttttcaaggctaagataaacattgattaagatgagtgattacatggggaagttgcaataatgcaagaaaaatttctgtgggaagtatcctcagccaaatgatttaacatgtctgacataagtaacttttaaagggcttagaaaggacaggacctcagggtggttctaaagatcactgatatgttcggtggctggaaaaacaaaacaaaacaaaacactttaattcaataaataccaggcagttagcaagaaaattcctattgaaatgtttgaatttgtacacttatccctcaacagaaacaagtccaacaataatttcgagtatgttgttaaatatactaattgcaacaattcagcaaatcagatgctccattttcagcagatgtgcaaagttaactctgaccctgacagtgcagtcagtggtagagtcaccttatatttcctgttcccattccccaacaggtgtagttttctgtcagcctttcactcttactatagtcaactgtaactacatgttttatttgtctatctaaattaaacgttgtccttccatttgtcaaatgccaacataactcaggggcagaaatcttctattgtttcattaagttgtttgttatgtcatttttattcttttaacccactgctacatgtctgactagagagattaaaaaataaagtctgataaagtcaaggttttagttcaattttgcgagaaaaatcttagccactcatatcatctaaattaaatctgaggccaggcacggtggctcacgcctgtaatcccagcactttggggggctgaggtggcgaatcacttgagctcacgagttcgagataagcctgagcaatatggcaagaccctgtctctataaaaagtaaaaaaaaaaaaaaaaaaaaaaaattagctgagtgtggtggcacatgcttgtaatcccacctactcaggaggctgaagtgggagaattgcttgaacccagggcaaaggttgcagtgagccaagtttgcgccactgcactccagcctgggtgacagggcaagaccctgtatcagaaaaaaaaaaaaatctgagccaaaccttttcatgattttataaacccaacacagggcaaatccatctcagttgaataaactggtactaataaatttataaaaccactgaaaaagttctaaacaaaacccaaactcaagaataacctaaactggaaaaaaagaaaacaaagaaagtgaaactgtggagccaatatttttaaagattttggacaacaatgagaaattgttaagtaaaatatagcataagcatacaatgcaccatacatggccattggaaattgtgttagagaaatggttttcttctccaaatcccaatagggcattttttttcttctgattctatggttgacccaataggccactgtatttgacttgataagataattttagaatgcacctaagctgggcatagtggctcacacctgtaatcccagcactgtgggaaggcaaggcgggaggatagcttgagcccaggagttgcagaccagcctgggcaatatagtaagacctcatctctacgaaaaatttaaagaaccaaaattagctaaacgtggtgacacatgcctgtaatctcagctactcaggaagctgagaatttttttgtttgtttgttttgagacagtctacttctgttacccaggctggaatgtagtggcgcaatcccgttttactgcaacctccacctcccaggctcaagcaattctcgtgccttagcctcctaagtaactgggattacaggtgtgtgctaccacgcccggctactttttgtatttttggtagagacagggtttcaccatgttggccaggctggtctcgaactcctgacctcaggtgagttgatctgctcttgcctcagactcccaaagtgctgggattacaggcatgagccacaacgcaaccagccaggaagttgggaattgcttgagtctgagaggcagaggctgtaatgacccaagatcatgccgccgcactccaacctgggtgatagagcaagactgtgttccaaaaaaacaaaaaataaaatgaaatgcatctaaaagagaaaaaaatggacaatccagctacatttttgtaaaacatgacacaaggcaagttccttctatcaaaatattaagccagacacagtggctcatgcctgtaatcccagcactttgggaggccaagacaggaggatcacttgaggctgggagttcaagaccaacctgggcagcatagtgagactccatctctacaaaaaaagttttttctcaaatcaaaatagtgtaatattagcataagaaaagacaaacatcaataaagtaaaataaagttgaacaaaatagatcaatttttatgagagtgcagtttgtgataaagagagcattccatataaaatcgtgaaaggatacaaacaaatagtgttaaagaattggctatccattttgggaggaaaaaaaattagaaccttactttatgctgccacataaataaattccaagtgaattaaaagagaaaaacatgaaaaagaagattccaaagaaattaaaagaaaacatacgtgaatatggttatagccttggaatagcatagatttccttaagcaaggaagccataaaatggatacatttgactaaataaacatttaaaactttcaactggcaaaaagaaccataaacaaatttaaaaaacaagctacagaaaaaaaactatctccagcgtatatagcagacaaaatattaatagccataataacagcacctattagataaataagaccaaacctaataacatggacatttttttaaaaggtcagatatgaacgataattgtagggaatgactggtaatcatatgaaaacatattcaacctcaacagctaaaattttatttttcacccagattggcaaaaacaaaagattagtaacactgaatatagttgaagacatgcagaaatggaagccgtcattatcagttcaggagcacaaatggatatagcccttttagacagaaattttattctatcaaaattttaacttgcattctctacaacccaccagttccacttccaatacatttcagaaaaatatcctgagacaacaagcaaataaatagcacaacaatttcaaagaaagagtttaaactgtcctcatttcagggcatacacagagaaacatccccatgtgtacaaagtagcaagaaccaaaatgtttgcttgagcaatgcctgtattaagaaaaaactggaggctgggagcggtggctaacgcatgtaatcccagcactttgggaggctgaggcaggtggatcacgaggtcaggagttcgagaccagcctgaaaaacatggtgaaacccagtttctactaaaaatacaaaaagattagccaggcctagtggcgggcgcctgtaatcccagctactcgggaggctgaggcagaagaatcgcttgaacccaggaggcggaggttgcagtgaagcgcaccactgcacttcagcccaggcgacagtgtgagacttcgtatcaaaaaaaaaggaaaaagaaaaagaaaagaaaaaactggaaacctcagggtcaatcaatacataatggcacatccacaagatgaaagttaaaaagagtaagacagcttagtaagcataaagttcatgctggggtgatgaaataagctttggatttggatagtggttttatatagatgtatacatataacctatatctacataaaactgaacaaaaacaaaactacgtatttctataggcacacatatatatgtgcagatacctttaacgtggtcaggaagaatacatccaaatcattaacaggaaagtgagattcaggggcagggcaaaagggagtgtttcttttaacagtattgggtaaactttttaagataaaaatgtactcatatgtttacttcagtgatttaaaattttaagacaaaaaatgcatttattgacatggaaagctatttattcattctttcaataaatatttactggaaacttattatgtgtcaggcacaataaaaaaaaattagagatatatcagtgaagaaaacagaccaaaatctctgccctcatgaagcttatattttagtgtaaggaagaaagtataatactttttctaaatgtcataagtgatagagctggggaggaatgacagtgtggggtggttaaatcgggtagagagaaaggaggtttcactgagaaggtaacatatggacaaagacttgagggagctacagaaggaaagagcatgccaggcagagggaaaagccagcagaaagggcctaaagggagagcatgtgagagtgagctatgttctaggaatagcagggaggccagggtagttggtgccaagtaagcaagcaagaacaagtagaaggagaagaggcaggagagaggtcaacttcacactgcctgccactcccatgtacctctgtgagtaccccccacctacagcccttaaggaactatacttaccaggtgaccctactcctctgggggtaacaaaacgtaaaggcaatgttggtgggaatgtaaaatgatgcaaccacctgggaaaacagtctggcagttcctcagtgttaaacatagagttaccatatgggccagtatttcactcctcaatatatacccaagacatttgaaaacatatgtccaaacataaacttgttcatgaatgttcgtagtattatttataatagtcaaaaaatagaaacaaatcaaatgtatcaaccaattaatggttaagtaaaatgtaatatatctaatataatggaatattattcagccataaaaagaaatgaagtacgaatacatactacaacaaggataaccttgaaaatattgtacatgagaagatagacactaaaggccacatattatacgcttccatttatataaaatgaccacagaggcaaattcacagagacaagtgggtagattgtggttgccaagggctggtagagaaaaggtaatggataacgactactaatatgtacagggttgcttttgggggtattaaaacattctaatattagactgtggtgagagttgtactattctgtgaataaaaaaactgtaaactttaaataagtgagttttatggtctgtgaaatatatctcagtaaaactataaaaatggtacttatattcaaggacataactgtgcttttaaataacatttcaaatacagaagccaatgacaaaaaaaaaagagacaagatatctgggttacccttaggatatgcaacagaaggagaaagaaaataatttggctgttactggtttgtatcagttaaggtaatgttatgctttaacagataaatttctattttcaattgcttaatccaacagatatgtatttcccactcagatgaagtccaaacaggtgttcctaatcagtaggcaactctccaccatgtgattattcatgaagccaaaagccttccgccacatagctctaccaccttcaacaaagtcttcacaaatcattcactgtaggggatcacacatgggaggttttcatgggacagacctaaaagtggtacgtcccttccacccacattccactaattaaaatccggtcacaagaccccatccaactacaaaggaagctgcaaactacagtatggcacttcccaccattagtaacagagtgcttaaattagtattgccattcaccagaacttatattaacagtgaatagcagttattctacttaaaggaggcttcatgaatcaatagtagtgatactatgaacagtcatggaattctgtcaataaatatttactgagcacttattatcgccacaccacatttgttctaggtgaagaaatattttgaaacctgccctcacgaatctcataatctaaagtgtgtagatagccagcaataaaataaatacaactgagccttgaacaacatgggcattaactacatgggtccacttacagatttttaaaaataactatcttggaaaaatttttggagatttatgacaatttgaaaaaacttgcagacaaaccatgtagcttaaaaatatcaaaaaattaagaaaaaggtgtgttgtgaatgcataaaatacatgtacctattagtctatcatttaccacttttatatacaaatctattattaaaagttaaaaaatatcaaaacttatacaaacacagactgtacatggtgtcattcccagtcctgagaaatgtaaacaaacctaaagatgcagttttacatcataactacacaaaattaagtgtagtacatattgcatcatttgcaatatgaaatcattttgcagctatctcctgttgctattgccttgagctcaagtgttgcgactatctccgtaaaatgctgtatgacactaatcatctccacgtgggcaattcgtctctccagtaaaatgcataaataatatcacaataaaaagtgatctcccatggttcttacacatttttcatgatgcttagtgcagtactgtatttaataacaccgtaagacccatagaaagtaccgctagagatgctggacgtgctttcaagaagcagaaagaagtggtgacattataagaaaaagctggattgcttgatatgtacaatagattgaggtctacagctgcagctgcctccatttcaagataagtaaatccagcacaaggaccattgtttaaaaaaaaaaaaaaaaaagcaaaggaaatttgtgaagccatcactgcagctacgccaacaggtgcaaaaacctcgcattttgtgtgaattatgtttttatctcatgttgaaaatgcagcttttatgtgggtgcacgactgctgtagaaaggcatacctataaactttcatatgatttgagaaaaagcaaagtcattatatgacaaagcaaaagaaaggtgaaggagtccggtcgcggtagctcacgcctgtaatcccagcactttgggaggccgaggcgggtggatcacctgaggtggggagttcgagaccagcttgaccaacatggagaaaccccatctctactaaaaatacaaaattagccgggcgtggtggcacatgcctgtaatcccagctactcgtgaggctgaggcaagagaatcacttgaacctgggaggcagagattgcagtgagccaagatcatgccactgcactctagcatgggcaacaagagcgaaattccatctcagaaaaaaaaaaaaaaaaggtgaaggatctaaagctggaggatttaatgccagcaaaggatggtttgataattttagaaagtggtttggctttaaaactttaggaggagaagcagcttctgctgaccaataggcagcaaatgagttccccaatgccagttaagaaaatcattaaggagaaaggatttccacctgaataggtttctgtggaatttttttgagacagggtcttgttctgtcacccaggctggagtgcaatggcatgagctcggatcactgcaacctccacttcctaggctcaagcaatcctctcacctcaacctccctagtagctaagactacaggcatatgccaccatgctcagctaattttttttttttttttttttttacttttctgcagagacgaggtctcactacattgagcagactagtctgaaactcctgggctcaagcaatcctcccaccttggcctcccaaaatgctgggatttcaagaatgagccactgcacccaacctgaacaggtttttaatgctgatgaaagtgctctattttgggggaaaatgtgctacaaaggacattaattagtaaggagaagaaagtacccggatttaagggaggaaaggataggctaacttgactattttgagcaagtgcagttaggtttataatcaggacagcccgctaacccccacgcctcgaagggaaaagataaaagccagctgctagttttttggttgtacattaaggcctggacaaaaagaaccctttttctgaactggttccatcaatgatttgtccctgaagtcaggaagtaccttgccagtaagggtctgctttttcaagttcttttgatatttgacaatgcccccaagccacccatgagttcaactcaccccatgagttcaacaccaaaactggtgaagggcgtctacttgctcccaaacacaatgtctctaattcagtccctagatcaggagctcataagggcctttaaggctcattacacacattcctttatggaaaggactgtcaacactatgcaagagaaccctgatagaacatcatgaaagtctggaaggattacactattgaagattccattgttatagaaaaagtcctgaaagccatcaagcctgaaacaatagactcctgctagagaaaattgtccagatgtcctgcataacttcacaggattgacaacagagccaatcacaaaaatcatgaaagaggttgtagatacggccaaaaaggtcggaggtgaagggttaagatatagatcatgggccggacgcggtggctcacgcctgtaatgccagcactttgggaggctgaggcgggcggatcacttgaggtcaggagttccagacaggcctggccaacaaggtgaaacgtcgtctctattaaaaatacaaaaattagccggacatggtggcatatgcctgtaatcccagctactcaggaggctaaggcaggagaatcgcttgaacccaggaggcggaggttgaagtaagctgagatcgcggcactgcactccagcctgggcgacagagcaagactcccatctcaaaaaaaaaaaaaaaaaaaaaaaagatatagatcgtggagaaattcaagagctaatagatagcacaccagaggaattaacagaagacgacttgatggagatgaataattccaaaaccagtgccaataaagaagaagatgtagaagaagcagtgccagaaaataaatcaacattgacaatctggcagaagggtttggattactcaggactgcttttatgacaagatccctctatgatatggcactgaaactaaagcaaacagtggaagaggagttgataccatatagaaacagttttagaggaaggaaaaagcaaacattcagacagaaactataatgttatttctgaaaagttacaccacgtgtacctgcccctcttgccttcctttctgcctcctcccctcttccacctgtggcaccctaagacagcaacaccaacctctcctcttactcctcctcagcctacccaacgtgaagatgacaaggatgaagacctttatgatgatccacttccactcagtgaagagtcaatattaatatattttctcttccttatgattttctttgtaacattttttctccagcttactctattgtaagaaaacagtatgtaatatataacatataaaatacgtgttgattgactgcttatgttattgtggtaaggcttctggtcaacagtaggctattagtaaagtttttgagaagtcaaaagttatatgcaaatcttcaactgcgtgtggggtcaacacccctgtgttgttcaagggtcaactataatatgtatgttgaatgaaaacaaatgttaggagaaaaaaactgaacaagggaggaggacagggagtcctacttttaacagagtgatcaaagccttagtgttgaggtaacacaaaacaacaccagagggaaatgaggaagtgagccatgtgggtacgtgcggaagaatattcaaggcagaaaaacaaaaagagcaaagtctctgaagtgggagcttgtgtggcgtatttgaggccacagtggttggaacaaaatgatcacagcagagatgctaggagatgaactcaggaagctatcagggagtcatattttatatgaacttgcaggctgctgtgaagattttggctttggggaagccattgaaggattctgagcagaggaggaacataatttgatttatcttttaaaaggatcactctgcagctatgtgagaagaaagcaagagcagaagcaggaagaccaactaaaaagaccacagaataatccaagtgaaaggtgttggtggctaggtctaggacaggagaagtgaaaatgtggaggaagatgtaagatggatttggtgtatgagagaaagagcagtatctgggctgactgaagtttctggcttaagcaactggaaggatagaactgccacttatggaaaaagggaagtctgaagtaggaatggtttgaggaagaaaaattatgatgagcttcagtgcaaaatagggcaatatgattacttccctcaccactaaaggtttgttcttggagttttcaggaaaatgttttcaatcaacaaaagtataattactatctgtgtagtgtctccaatttataagctttttttcacccacgatgcttcatttgaacatcataaaaaacttttttagacagcaagaatggggccaattctttttttttttgccccttgggaacctccttgttggcttcaatcccatcttacatttcacgttctctaggtttaccaatcagccttgaaggcatttccccatagcaattcagtaatttatgctgccttgttttttaacattccaatttcaacacccacatactttccaatacaggcacttcaatgacaaattttctagctttctttaatgtatgtctttcaataatctcaggcataaataatctttaaaaattcatactataatgaatactatattgaatataggtaatatatattattataatatatactgaatactatactaaatactgtgtgtgtgtgtgtgtgtgtgtgtgtgtgtgtgtgtgtgtgtctattcatactataatgattcatactataatgagtttggaaatatcaggctgaccaccctataaatccctggtccacagttggctaagtatgaccacttcgcagcccggcttccttagcaattactgattagtaccaggatattgagcacctcctctttgccagataccaagacgactaaattgcagttttgaaattatctttcactgtaccagaatatgtcaaaagcatttaaaatcattctttatccttatattatcttataggctggaacggtagctcttccagagttcaaatatgattacattttcatcaattaaatgctttatttatgggagccagtaacatgagcacatgttgaaacagtatgtctttgttctgattaaatcaggagctatttgattcaccaacacaagcactgtcaaaacataccaattccaatagtattataaaaagattataggaaaagaccatgttcagttatgaaaagacttgaaattattctgtaatttcatggttgctgtttctcagctttctcatgtcaagtcacagatcagaaacttcatctcaacagaacaaatgcttgttaaccatttatcaagaaaaaagaaaagattatttgagtacctactatgtatgtgcctggcactttttatgtattgtatactaaataattaggcacacagaacactgtccaacacatggtaagcttaatatttaagtgtttattattttttaataatcttttatttaatcctattctgcttaactcatacaatgataattccattttacagatgaggaaaagttaacatgtcagttcatacacagtcatgcatcgcttaataatgaggatatgttctgagaaatttgttgtttggcaattttgtcattattcgaacatcatagggtatacttacgcaaacctagatggtgcggcctactatacacctaggctatacggtgtagcctattgcccctaggctacaaacctgtaggcaactgtaacacaatggtaagtatttgtgtatctaaacatatttaaacataggaaaggtgtagtcaaaatatatcataaaagataaaaaatgaggccaggcgaggtggctcacgcctgtaatcccagcactttgggaggccaaggtgggcagatcatttgaggtgaagagtttgagaccagcctggccaacatggtgaaaccccgtctctactaaaaatacaaaaattagctcggtgtggtagtgggcgcctgtagtcccagctactcaggaggctgaggcaggagaattgcttgaacctgggaggtggaggttgcagtgagctgagatcatgccactacacttcagcctgggagacagagtgagactccgtctcaggaaaaaaaaaaaaaaaaagataaaaaatggaacacttatatagggcacttatcatgaatggagcttgcaggactgggaagttgttctgggtgagtcagtcagtggtgagtgaatgtgaaggcctgggatattactgtatactactgtagactttctaaacactgcacatgtaagccacattaaatttgttttaagaatacttttcttccttccataataaattaaccttagcttactgtaactttataaactttttgatttttaaaatttttttgactttcttgtaataacacatagcttaaaatacaaacactgtatagctgtacaaaaatatttttttggtcgggcgccatggctcacgtctgtaatccaatactttgggaagccgaggtgggcaggtgacctgagatcaggagtttgagaccagcctggccaacatggcaaaatcccatctctactaaaaatacaaaaaaaaaacttagtcgggcaggcatggtggcaggtgcctgtagtcccagctactcgggaggttgaggcagggaaatcgctttaacctgggaggtggaggttgcagtgaaccgagatcgcgccactgcactttagcctggtgacagagcaagactctgtctcaaaaaaaaaaaaaaaattagcagggtgtggtggcgagtgcctgtaataccagctactcaggaggctgaggcaggagaatcgcttgaacccgggaggtggaggttgcagtgagccgagatcgtgccactgctctccagtctgggcgaaagagtgagactccatctcaaaatatatatattttttctttatatccttattctataacttttttctattaactttttatttacttgttaaaactttttgttaaaaactaacacaacagcctaggactacacacgaccaggatcatcaatatcgttgtcttccacctccacatcctgtcccactggaagatcttcgggagcaataacatgcatggagctgccatctccttgataacagtgcctccttctggaatacctcctgaaggacctgtctgaggctggcttacagttaatttttttttaataaataaaaggcatatactctaaaataatgatttaaaagtacagtaaataaaccacagttatatattatgatcaagtattatgtactgtacataactgtatgtgttatgcttttatacaactgccagtgcaggtttatttacaccagtaccacaacaaacacgagtaggtatctcactatgactttaggatggctactacatcatcattaggccataggaatttttcatctccattataactgtatgggaccaccgtcatatatacaggccaccattgactgaaacaccatcatgccatgcatgactgtagataggaagcagcaggggcagcatttgaaccctcatctgatcccaagcctgagctccttagtgtttctgggctctggggcttttcttggagctcagagaatacaaggataattgtgaggtatgtcttataccatagagtgatggccctagatgatctgcgctcaagttgttttattcattcattcatttaacttctaagttccatactgttctgcttagaatggtgagtaaccaagagtctggatggcacctagacagatgctgccatctataagcttctaaaatcttattctagtagggccctaaaacagattaattcatatgaaaggatacagtacacatttttaaattaaaacacatttccttattaattctttaatggaatggaataacactgaattaagaatggaataacactgaatttagccaaaaggctaaaaaaatcagtgtaataaacagccatcatcaaaaatgtcagaatcatcaggaaagcataaaaaacaaagtctttccccaacggagtaacaggctctgcctcaacccagaagagagctgaggggaagttatagtggttgacttagagagacccttgggaggtccaatcactcaccaaactttaactcgtgattataagagaggatgctctggggattttgctgctttgtattgttacattaaacatacaagcatttttaaaagctctatgttagaatttaaagatgcctagactatagacacatatgctgtacaattaattcactggaattttttttaagtttaaggccctataagaactagattatcagttataaatattgagaacttttggataggctaccacccctcaaaaatcacgacaggcaaccatacaggtcagtccctcaagaacacctcaagaacctgtccctcaagaacgcctcccaactccagggtaatgctgctgcgagggtatcctcggggaaacacaatggtgaatgtctgctgcaaaacactgagccaatacctaagaggcatgctgaacatttaacaacaatgatactaggaacaagtattagttatttagaaaaagtataaattatttagaacacaaaacaactcttcaggagcttttaaagtaagtgcttccaaaaaaggagtaaatctctggttactactagagatgtactacgtaacacattaaatctgtaaaataatttggcacaaaaagttaaatggacatgaggaaaaaaaccagcctaggttatgataattaattaggaatctaaacagacttatatgcaagatgtaaaaccaaaaccctaactggcagaatagcagtctacttacttacctgttatttccaaagcgcagcaggacacttggcagccttctgtttggttagtattagaccctagtcacaccttaatagttgtttttatagatttcagtacccccacacctttcaatctaacatatgtaaacattctctgaaaaccaaaagtatctaatgttaaatatatagaaatttttggttaaatctctacacctgttaaacagaaagattcctcttcctgatttcttttctccacttttctattctttccttaaaaataatttggtttctttcctaccactaaattattattttgtgaacttaaatgcaatattacaaaggtggccagttttctaagattaggacttaccaattccactttacagtgcttagtacaaaattattggtataattttcaatccttaataatactatgctactaatggtcatgttttcatgtgttataagaaacatgccttttgggaggctgaggcaggagaatggtgtgtgaacccgggagccagagcttgcagtgagctcagattgtgccactgcactccagcctgactccatctcaaaaaaaaaaaaaaaagaaagaaagaaagaaagaaagaaacatgccttccataaaactattcctactaatgttcatgttttataagaaaaaaataaggccaggtgtggtggctcacacctgtaataccaacactttgggaggctgaagtgggcagatcacgaggtcaggagatagagaacagcctggctaacacggcgaaatgctgtctctactaaaaatacaaaaattagctgggcatggtggcgcgcgcctgtagtcccagctacttgggaggctgggagaattgcttgaacctgggagacagagggtgcagtaagccaaggtcacgccactgcactccagcctagtgacagagctagactccatctcaaaaaaaaaaagaaaaagaaaaaaatagtgtttacataatgtataacttctttcagccttggacaaaactatcattgaaacagacgtctgaagtcatccaaacaggccgacaagaatttaaaacttcattatttgcaaattaacaacgaaaaaggtaggcttaaggcagacaattggttactaatgtctccttcaaagggaaaaaatttccagcaccatctactaaaactgttcggatatattccaaaggctagttgtcttttaggatttttcttgggaggggttgttcattttaattgttgcatttaaaatgttcaaaaaataaatgggcttagttggtcaaaacacaaccactcactcaggaaaaacatcatcataaaggtaaaaataactcaaagcatacacccgaagtcattaaaaggtttttcctcagttttctcttataggatgtgagataaatgcagtattattctctattaaagtataaaagacaactcgactcagttgtctaactcacattaaattcctccaaaatggtattttgaagagtatcacaggctcagccacatcaagtttggaattttgtgacacagagtcagatgacagaacactcagtccttcctcacttggaaacaaaaaccaaatgcttgaagagacttaatgtcaaatctaactatgcaaagtcttaagtttacttcaatttcatctcaaagcaatctttaaagaaaaaaaatcaataagccattcaaacaccagaatactacttttctcggaatctttaacaaaacgtcaaacaaattcagactgttggactgttaaacttcaaagagccaccttaatattttgaaaacatcaagaaaaagttgagcaagaaagagaggaaagggagggagagaagaaggaaagaaggatggatggaaagaaggaaggaaggaaaagttttctcaactttaacaaatactattatcaaagctaaggagttttggccttgggaattcagatattacgcataaaacaaggaaataaacctaatgaacaaacattactactatggggtgatgtcaaccttgcaattttggagagagattaatgaagtggggtgaagtataaagagaataattttttcacttcaaatgatgagtaatgaagttcaacatataaacattttttgtttgctcattttttcccaaataactactttacacccacattactgtctcatttgcaaacgtctgcatagtatcttcagcaactatacctagcactgcatttttacatacattaagccagctgcctggatgattttttaaaattgctctttgtttcactgaataactgaggctggtgactctaaaagttagagaaaactttaataagtaacacccagtccaacagtcctcaacagttctgttgtacacaccattcccatgtgccaacatttcctcaaataacagctctccattaccctacagtgcttttctagagaattcttccctacctgctgtggtttgaatgttgtgtcccacccaaaattcacatgctgaaacttctttttttttttttttttttgagatggagttttgctcttattgcataggctgcagtgcagtggcacaatctcagctcactgcaacctccacctcttgggttcaagcaattatcgtgcctcagcctcccgagtagctggggctacagggaggcgccaccatgcctggctaatttttgtatctttagtagagacgggtttcaccatgttggccaggatggtctcgaactactgacctcaggtgatccgcccacctcggcctcccaaagtgctgtgattacaggcgtgagccacctcgcccagcctgcacgttgaaagttaatccctaatatgagagtattaagacgtgtggcctttcaggaagcgattggatcaatgccattataagaagcttctgagagctgcctgccccttcttgctttcacattcccttccaccttctaccacatgaggatgcaccatcaatgaggaatggcacctccccagacactaaatctgccagcaccttgattttggacttctcagactccagaatagtgagaaaataagtttctattattcataagttactgagtctcaggtgttctgtcatagcagcacaaatgactaaaacatcatccatccccgaggaggagattgtccatttctgtgttccaacaccatcaatgacacagggataaaaaactcccacgactaccttctaggataatctattccacttctaagcagctccgccacaaagcctgtccttaacctgctgcaaagtccctatggcttctgcccattgctgttgcccactcagaatgagtctgtgttcattcactcacacagagcccttcacatagctgagagaactaacgttcatcaactgttcttcctaagcaggtcctgagctgcctcaccttcctagtccctcctctaaaatacattccagtttatctgtagcccaaaacagaatacaaaagaataaagtattgtttataatacaaagggtaagtgtttgaggatggacacctctattttacattacgtgattattacacattctatgtctgtatcaaaacatctcacataccccataaatacatacacctctatgtagccacaaaaattaaaataaaaaaaatttttttaataataaattaaaatgttaaagtgattttgatttctgctttatatcgtgtatttctgtgactaggccaaacaggtcatgggtaaatctgctcagttaattagactttgatattgagctcttggtaatcagtcttaatggaacaaaaactactccttcctcagtatgtttccttaaactaaccaataatttcataaaagcagatcatctttcagaaggaaaaactaagggaaatcataggtgggttagcacactccacaatgtaaaggaaacaataaatatacattcccatgcaaaattcaattctctctcttcaaaactaccacagcattttgtgggaccctctagaagagcatttcacctggagtgattcaggcctacctgctcctcagggtctgggccccaccttcatctttctctatgattttacactgtgcctgacagtggtgagcttgcaacttctgtctgaatgaaactgatcaggagtagttctggcagctatttagatagaattggagtctcagcactcattatttatcatactcatcctttaatttaaaagagggccaagaaaaccaaattatttaaagatttcccaatttctgaaaatataatgctgtatcagttgttttttttttaagcagctcaaaaaatagcacatagagcaggtaaaaagggtaggaaaaatttttttctatgcaaaagccttaacatttataaacttcaaccaaatccctataaaaaacatgtagtttttgcactgtgtagtccatatgctaaatggacatgtttagttacatgttttcttgagcagtactttttatttgtagcaaagctattacatcttatacattatattacacgtaaaagtccattttaaaccaaattacttcaaaatttgacctatattacatctggcacagactagctgttctgctatactgtttaaatgcctgctatattcgcagcagttactttataaaacacataatctttatgtgctagcagtaaatttctatacctttaagggataattctaggctaatcaattagtataccaaccttccctatccccgaccccattcattcacttggccctgaccatgctaagcatctgctacatataactcctagtaggaggtacaactatgtagaaacactacaaagttactgtgacagtatttaaaacagatgcactgacagccaaaaaaaaggggaaaaaaatcccatacaaaaattgtgaaaagagttaagatacaaaagaaaaaaataacagtaaaatagcaagcgctcaatataatttatgtcaattttgtaacttttcttatttatacacaagatcaaggaaagaacagaaaatccttttataacaataaaacagtgtaagagacagaagcatcgtaagtcaaagctaaaaaaaagcaaccaattattatatactcattacaaaataatacactgggaaaaggtcgaaactgtaattggctcttataaagtagtaattcaggatatatacagtctatgactgtaaagcacatctttataatacaagtagaacactttcatacagtttccaacagaagggtttattcataagccattactgcagaggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagttaaaattaaccaagactgatagttacatgaagatgtctagttattgggtgttttcccccgctctctggtcctggctgaggcaagcggatcacttgaagtcaggaatttgagggtaaaaccctgtcactactcaaaatataaaaattagccaggtatggtagcacatgcttgtaatcccagctacctgggaggctgaggcaggaggaacacttgaacccaggaggcagaggctgcagtgagcttagatagtgtcactgcactccagcctgggtgacagagtgggactccatcacaaaaaaaaaaaaaaaaaaaaaaaagatggtgtttaaatttttattccaggaacagggttattctttttatattccaatttcaaaagaaaaactctctatatgttctgcatcaagctaataccacaattaaaacgtattcttcacatgatagagaatttaaaataatgatgacacaactagatacttgataatattaaggaattattcattttacatgtgataaacgtattacggcttaaaaagtcatcattttagagatactgaattatttatgaaataatacttgagatttgctataaaacagtgcaatgagggacgcaaaattgtgaacgtgcatgagagcaaagtatagataaaacaagtgggccacgtgttgataattgtgggaaccaagtaacatgatattctctccgtttttccgtatgctcaaatacctccatgataaaaagtaagccaaaaaataaaattatagtaacaaatcagccttctcagagggcataccacagaagcagtagcatcataattagttgttgtaaacacaggtattaaagagcacacagtgactgacagcattatattcatggatgctgctaccctgctgaagaaactgctgcatttgtcagtaccatagaaaggtcaaaaaaaaaaaaaaaagaaaagaaactgctgtatttcagcagcgtgagaggtgattcccatgactaatatccaaaattacatgacattacatccaaaatacattttatatcttagaaatctttctgagaaatcaacaatacttaacaagtatggaatgactataagatcatcaccattagctagatatttccaattcctaaccattcttttcctcaacaacctactccttcaacgagtgctgaagagagaaacaatggtcactggaaattcatcttttaaagttatagatatgaggttttaactcaaaaagaaggaatttcatcaagtattagatcatattcagctactgaaacaaattcatatttcctcgtttcatgttctcaaggcacaaaatactttaccttcatggtactcaggagcatttccttccttccttccttcttcccttccttcctccctccctccctcccttcctccttcccttctttcttctttctctctctctctctctctctcctcctctctttcttttagatggagtctcgctctgtcgccaggctggagtgcagtggcgtgatctcagctcactgaaagctctacctcctgggttcaagcgattctcctgcctcagcctcccaagtagctggaactacaggcatgtgctaccatgcccagttaatttttgaatttttagtagagaaggggtttcaccatgttggccaggatggtcttgattctcttgaccttgtgatccccctgcctcggcctcccagagtgctgggattacaggtgtgagccaccacgcctggccattctttcttttttaaagcaagaatttcatttaatgacctaggtggctttattctgattttcacttttaattatggtagacaaccaaatgatagatctctgaaattttgagacacaacttcttgtgtacaaagagaaatgcagggttctccatcttaagcccctaaagccttcaggagccttcattcacctgtgtaacatagggcctccaccttgatgccagccaacacacacatgtgctaagctgaagcagccatccctggaaccggaaagaatgagaagggaacacaactgtctcaagtttgaggcttccttcttgacaacaatattcacagtacaaaagtactgtgcttagaggagacgtaagtcagataagctgtaacttttcacaaaatgcacaattagtataaagtttaataattttttttcttccagtgtaaattcagtttgtttactgctttgtagttttgaaaagtcaggagttctttttaaattcttgggagctggtctgaatgtagtcaggtcacttttcttatcaaacagcaaaaacttattcgagattacataaaaatgggaaatataaacacatgttacatacagtccgtacactttgagagcatgtcatgccagttggaaaaacctaacagcaacttacaatggtaaatgatgactaccaaatgctctgaataggctgtacgcatgatgggagtaaagtgaagagggggtttaagccatgtgggtttttttgtttgtttaagagacaggatctcactctgtcacccaggccgaagtgcagtggtacaatcatagctcactacagccttaaactcctgggcccaaatgatcctcctaccttatcctgccatacggtagctaggactacaggtgcatgccagcacatcctgctaattgttattgtagaaacaggattgggtctcactgtgttgcccaggctggtctcaaactcctggcctcaaatgatcctcccaccttggccttccgaagtgttgggattacaggcaggagccacagagcccagctgggatttaattttgaaaaacagaggagaggaagagaattccaggcaggaggataaaagcaaaaacatagagatgacaacacacaacatgtgtttcaggcacagtgactagaccaatttggctggggtactttttctcctttgttgtcatctttatttttctacctgggatgtaaacgatgtgaatatgggtcagaaaaatcagctgcacagaaacacctcagccaattgtaagacagagagagggtggacatgcatgaaggggcagtagcaattccagaccagccttctgaaagagcctgtggtccaagccggcaaccagaagggcactctgggtggggcaggcaggaccatgcaatgcaggttcttgggaggaaggatgaggaggagcagtcacagcagatgctgtggctgagctccaacaagtttattggactctgccttcaagctgctgcctgaagaagttgattagcccattggcggaagcatagtgagaggtcacttcaaggcaagcaacaagaaaagactagaaagctaggttggagttagcctggaggccttatataccaagagtttgaatttcagactgaaggcttctgaatgggattaaaatgacaggaaagtaagcagcagtgcacatatacagagatcagagactgatgttcaggacggaatggggaggaagagcctggaggttagttctcaggggatgtttactttagcaatcataaagagtccaggcctggcgcggtggctcacgcctgtaatcccagcactttcggaggccaaggtgggcagatcacgaggtcaggagctcaagaccagcctgaccatcatggtgaaaccccgtctctactaaaaatagaaaaatcagccgggcgtgttggcacgtgcctgtaaccccagctactcaggaggctaaagcaggaaaatcacttgaacccgggagacagaggttgtagtgagccgagatcctgccactgtactccagcctgggcgacagagcaaaactccgtctcaaaaaaaaaaaaagtatacaggaggatgtgtgtagattatatccaaatattacgtcattttatataagggtcttgagcatctatgaattttggatatggaggggtcctggaaccaatcccctgcaaacaccaagggaagactgtacttcatttatgtaagcttccacagtttacaaaggacttttgcttacataatctcattttaccttcagaacaatttgtaaagtagaacatttgctatatttcacaagtgaggaattgctgctccgggcagttccttttatgaccaccattccatgtttcattttatggctctgtctctcaaccagtagactgtaagctccatgagggtatgcagggaccacactgaattttgtttgcctttgtagccctggctgcctcatgaagagccctggtccctgatcccagcagacacatgctcactaaatatgtgacagatgggtgaggagcacatcccctctcccactcttgtttcaatgatactaaaatgctttatcaatcaaaagtgtttgggggctttttgtgtttgttttaaattattgttctgacaattaaaaggctttgacaattttaatacctctacttagcactttctaaacaagacctcttttcccccgctaggtaggaaaaaggaaaaatatacaaaaaaggaatatcaggctgcctgccaccttcaccgttgtatcaaaaagtcactctaagtgatatattagactaaggaccaaaaaaaggtcaatatttgctaattattttttcaaatatcttctatttctttgcagaatggaatgtatgctgaaacaaataaccacacatatgagtacctacagtgccagagttgagaaattctggcctagaacacttgtgccagaaaacaagaaaatgctccaagaataatggagacatgtcaaaaggacaaagcagcagcttgaagggcctcccactggccaagtctgagacaatttaagcatcaatacaaataataaaagattatagctcattgattaaaataaaaaacatgagttcatattgatataaattaataaatcaataaattgaaaatgtgatgaagaatgagatagttaacataatttggaagtacttatccataaaataccaattacaaatggaagaataatttagcagtagaaaaatgcaaaaaattgaaattgtatgtcacctactaggaggcaatgagacataacatcatttctgccatatttctgccaaagatacgcaacctgagtttaatcatgagaaaacatgagacaaacccaaattgaaggacaggctacaaaataactggcttataatttccaacccatcaagaccatgaaagtcaaaagaaggctgagaaagacttggcaactaaaagcaaagcatgtgaatctgaactgaatccttttgcttgccccacccccgcaaaaaaaaaaaaaggcggtggggaaaggagctggaaggtctttattgggactattggtcaaacttgaatggggaatgggggggtgtgaggagtatttgatggtaatataatgtgtcaatgttaatttcctgcttttgatggttatgttgtacttatgtagaagaatgtccttaccattggaaacatacacacactagggtaattccagagtgatggagcatcaggcggacaactccaacggttctggagaagaaaacaagttttctctactgtacttgtaactattctgttttgggctgtttcaaaagttttcaaaaacattttaaatgattagtatctctccaaaatgaaagtaatggatacaatcttaatacatacacacaaattctttccaacaagaatgttctctttgtaaaagtactaaataagtcttccatttggtcactagggaagtagtataaaatagtgttgcataacaaaaaagaaaaaccaggctttccatgtagtaacactgacttcaagctccagttcatcacatacaaatttcatgaccctaggtagacttttttttttttttttgagatagagtctcgctctgtcacccaggctggagtgcagtggcgcgatctaagctcactgcaagctccgcctcccaggtttacttacaccattctcctgcctcagcctcccgagtagctgggactacaaggcacccgccaccacgcccggctaattttttgtatttttagtagagacggggtttcaccgtgttagccaggatggtctccatctcctgacctcatgatgtgcccacctcggcctcccaaagtgctgggattacaggcgtgagccaccgtgcccggccggaagattttgtttacccttctgggtcttgatatcctactctgtaaagtgagaataccagccaggcatggtggctcatgcctgtaatcccaactactcgggaggcttgaggtgggaggatcacttgagcccaggagttggagatcaatctgggcaacatagcaagaccctgtgtctataacaaggaagaaaatgaaaaaagaaaaaacaggaagtgagaataccacttttggctgggcacggtggcttatgcctgtaatcccggcactttgggaggctgaggtgggcagatcacttaaggtcgggagttcaagaccagccaggccaacatggtaaaaccccgtctgtactaaaaataaaaaattagcccagtgcatggtgacatatgcctgtaatctcagctactcgggaggctgaggcaggagaattgcttgaacccgggaggcagagattgcagtgagccgagatcacgccactgcactccagagactccatctcaaaaaataaataaataaataaaagaatccctcactttgaacaacaaaagttgttaatctgctgagaatacaggagaatacaagggtgggaggaaatctggtgctagataatacaatccttcactctttcagtaagtttggtttttaaacacatgaatcacttattcattcaacaaatatttacagttgacccttgaacaacacaggcgtcaggattaccaactgccctcacaggaaaaaatctgcatgtaacttctgactccccaaaactttactaatagcctacagctgaccagaagccttactgataacataaaccgtggattaacatgttttgtatatgtattatacactgtattcttacaataaaataaactagagaaaacaaaatattagaaaaattataaggaagagaaaatatatttactattcactaagtggaatggattatcataaaggttttcatcctcacggtcttcacactgagtaggctgaaaaggaagaggatgggttggtcttgctgtctcaggggttgcagaggcagaagaaaatccacataaagtggacccatgtgatttgccctgtgctgttcaaggtcaactatatttggtttctatactatgctctactatgtagcagctacagagatttaaaacatgatccctttgcctcaagccaataggaaacaagctaaaagcaagcaatcataatgaaaaggaaggatgttttaagtagtaaaggagaaagaaaaaagaaactcaaatggattctctcattctcaacaaacaagcaagtgaaacttctttgggtaaagagagaacaaccagaaagctattctggctcttcagtgctcctactgcaaggagtgcaagggggtgtggtgcaggaagcctgagctacctatcccaggggaggacaaagggagacaaaggcatcaagagagagcagctgggcagtgaccgaacatggctgccaggccaggggaaagtagcacatgggtcctgactgaaccctctgtggggctggtaagccctttctagtccagagatgcttttgggaggaggaggtgagtggcagaaagaaaattatacaagaaattttcttaatgttctttacacaatatacatggggaaaatgcacaagggggtaattgtggagccatgtttcaaagtaagatgacattcacttaatttgtacaaccagaatacagtgtgtttttctgtaatgatgttatttatagcctagtacttgtttgacagtacctgactgagaaagtgacaaacatctctgtatatatagaacttaacttataaaacatgtttaaataaggtaatttgcccaaagcttctccattgaattttaattccacaatatttgttataccatatcaacaaaatgacaccagataaaaaagaccactaagctcagaaacatctatttggtatctgtatcttcggaactgtcttccactcagtatttaccaacacagttaaaaaccagcatatttacaatgcttctttaccagcctgctagcaacttgtctctatctactactgagcacctcctttgttcttggtacttcccaggggatgatggggtggcccaataggaagctcagtcttgccctaaaggattttacagttacagatagaatcactagagaaatttctgaaatgcaaggcttttcaaaattagctgccaaaaaagggagagttaactgtgggtcaaaatagctgcaaacagctttaccaaaagaaaggcataaatttcatcttcaaggacagacagaatcttggaaaggtagaggaaagggtggaaggcattcccagcaggccaagcagcatgcaaagggtaccaaggctggcatcaggctggcatcaggtcggcaaggggcagggtggaaagtatgctcgtgtgtaaggtggcaggagggatcaatctgctggcatagataacgaggccccacagaagagtacatataatacataaaagttctatagtacacaaacagcaccaaacaggaaagacttgaggagtgctacattttatagctgccaagtgacatatactcagttaaagggcagttaggaccagcagcagaccagcaggaaggtgttggactagcccagagatcaaaggctgtgggcttaaagcagagaagcggccatcagaatggtgtcaaaggattgagcctaagagacatttcaaagtaggaaatgacagaaaaatcaaagatgactccaaattctagcatgtgaaaaggaaaataaatactggtgccactgaaaatactgggatagtagttaagaagaactgaggtttgggagtgagggaggtgtaaaagactggtgtgttcaccatgactagtgaactctgtggtaatgagagtggccacccaagtgaagaagtcctggaatcagctacaaaccaggctgttgtcagatgacaaagtagaagaaaggttggattgtaggtttgcaagtcaactggcatgctgaaggtaactactaatcagaaaatctcacggagaaatgaacagagaatgaaggagagaccacaaaaaaagagaggtaggaactaacactttttaagtatctatgtgccagccactacatgagccactttgtataaattaaatacagaaaaaattgagaggtaggaaacctagaaagtttcctctcacaaagaggagtgcaccaatgacaaagccaaacatgaaaggaaattcaagagaataaaggctgagaaaagaaaggacactggccttgccactacaaaggttactggcaccctctgggagagatttccagttgtgtggtggaagccgaggctacgatgtgggtggctgagaagagaaggacagatacaaactgaaggccgtgaataagaagtaggcatttaagtcgctgcgcagcaaatggacaagattcaatggctgctaaaaaggacagaagtgccttgcagtgagtgctcttttttttttttttcccgagacggagtctcgctctgtcgcccaggctggagtgcagtggcgcgatctcagctcactgcaagctccgcctcccggattcacgccattctcctgcctcagcctcccgagtagctgggactacaggcgcccgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccgagtgctcttaatcctttgcttattttagtaataggaaaacactggccaacaaacccaaaagtcaaaggttagggcctacatatcatatgattcaaggtaatgcaattatgggaaaatggaagacacaatttagtttttgcaggctaaatttccatcaccagcaaatctagttcagctataaatataacaaattaacatacactgattggagcatatttcacctgctttatagttgaaaagctaacatctctcaaaactcaatgctaaagagactaataacaaaaatacaaaaaaacccataaaaaattataaatattttatactacctttcccaaaccgtaaaccatattttgaaaaagcatctaaaagaccaatcacaatcatctgaaaatctgctttaggaattgtggagctactggatttgattataatgttggcaaaaacacttgctgcttcaatggaaaatattttcatcaatatttccagtgatgggctctaagttgagatagtacaattcattcatgaaacttgctaagttacaatttatgcactagtttctactcaaaatggtaagggtaatcattcttcaatctttcacctaaagagtaaaactcttctaggtggacaacagggaacaggtaaacttagaattgccaaagaatattacgtcttgagtataactcttagtggtattgtatggctaagttgttcaaaacagaccagaggtgagtttctgctaaattcacttttctatccactgctagctggaatcaacttttttcacattctaggaaatgattactatatttgctcttgccaaaatgctctcaccattttgttactattagataataatccattaatagtaaatttaattacttcaagaaggaacacagtttatttataaagaatctttttttttttttttttttttttttttttttgagatggagtcttgctctgtcacccaggccggagtgcaatggcgcaatctcagctcactgcaacctccgcctcctgggttcaagcgattctcctgtctcagcctcccaagtagctaggattacaggcgcccaccaccacacccagctaatttttgtatttttagtagagatggggtttcaccatgttggtcaggctggtctcgatctcctgatcccaggtaatccgcccatctcagcctcccaaagtgctgggattacaggtgtgagccactgctcccggccaagaatcattttatttaaataaactgccttgcagtcagggaggaagagagctgacacttagtgcttaccgcactaggcaccatgtgatatgatacctcttccatcccaccaccatttgaaatattcccattttaaaggtcaggaaataagagactcaaagaagttatttaacttatcaaatatcacacaactagtaaatgacagccaaatccataacctaagttattctgccaacacaccgagctgcctgccattcaaaaataaaatatttacatgtaaggctttttccaaaatggatttcctcatcttctatcatttcttcttaggcatttcactgaatgtcctaaagcctcaattcaggaaagaattgagatcacttcttagaaagtttttaggtgaggcgcagcggctcatgcctgtaatgccagcactttgggaggctgaggcaggagaatcgcttgagcccaggaggtcaagtttacagtgagccgtgatcacaccactgcactcccgcctgggtgacagagtgagagaccctgtatttaaaaaaaacaaaacaaaacaaaacaaaacaaaacaaaacaaaacaaaacagtttctagaaccaccacccaatgaatcaactaacaagaagaaacctatctgagagcttttactgataacagatcttcataaaaagctctggagaccaacagtagtacatctagtctaccttataaactgtacaactatttttacaatattctttattttcgcaacacaaaatcaggtgtcacagtctctgacaggggtgagtcctaggctctcttgggactagactctaaaggacaggccctcagtgtgtgatggagtgagtgaatgaataaagacacagccagcataaatgttaatacagcagagagaaactatgaatctggaggacccccaaaatgaaagcataaagcaacctccctcaacaaatgtcatttaaaaagccagaatcatgtttgagttatataaaaagtaataggaccgggagcagtggctcatgcctgtaatcccagcactttgggaggctggcacagcagatcgcttgagcccaggagtgggaggccagcctgggtaacatggtgaaacctcgtctctacaaaacttagctgggcatggtggtgtacgcctgtagtcacagctactgaggaggctgagtggaaggatcatttgaactcaggaggcagaggttgcagtgagccaagatcatgccactgcactccagcctgggtgacaggtgagagagaccctgtcccaaggaaaaaaaaaaaaaatcattgtattttaattggcaataccccaattaaagctacaagaatggttatcataaaaaaaaaatagagaataacaagtgctgtcaaggatgtggagaaaccagaaggtaaaatggtataggcaatttgaaaaaacagtttggcagttcttcaaaaagttaaacataagagttaccatagacccagcaattccactcctaggtatatacccaagagaaatgaaaacaaatgttcacacaaaaacttgtatagcaatgttcacagcagcattactgacaacagccaaaatgtacaaacaacccaaatgttcatcaactgatgagtagataaataagatgtgacatagccatatagtagactattatctggtaataaaaacaaatgaaatactgatacacacacaatatggatgaacttcaaaaactttatgctaaattaacaccaggtccaaaagaccacatattatatgatatcatttacacaaaatgtccaccataggcaaatctagagagacagaaagtaaattagtggttgccttaggctgaaaaagcagggaaagggcataactgctaatgggtacaaggttttttttctggaataatgaaaatgttctaaaattagattatcatgatggttacactaccctgtaaatatactgaaaaccaatgaattgtatactttaagtaggtgattttcctcttattttttaaataagaaaaagcttacaattgtttgcttctcatttttcttcttcacacagcaaggcctgcagtagggaagacttatttcatcaagaacagtatactatggtttttctttgatttagaatactgtctttctagcaccctacttttagcagtaaaagaaaataaagttaggaatttctaacatttagaaaataatcattaataaattaaaggacaaagtgaaaaaaaaaaacaaaacccagaactttaagcttacacctctaactccaaagcaggaggaatttgcttggtccagctcagcacaccagacactactacactctctgagctctaataacacttaccatcatagtcttgatcatggattgcggtgcgaacctccagagattgcctcaagccaaagacatgtcaatctagctgaggtcagggtgaacatatatccaactttcaaagcatacaatcaatgtccaaccttcccaatgtggttgtatcaacacacataccacaagcgtgaataacagctccagtggctctacgtactcagtgacagtgggttttaaaattcctgcaaatctagtgagtgtgtaatgacatatccccgtgttttaatttgcatcccccaattaaagtgagacaatgccttttcttatgtttactgaccactggattccctcttttgagaagtgccttctcaagtcattttcctactgggctgtcttccttatttattgatttgaaggaattcctcacatattctgacagttctatgtgattatttattctcccattctgtggctcattttttcactctctttatgtcgtctgttgataatggttttaattttaatgtagtcatatttatcaaccctttcctttacagttagtgctttttgcctcttattttaagaaattcttccccattctgaaaccacaaagatcttcgcttattgttttgcctttcacattggaaatttctattttgattcacattggaaagatccaatttcctttttatttttcccatctgtaaaactgattattgttaactagattcgtctccagtgtctagacttatataaccactaagaaaaataggaacgaatgagatcctccttttgttgaggatctactatgctactatgctgagtactttatatacagtatacaaatatacagtaattctgcaaagtacattattactagtcccatcttaaagaaaatgaaactaaggctaagaaacacacccaagctgttagaagataaagatgggatccatgcctgtctaatctagtgcccataatatttctgcacaccatactactttaggtaagaatgtgatctctggataaaacaggaaatattttcattttgaggatgttgcagtcactttactctccaggtccactagtatagtgacacttattttttatttggcagttcttttattaattcactcaacaggtatttcttgaattcctactacctgctaggtactgttccaggatccagggatgaaatagtgagcaaaacaaaatccctaccctcttgggggtttataggctaatcagatcagaagtgtagtctcccatgtctattctacattaagtcttacacagttagtaaaggaaaccttcctccaacagaagagtgacaggactgcaacatgaagcactctcatggaacaagaaggaacttaaagagcaacttggagaaataccagtactcatatgaaacaaccccacgaaataaagcatcccatgcctcttcccttctcctgcagcttataccttcactcttcaaaaaaagcaatataattaccttaacaaaatgagcatgacttcttgtaaacatctatatacaccttgtgctgtttctaaactcttttccttctctatttaaaaaagatgcttttcagtgtgtggcaagtaacaataaactgctttttcatttctttaatacgaactggaagtctatgcatacttagaaaattgcatacttagaaaattgaagaataggctgggcacggtggctcacgcctgtaatcccagcactttgagaagccgaggcgggtggatcatgaggtcaggagatcgagactatcctggctaacacggtgaacccctgactctactaaaaatacaaaaattacctgggcatggtggcacgggcttgtagtcccagctacttgggaggctgaggcaggagaatcacttgaaccaggggaggtggaggttgcagtgagccgagatcgcatcactgcactccagcctgggcgacagagcaagactccatctcgaaaacaaaacaaaaagaaaaaaaagaaaaagaaaattgaagaatgcaagaagcaggcaagaaaaaaagttagttctgcagtacaatatgaaggccaagaacttcctttattttcccaccacctgcctggatctgttttcatccttcagagaaaggaaaatcccttccctgaagctctagacaccaccctgttcccatatttactctgtaacctagaaccttcagttagaccccatgttctacacccctatctaccataacagtcccataagatcagcacacaaacaggctctcatgttgctatctcaatagtaaaagaaaacccctttgtgccctccaagcacttctccatttctctgcttcctcctcacagcaagccgtctcatctcagaggcttgccttcatatggcatttcctcatttcctccccagtctggctacagcctcacctaactcactggtactgctcttgtccaggtcaccaatgaccttccaattgctaaatccaatggtttgctctcttatcttaccagatcccctccattctacacagtaaactgccacttctcagaggattttcttctctcaggtactgtgacactactctcctggttttccttcttcctctttagccaatcctgtctcctttgctgcctcctccagaatcacaagctctaaagcttggaattccttggggtttggtgctgtgttctcttctttttttcccatccacactggaattctcttcctaggtgatgtcatgcaaactcatggctataaatattatcgatactcatacctgtaatcccagcattttgggaggctgaggtggaagtattgcttgagcccaggagcttgagaccagcctggacaacacagtgagacttcgtttctacagaaaaaaatttttttaattaactggatgtggtggcctgtatctgtagccccagctactggggaggctgaggtgggaggatcacgtgagtccagaaggtccagagggctgcagtgagctatgattgtatcactgcactccagcctgggcaacagagaaagaccttgtctcaaaaaacaaacaaaaaaaagcacacgcatgtgcatgtgtgtgtgtgaaatcaatgattaagaggactcagtcactggtgtgtgtgtgtgtggggggggtatatgtgtgaaatcaatgattaggactcactcactgagctccagactcacatatccaactactcatttggaatttccattttaatgttacatgggcaaccaaaactttttccttctcaacccaactctccccaggtttccccatctcaatattacaggaccaacctagtcaaaaacttagaaaccactgttgatggcttcctcatcctcaccctgtccatgagcaagtcctattgagtctagccaccatgaattttgaaatcaaacacttctctccatttttcactgtcatcatcctagtccatgccacctagactattgcagcgacctccaaactgtctccctttccgcatttggaagtccattctccatagagcatacaggcattttttaaaacacaaagcaaatcatgacacaaacctacttaaaacctttcagtaactgactaaatagtaaaatcaaaactccttactgggatatacgaggccctgcaagatctggtgtccccacttaccacttcggcttctttccattcacactcccactgttggttcctagttcaccacagactccaatctcagggcctctgcaggtgctctacccctcacccagccttctctacacgtgactgcttcttgccttccacagcttagtctaaaaccagtacataaagatttttttttttcttgccgtggccagtgagtaccaagaaaaaaaaaagtaggccgggcgtgatgtaatcccagcactttgggaggccgaggcaggcggatcacctaaggtcaggagttcaagaccagtctggccaacatggtgaaaccccgtctctactaaaaacacaaaaattggccaggcatggtggtgcatgcctgtaatcccagctactcaggaggctgagacaggggaaatcgcttgaacctgggaggcggaggttgcagcgagccaagatcacaccactgcactcccgcctgggtgacagaatgagactccatctcaaaacaaacaaacaaagaaaaaacaaaaataaagaaaaagaaaaaaaggaaaaaagagacttttcactctattgaacacatccccatcttattttctaatacatcagtcagatttcctgctagcatttatcacaattactagattttacttatttccttactggtttattatctccctaccttcctgcaatacaagctgttgtcttttttgggtagtatattaaagccgatacatgtttgtagaatgaatggcagaaaaacaagtcgaggatggaagaaggagggagaaggggaaaccaagaacagagaacacatttccaatctatacccaggcttccacccagagttttgtaatacaggtttttccatactaagtaaaagtagaggccgggtacggtggttcacgcctgtcatcccagcactttgggaggcttaggcgggcggatcacctgaggtcaggaggttgagaccagcctggccaacatggagaaaccttgtctctactaaaaatacaaaaaattagccaggcatggtggtgcgtccctgtaatcctagctacatgagaggccgaggcaggagaattgcttgaacccaggaagcagaggttgcagtgagctgagatcgcgccactgcactccagcctgggcaacaagagtgagactccgtctcaaaaaaagaaaaaagaaagtagaggtcccctattggctacgttgagcctaacagtgatatataataaacttaatctattcgtaaaggacatctctaacaacaatcttttttacactcagtacatttctaacgaaagaccaaattcaattatcacttctctacaactagtcttgggagtaactagtatgtacctaaatttgctgaagtaaatctggagacaattttgcttaaaacctgatgtcaaggagtggaaaaggtaatatgaaactcaaatgctttatgcctaccctcattagaaaatgtctctaggaaagcaaaatgttaaagctgggtgatgtgtaaactggggatgtattatattatctctacttctgtgttatgtttaaatttttccataataaagagttaaataaataaaagtaaatgcctctatgaagtcaaaagacaacaagtatccatgggtcacagacatactcctggctcaagtgcactctgttgccatttggagatttaatttaaatcagttgatggttgctaacagtgtctccataagtcttatgacctaaggccttcatcagggcctttttgggagaatcggaagacacaaggaagcaggagtcccctttcacctgctctgtgtcacagccttccagccccagcaccaccaacccagcccctttctatgggagtttccaataaccacagctcaaaaacagcaaccgcagggagaaataaaatcatttacaaggggaaaagagaaaaagcacgcagaaggggaaaatattaatacattatttttgcttaaattcaaaccaaccattttcccctagaattctgatgaggtaatatttcttctaaagcagcacttcaaattcaggaagggattcatagaagactaaatgcaaaaagagcagaggccagcaaccccacccaataaagtttcttctctcaaagattcctcaccgctctctagaattcgtctatggcattaaataaaaagtggttaagaggtgaaaattaaggcctcacttactaggtgaaacaaagaacagaagaatctaagctactctagcaggtgtttgttttctactgtagaaacagcctagctggactgggtgcggtggttcacacctgtaatcccagtgatttgggaggccaaggtgggcagatcacttgagcccaggagttggagaccaaactgggcaacatggtgaaaccccatctctagtaaaaacacaaaaattagctgaacatggtggcatgcgcctgcagtcccagctactcgggaggctgagacaggagaactgcttgggcccaggaggtagacgctgcagtcagccatgatcacaccactgcactccagcctgggcgacagggtgaggtgctgtctcaaaaaaaaaaaaaaaaaaaaaaagcaaacataagaccctgtttctataaaaaacaaacaaacaaataaataaaccagaatgaagaagcaaaatacactatagacatacagtggaatattattcagtctttaaaatgaaggcgattctgacacgtgttacaatgtggatgaacctggatgatactatgctaagtgaaataagccagtcagtcacaaaaagacaaatacatgactccacttctatgaggtacctaaagtagtaaatttcatagaactgaaaaacagaatgctggttacctggagcggggtggagcgggaaatgggaagttattatttaatgtgtatggagtttaagttttacaagatgaaaagagtgatggagacggactgtggtaatggttgcacaacactatgaacatagtcataccactgaactgtatacttaaaagcagttaagatggtaagctttatgaatgcatttaataccactaaactatacacttaaaaatggttaagatgctaaattttattttgccacaataaaaaatttaaaaaagtcatccctaataaatagcttattaataacttcatatcataaatcatgtagttaccaagtatgtttagattttggtgtccttgttcataaagtgagaagaggaaaaaaagaggagcaacccgacctttaaatgacagcagggtcctgagtaacagatgactctaatcagatcaggagaggtcaatgtgatcctttatgtgacagagatctaatctgggacatggttgggcctaaacacagatttactgaactcaaggaaatgaacacttaatcacactaagagatcagggccacagtgaagatatgtttcctgtcttgttccatttctagaggctgagttcagttttgtggttcaacacatggatatgactaggctaaactgggatttaattcttagctttcttatatttcagtcatggtctaagatctcactctgtgttattatttggtggcacaacccaaactactcagtttaatttgttctacatctaaatttatctccatacatgaattaaataaataccatctgtgctggatagtgtatgctggtacttagtcccacatctacccttccagactctccctgcatcatcaggcctgaaatctacatttccaaaccccccgtcagctgtgctcccattaggctctggcagcagcactggcaggagtacaggttcctgcttggttgcagcgaactccagtagcatcagtgagaaatgcgggtttgtgggctctggtttgtaggcaccttctcccttttgttcctacagccctttctttttgtaaacaattcctagaattacatccctcttgaatgaaacacctggagtggtttcctgactagacactcgctaatagccctccaaattcaaaatttatataactcatgggccagggtagggagctatgctatgaaatactcattcatccattcattcaacaaattcttagtgagcaactactatggaccagatgctgttctaggtactgcagatatagtaggaaacaacacagacaaaaatccttgtcctcaaggagcttacattctagtgaaggagaggcaatactcaggataaataaataaaacacatagtgtgtaacacaagtgctaaggagaaaaaaaattaatcaggggcagggatatgaaatgttggagaagggttgaaattttagatacgtcaactgtctgcgtgtcacagtcgggtggtgtgcttgcttccaagtctggaggtgggtggttagagcctgttctatgaaattttagatacgcaggtcactgagatgattttgggggaaaaaaccccaaagaggtaagggagctagttactcacataactgtaggaagagcattccaggcgagggaagatatgtccaagagtcctaaggaggaagtctccttggcatgttcctatgtggaacagaacaggcaatggcgaggatatctgagagatggggagggccggccatgagagccttgttggctatgataaaggctttagccactgcagtaaattctgagcagagtaacatcatctgactcacttgctaacagggtcgttgtgtgtcaacaacagactgcaaggggcaaagggagaagtaacagggaagacagctaagaggctcccgaaataatccaagtcaaactgaatgatcgctgggaccaatgtgctagcactacttagagggtgctaagcaaattctgaatatattttgaactcccatctgggccttaaaaagtcaggggccggtccaacaatctcgctggaaatcatacaacagaaacttcgaagggactcctaccaggtgtaagaatataacgaatattatagaattatttaattatctttgtctaaagccattatattgtttatgttttgatatttaaccaaatataagaatataaaggctttggccattatatataagaatataaagtatacaatgactttagccaaaaataaataattgcaaattaacattctccaatagttattataggggaaaactaatttataacatgccaggttataaaacttttaatatttttatataagtattatagaaacagtacagaaatatgtaagtacctattaatccagtttttattaaactggtcaagttacagaaaaaacatgaccttcttaactgtattttcaagaggataattatcaaaatgtaaattttctagacagccaatgaagaaagaaatttagaactagaaaaaatctgggagtcccattcccttcatttttggactaaggtaacaaagcccagatatataaatgaagcctggtcattcttcaagcatcaaaacatatttcaggctgggtgcagtggctcacgcctgtatcctaacactttgggaggctgaggtggagggatcactttaattcaggaatttgagaccagcctgggcaatgttgggagactttgtctctacaaaaaattttaaaaatttaaaaattagccaggcatggtggcacacgcttatggtcccagctacttgggaagctgaggtgagaggtcacttgcgcccaggaggtagatgattcagtgagccatgattgtgccactgcactccagcctgggtgacagagtgaaccccgtcttaaaaaaagaaaaaaaaagaaattcaacactgtgatggaaatatttctagaatatatttttacttccctatcttcttaaaacagagactcctaaacatacttcatctttgccttggtaactctagcctctctaaagagcaactatacccagcccaggtgtgatgctggactttgctgactgctgcctccactatgcagccctaacaatctctactcatcttgctcccagctgatggtgtctgatctacacggaaggctggaaaacagttaagaaccatacatcagctttggtgcgggagctttataacaattattgtcagcacttgaaaactgattttgctttctctcagtgttgggctgtgttttgaagagctaatattgcgtgcaaatggatgggttaagtgatgtaagcacattgcttcagaaaaagttctacccccaaatgcaactgatcactttacagaaagtgtagttttaaattattaaaagcaaaattaattatctgaaaaaatattaacaccataaacatcactacatgaaaacacaaactgccacagtaatgcttatgtctcaagtaacagcttacaagtatcaacagtaaagtaataagctgtaataaaaaggcacttcatctcttcaaaacctgctatcccaccaaaattctccagtaagttaacatgaactaaatttttggtccctttcctagcattctaccaaaatcagtttaatttttaaaataataaaaatattttattgtactagaaaggaaagattctaaaaacacacaaaaccataagtcaagacagcaaacgactcacacgtagccactcagtgaggacagtaagtcttccttagcaattaaagagcaaatagaggaactcaacagagaatacaaagtaaaaaggctgaggccctttaaggatagctggaattcctaccaagctgcatgttcatggccacaagttaacagagtttaccctccctccctgtgcccccacagctgctcactgcagttacaggtaggtccctgtggggctgcctacagtcctagatataacagcccagagatctgtgtggttggttcttagccgcactctcaaaaaggaagagctggcaagaacctcaacaaaattaaataatagcttaagaaggaggcagcgctaaagataaaggtttgagaagggattttttttcttcctttagagacagggttttgccctgtccctggagaggctggagtaagatggtgcaatcacggcttactgcagcctcgacctcctgggttcagcctcccaagtagctaagactacacaatcgtgccaccgcacctggctaatttttcaattttttgtagagatggggtctcgctaggttgcccaggctggtctcaaactcctcgtctcaactaatcctccctccttggcctcccaaagtgctaggattataggcatgacccaccatgcccaacagggaagggaattcaaaagaaaatttcagggttactttcttattttacactagatgtttcctctattaagacctgaaatttttagcttattaaaaattcttacactaataatacaatatagaagtattcacaaatcactaactcactgccatttactcctacaaaaaatcctttctcaaaacaaaactctacaaatgttagcccattcccccacccccgttaaaacaccttccatagtagacgctttacacttttttgacaacacttaaacacaagttctgtatcatttcctatcctgattataagcttctctaggccagggaacttactcaattttgcattccctaaacccctggcaccactgcttcatgtcacagctacttagtgtctgctaaatgaattactatggtatcagatcatggcacctccagttcactaatgagaaaattcaactttttaacacagcaataacatttctgcctccaggaatactgtcattttcacaggagaaggaaattcagtgattcagtgcctaccatctgccccagaggtcagctatttctgacaagtcctagtgtgcacatgggccaatcaggctgcagctgccttttttcacaggcatggatggaagaatgagaaaggtcactaaagcagagtccgtatgtaaattcgttaggcatcatccacaggaaatttgcttcctcttaaaatcctgtgaaattaaaacatgcctttaagccattgtttcttccccctgttctttaacccatttatgctggaggttgcaaatttttttgtgtgaaaactcagaccttggtgatgaccttgagcactatgatataaataactcccacaagcttagcgttccagtaatggaacagtaggcataaatgggttaaactttggatagtccaacttgccaggttaccccattgtttacaaagcctttcacagtacaaaaaacttgattaaccctaattgcctgctgacgtctacggttgtttctttttctcagaccactctttttgagacagggtcttgctctgtcatccagggtggagtgcagtggctcgaacacagctcacttggaggcagattcaagtgatcttcctgcctcaaccacctgagtagctgagactacaggtgcacaccaccacactcaactaatttttgtattttttgtagagacagggttttgtcatgttgcccatgctggtctcgaactcctgggctcaagcaatccacctgccttggcctcccaaaatgctgggattacaggcatgagccaccatgcctcgctttcagaccacttcttgaagtcaccttagttccataaaacttgtgtgttgacatacagtgtgatactgtttctttgccacaaattcaactctacaagtcacatctctttgtctgccttcatgggtcaaaactacttactagctgggcatggtggcacatgcttgtaccactagtcccagctactcgggaggctgagatgggaaaacagcttgagtccaggagttggaggctgtaatgtgctatcatgatcatacctgtgtatggtcactgcattccagtctgggtgacatagcaagaccccatcttaaaaaaaaattacctgctagaacacagaataaatggcagaaagaaggccatagcagagcaaacacaactcagaaacgcccagtctagcactcgtggctgggaacccttgcagggaagtgcacaagtactctcagaggggacctgcctgcctgtcactggcttggtgtgaacactctctgagcaagtcacaagagttatgggctaggccgggcgcggtagctcatgcctataatcccagcactttgggaggccaagacaggcagatcacaaggtcaggagcttgagaagatcctgactaacacggtgaaaccccgtctcttctaaaaatacaaaaaaattagccaggcatggtggcgggcgcctgtagtcccagctactcgggaggctgaggcaggagaatggcatgaacccgggaggcggagcttgcagtgagccgagatgcaccactgcactccagcctgggcgacagagcgagactccgtctcaaaaaaaaaaaaaaaaaaaaaaagtcatgggctagaaatgtactaccatgggggagaaaaagaatagactaccacaaattgtcacactttttaggaaaatattttacagaaaatggcagtatgcagagcgttattgaagggttataaatatattctctgaggggtattctgaagttcttttaatgaaggataataactaagagcttgggctacaaaggcatatacaacactgtaagattcaactacagaatgcttcaagattccaaactcagtttctttagaaattctgcgccagaacaggagcagcatttttaaaattccttaccaagtagcccaggtaaaaaccaacttttaaaaacttagctatatttctgccaatgtacaaaagaataccacccaaatacagaaattgatacaatttgttaatccttgctgctgcaattttctcaaaacgaaaatacaaaagcaaagtatctgaattcataacaagcagcatacattcaggccttaggcttcaaaagcatggtcaacacctcagtagtctgaagacatcttcagatgctttagtctcccaagactcagctggggattctgcctatgccatcccctctgcaacatgtggtgggtggagggtggggagaatgggggtggtagaaggcctctccacgactctctacctccaactcctcttactccactgcacccagttcctctacccttggcatcttgggggcagggaggctggagaacagtctacccccacaaatacactaacttagaaaaaaaaacacttttaagtgtttagtattagaaatactaacttagaaaaaaaaaccagtttaaatattagaaaacttttcttaatccaagcaaattcaattatcattagtctatggtactgtttgcagcagcaaaaaaaaacccaaaatataaataaatatggaaacaaataaatatggtgcatccatgcaataaactactaggcaaccattaaaagaatgcagcagatctatgtgtacttggatatatccaagatattttcagtgaaaagagcgaagtgcaaaacaatgtctaaaatatatcaccatttgagtttttttaatatggatgcggaaatatatgatttacacacatagaatgtttctataaaaatacaaaagaaactgggaataatagtggcctacagaagggactgaggaactaggggtttcagtaaaaaggaatacactcttttttgatattcaaaaaaaaattttactatgtatgtgtatccctgtttaaaatgttttaaaggcgtacttaagtctgtgatgatgattttaaaaaataaagcaacagaagaaaaagtaatgcctattaaaagcaatctcatttttcttaactatttctaaagtctttgtggcacaatttgaattcagtaaaacaggggagactggagggattgggagtttggagaggtccctttcaccctcctcctttaaaattacagtaactttcaactggccataatgcaaaaaaaaaaaaaaaaaaaaaaatctacttgcttctccaacaaaaatatttggctccattgtaaccaacatttaaaagatacaaatacattagcaagtctgtgactaaagttcaattacattttatatgctaatatgaaatgctaatcatattttttatgagtcaacagttttacataagattattttgtttctaaactaacaactttagaattactgaagcatccaaattacctaaactcactccagtcaagcatcagttcagtaaaaaactaaagggttttcccccatagcttcaaaattcccaatcttctccatttccaagcatgatgcggggcaggggcaagggagatggcaggcaaagcctaagcctgtccaaccctcttcagactctgtagatggctcctcctggtttcagggatcccaactcctcatatagatacagccatcatcagcaatcccacattaagtgcattgattccattaacaacagtgggaggcaagtggctccactggcttggattctgaagctcaacctgtggcccatgcacctgcgaataacaacaggctctctcatcagtcacacagggcaaaggaagtggagctgccccaccccacacccacacagaaccagactgctgattgcctctttgtaactactgccacaaaaagtaaagcaaatgccctgcaattggatttttactaatggaaatgcatttgtcgagaatccaaagatgctcagttatctcggaaaaaaagttataacatgatcttcaaaaatgaagatgaggaaaggcattttgccaacttaaaacattcatcaaaatagatatttaaagcagcaaaatatgacaaaatactagtttctcattttttaaaaacctgaacattcagaactaaaactataacactgtaaaaaaaaaaaagtgtccagggataggaaaaaaatatttcttaatcatgtataaattggttatttattcatacctccatttacatacacatatttgccaggtgctcagtaccaggatgccatggtgattaaaagacagacacagtccctaccttcagagcttacaatagtaaatgaacacaaggaataatgcattggtgtatagtttatctctcccacaagggacaattaggaaaaacatcctgggagtaggttcacaggttttaatattctctatagagtggctttaaagcattttatgataaattaaaattaaaatattaaaatgagctaaaaatagaatatttcttatagtgaaaagtgtcactaagaaaatcaatggtgagaaaaaagtgcctctggaatggaggtaaggatgtctagggaaggctttgctgagctgaaccctccatgatcaaaaggaactaaatgtaacaaacttgatgtccagccagctggatacaatggctcatgcctgtaatcccagcactttcagagcccaaggcgagtggaatgtttgaggtcaggggttcaagaccagcctggacaacatggcaaaaccctatctctactaaaaatataaaaggtagctgagcatggtggtacatgcctatggttccagctacttgggaggctgatgtgggaggatctcttgagcccaggaggcggaggctgcagtgagccgggatcacacccctgcactccagcctgggtgacagagcgagaccctgtctcagaaaaataaaaataaataaaaattgatatccttgggatggacagaagacccatatgggaaagcaagtggaaaagtggtagaggtgggcagggaacaagaaacaaagtattgtaggccacacaagaagtttggattttattctaattacgatggaaagccactggcagcctctaagcctggaaatgacaagatgagatctcattaaacataatcatttcttgtttagaacataatacattttcaaataggaataacattataagtggatatgttgcagtattgcttccatgcattcattcagctataatttatttagtgtctactctgtgctaggttgtgtgcaaggtactaactaggaataaaacagcatctctgaccttgagttcacagtttagtagagatgagaaacactgaacaaacaatcacaattgtaatatttacaacagtggaatatgtggaatgctgtgagtgcccagagcaaagggtggttaatgcaacctgagggagtccaggagggaaggcttcacagaagccctgggccttaaaggacaaacagggatttctttagcagaacattccccccacacctaagcctctgatagaatacaagaaaatttggggcctaccaaagactctgccttttgaagtatttatgggccaggtgcaagagctcatgcctataatcccagtgctctgggaagctgaggtaggaggatcgtttgaggccaggagtttgagaccagcctgggcaacagagcaagaccctgcttctacaaaattttttaataaaatttgcttttttttttttgagatggagtcttgctctgtcgcccaggctggagtgcagtggcgcaatctcggctcactgcagtctccgcctcccaggttccggcaattctcctgcctcagcctcccaagtagctgggattacaggcacacatcaccacgcccagctaacttttgtatttttagtagagacggggtttcaccatgttggccaggctggtctcaaatgcctgacctcaagtgatccacccgcctcggcctcccaaagtgctgggactgcaggtgtgagccgccgcgcccggcccaacatttttttaatactaactttttttgcagccatttttacccccctcaactacaagcttttatcaaaattttgaaagagattttgaaaaaattccaaatactctctacttagattcaaaaattttaaatttcctaattatctttctatatacacaaagatttatacacacacacgtattttatgagccatctgaaaatgctgaggatatcatacctcaccctctaaactcttcagcttgcatctcccaagaataagcacattctcctttatgtataactacaatgccattatcacaccaaaaaagacaaaaaaaaaaaaaaaatcaccctggcgcagtggctcacgcctgtaatcccagcagtttgagaggccaaggcaggcgggtcacctgaggtcaggagctcgagaccagcctgatcaacatggagaaaccctgtctctactaaaaataaaaaaattagcggggtgtggtggcgcatgcctgtaatcccagctacttgggaggctgaggcaggagaactgcttgaacccaggaggcggaggttgcggtgagccgagatggcgccattgcactccagcctgggcaacaagagcaaaactctgtctccaaaaaaaaaaaaaaaaaaaaaaaaatcaacaattccttaatatcatctattatcaggtacttctttttaaatacaaaggactttgttgaaattttattgaaggaatgtgttttaataaactggttagatttattacttgcattgcattttgacatttttaaaatgtaataatactttataaaatttaagttaaggaatctttccttggcaagattcatcactggcacgggcatggtagctcatgcgtataatcccaacactgtgggaggcccaggcgggcagatcacttgaggtcaggagtttgagaccagcctgaccaacatggtgaaatcccatctctactaaaaatacaaaaattagctgggtgtggtggtgcgtgcctgtctataatcccagttgctcaggaggctgaggcaggagaatcacttgaaccaggaggcggaggttgcagtgagccaagatcgcaccactgtactccagcctgggtgacaacagtctgtttcaaaaaataaataaattaattaattaaaaataaatttaaaaaataaataaaaattaaaaacatattaaaagaataattgtgggccaggcatagtggctcatgcctataaacccagcattttgggaggctgaggcgggcagatcacttgagatcacgagttcgagaccagcttggccaacacggagaaacccccatcgctactaaaaatataaaaaattagccaggcgtggtggcacgtgcctgtaatcccagctacttgggaggctgaggcaggaaaactgcttgaaccctggaggcagaggctgcaatgagccaagatcgagccactgcactccagtctgggcgacagagcgagactctgtctcaaaataatgataataataattttggtaatcaaatataccaaaaagtgtgacagcggtccatgtgagactgacattttgggagcactgccttagcagaacaacaccctaagcggatggaacatggcaggaaaggatttacaggagagtgggttggtgaggctgcagaggccatgagagaagggaataagctggacaaatggactgggcctgagtgcttcaaggattccgcatgccttcctgaggagtttggactttacccggccaaatgtgggattttatgtgactaaaatcaagtttgtttagaaagctctacttggcctcagtgcttcaaggattccgcatgccttcctgaggagtttggactttacccggccaaatgtgggattttatgtgactaaaatcaagtttgtttagaaagctctacttggcctcagtgtagctggatggatgggagaggtggggaaggtagggagaccatttggaagcaacagaacaaggtttgtatttttcactgctaatatgtaacattttagttttatgggttgaataagcctactacattgataaatgaacaaaacaaaaacagtaaaactaaacaaagtttatcttgaaaatgttcatgttggtagaatagcaactttcaaaagagtcagcagagacttaagtaaattttttttaaatggagtctcactctgttgcccaggctggagtgcagtggtgccatctcatctcactgaaacccccacttgccaggttcaagtgattctcctgcctcagcctccccagtagctgggattacaggcacatgtcaccacgcccagctaattttttattaaaattgatggggtttcactattttggccaggctggtctcaaactcctggcctcaagtgatccgcccacctcagcctcccaaaatactgggattacaggcgtgagcaaccgcacccggccagagacgtaagtaaattttgaaaggagcccttcagcatttttgacagtctcagcatttgatgaagctctttttaatatctagtttcactttccaaggtgtctttccttttccttggcaaggttcatcactggcactagttttacatttatcagtcacaatcaaaatttaaatttccaaaggaaggaagtggggtacagaatagataaaatggtttaaaacatagagcatgccctcaaagcagtgctgacagcaactctgaggagctccatttatgcagaatccactgggaaggctgccccaagagccagccgccagtcctgcctgggaggagagggaagcagagaatgtccagctatcctgccgtgggacaggatgctggcccttcacccctactccactaggaggactctcattttattttacttatcgggcttcctagaaagatttcatttgaacaaagggttccacaactttaaaaacacttgaaaaccaaggagtcagaactgtacgttctaactccaaggctggcaattgaagaataagacctcaagtcccacaggaaagctcccagtggacaaaacaaacaccatcgctgaggagcaatgtaaagaaagagacctgggcaaacaggcccactagaggactggcgtctttggggtagaaggagaaattctattttggacctgtggattctgagatgccagtgtggcacccaacttggaagcccaacgggcagggatgtaggggtcttagaggagcacaggagctagacaaactctaaatgtggacaacttcattgagagagatgtaaatagaaagaagggaaggtcttaaaaggttacagaaggcaaagacagaaaggtctgcctcaagacaggtctttctggagaacctgaattctcctccaaggtagtctatatccaggagcagagagaggcactggctggaaggctgcaggtggcttacggggccacagaagggaaagagggaaagaacaaagtggattggctagggagcagctcaaagattagacagtgggtccaggcctgatggggctgggactctgggagaaaatgaaggtcacaatgagataaaagacgaggcatagggagaacagggaatcctctgaaggaggctgtagagaacccaacatttcaccagcacactattccggaaagcactcctgtcagacaaagtcaatagaaagccaaaaacaggagtaaaagtcaatggctaggagaggagctagggtgagggcagttgtgtcttaccgccctgactggctgcgggatcatgcagccctcctcaagcacttgctgcagaaaaggaagactctccctagaaggggaggccagaagagaccacccagccctctgcttcccttgtcatagccattcctgagaatggagcctgacaacaaagaaagtcatttgaagctcttctctgttgattgaggagcccaattgaatacttacaggaaaactgggtacagataatgcctaggagaagatctaagcctgtttcccaatttgcatatggtgttattcatattaacgataaagaaaactacgtatttttaagtgcaactataacttgattgaggactggaaagccaacattaaaagagaaataaaattaaattaatattaattacattaagagatcaagggattcagatgttttaataccatcataaacacctataacaacaataatacacccgaagtttctcaaatttctatctttagctagaccacccaaccctgctcattttgctcaatgataaaaatgaaaaccaggctgggcatagtggctcatgcctgtaatcccagcactttgggaagctgaggctagagaatcacttgaggccagaagttttgagaccaggttggacaacactgagagaccccatctctacaaaaaatgttttaaaggcccggcgcagtggctcacacctgtaatctcagcactttaggaggccaaggcggatggatcgcctgaggtcaggggttcaagaccagcctggccaacatgatgaaaccctgtctctaccaaaaaatacaaaaaattagccaggcatggtggcaggcacctgtaatcccagctactcgggaggctgaggtagtagaatcacttgaaaccaggaggcggaggtggccaagattgcaccgctgcactccagcctgggcaacaagagcaaaactttgtctcaaaaaaaaaatgttttaaaaaattagccaggtgctggggcatgcacctgtagtcctagctactcaggaggctgaggcaggagaagtgcttgagcccaggcactccagtttagacaactgtctcctaccctgtatctcctcccctaaccattgacttttactaccgtggctctatgctctattagacaacatcatgccaaagaaactgatactttctcagaaaagccttactaactctaggaaacaactaaccattcttaagaattgaatagtaacacaacgcacaataaaaatcaggcttcatgacatttactgtctattcttcaatggtttccagaaagtcaaaaacatccttgccatgaagaaaggacagtaattaagagatggcctccccccggtaacaaacagtattaggaaactcatcccacatttactacattaatacagccattaaaaataataatggaggaaaatataactctttaaccattctgaaagtacatacctgctcaactctctattacccttaactgtcaaacctgctttctctccaaccaggattggacatctatatttcacaaatacagaattaaagtgatacagcaaatctaaaatacaaagcattaattaggtggtatcattattatgtaagtcattaagcctttttaaacacgtactagttttctatcaatacagaaacaagagtgaaatatggcaaaacctcaactaaccagaacagctggggattgagtcactgaatatgcctttcagataggtgaaggcttatttacaattctgaacacacatatttttttggttaactgttctggacgacatgctttgacacaggcccacaccacgaatgtcagtgatcacacagtaagatggcatcctgagacccaaaaggccttactccttactcaatgttaccctggactcctgcaacctttgcttttatgttctccttgtcttccaccctgctgtcacaatctgctctgtttcttttgttcgaataagcaagtgtgcccaaactgtatctaaggacaaggtacctggttctctaggctctgctgggcacatacggagttcttccaagggaggtaaacaaatcctagcaaacagtattctgtgacctgacctccactttacctgctgtggaagtctttcaaataatttacttcctcaaaaaaaattctgacacatgctacaacatggatgaaccttaaagacattatgttaagtgaattaaggcaatcacaaaaggataaatactgtatgattccacttagatgaagtacctagaatagtcaaaatcataaagacagaaagtagaacagtggttgtctagggtgggaggaggggagttggggaatccctgtttcatgggtacagagttccagtctgggaagattaaaaaagttctagagatggatggtggtaatggttacacaacaatgtcaatgtacttaatgccactgacctgtacgtgtaaaagtggttaaaatggtacaattcatgctatatgtatataacttaccacaaccatacgtttacagagtctctctctgttgcccaagctggagtgcagtgatgtcatctcagctcactgcaacccccacctcctgggttcaagcaattctcctgcctcagcttcccaagcagctgggactacaggtgtccgccaccacacctggctaattttggtatactttttttttatttgatttcatttaagttccaggatacatgtgcaggatgcgcaggtttgttacatataaacatttttaataataaaaatttatatcctcattatatatcactatgttctagacaggcaatatgctaagtgcattggtgtgatcaccatctaaccactccaagagggttattttatgacgcaagtcaaaatgagaccaaaaggtatcttaaagttacaattcaaaattaccatatactatttttaacacagaaaaagcatattttagaagaaccgatccttaagaaagaacactagaaaaaactgagagacaggaaagcactctagtctggggagcaaattaatgtgaacagaaatgaagaaccagtggcagcccatgggcagccttactactgagcaaatattccatagtagccacctcaaatgcttttttaaaaactcttcagggtataaaaaataataatttggaattcaaatctgagtacttgttggctaacactttaaattgaatatcagcaagaaaaactcctgaggcattttagtaattgctaaatttctcatcccagctcatgttgtcattccaaatgtgtgactgtcccacactttcaactgccaacaaaccaccttccaactctcatctaagatcctctccaaataccatctcagacagaacccaagtttcccagataaacagatactgacacttaacaaccctatctgccccacatcagtttaataattaacctttctctagactaagcaaaaacatcaaaaaagaaccaatgcaccagaccagtatgccagttaaaaaaaaaaaaaaagacccaatgcacacagtactgtgcatcatgttggaaatatcaccttatagcctctctctgcatagtgacatgcttggctcactgaagttactcaactgttcaaaccacagagttcaacaggtacttaacacatcatttaacacacaatatacagactacttttttttttgtttttatttatttttttgagacagggtctcgctatgtcaccaggctgaaggggtgtgatcacagcccactgcaacgtctgtctccctggctcaagagatatacctgcctcagcctcccgagtagctgagactacaggcatgcaccaagacacctgaatttttttttttttttttttttttttttttttttttgtagagacagggcttccctatgttgtccaggctggtatcaaactcctggactccagagatctgcctgccttggtctcccaaaatgctgggattacaggtgtaagtcactgcgcccggcctattttttgtttttaaataaattccttgagtgactgcctgaagacaaaagagaactaaataaggttataaacatcctcttgaataaaagaaagaataattacatacacgttttcaggtgtctctgagttagaggaaaaggtttacaatcaaatcattaagacttatgcagtgaagtcatatgatttttctattaataatgtgtcagtgttcttatccttcctcccccttttgaaaagtttaaacatgaatctgcaacaacctgaccacattctttctattttaaatcattttccgcgaggcgcgggggctcatgcctgtaatcccagcactttgggaggccaaggagggtggatcacctgagatcaggagttcaagactagcctgaccaacatggtgaaaccccatctttactaaaaataccaaaattagccaggaatggtggtgcatgcccataatcccagctacttgggaggctgaggcaggagaattgcttgaacccaggaggcagaggttgcagtgagccatgatcgtgccattgcactccagcctgggcaacaagagtaaaagtctgtctcaaaaaaaaaaaaaaaaaaaaaaaaaaaaaaaaattcttttccaatgaggttagtatcccctgaagaatgggagactcctatcaaaatcccactccccaaactctaatggtttaaaatctcgcaagtaaccaaaatccccacacacttttatcccatttaataactatgtatatacagaaatattattttcaaatacaaaatatcccagttaggtaacgaatgctatatactaaaagaaaaatactctgccataaggaagttgtatcatttactcattacaagttcttttattttatgttattccaaaatattggttataagccaaataatccaagaaagcaaaattttggaaaattataagagaaaaaatgtaacattaaaaatattaaagatgtaaaatgtctgcctaaataatggccttttggtttttggactgtatctatttacttaatgtgaacataacatgacgccaaaataaaaagccaatgaagtttgtatagttcatcttttctacagactttagagttaaatgatacctgctgctacaccaccattccacagctaaacccagtctaggtatcactgtgaaagcaaaagtatactacagaagcaggaagattatggataggcaaatcatactgggttggttggtttgttttttgagacagtgtcactctgttacccaggctggagtgcagcagtgcaatcatagctcactgcagcctcgaactcctgggctcaaaggatcctcccacctcagcctcctgaagagctgggactataggtgcccaccaccgcgcctggctaatttttttatttttttggagacacagggtctcccttttctttcatccaggctggcctcgaactcctggtctcaagcgatcctcttgcctagcctcccaaagtgctgggattataggcgtgagccactgtgcctagccagcaatcatttttaaaaggaaaaatctgagtttacaacaaaacagcaaaaaaaggaaattccctttcattgtgtattttgtttctcgtgtatctctttagttgcttctcttaaaaatgtaatagattttaaattaaacaatctgatcacataaaagtcaagaaatttaaaaagagccacaaaaagaaacaatgtatcaataatagctaagtcatcaattactctcttggctaatgaggctgtgaatcttgggtggagtgaccaaatccagcttagttgctggtcagtcagttggctggctagcttaacacgggaaagacagaattattcagcgaaatcatttcacaaaagaaaaccttttaactttgtggactattccccatggatccctacaccacaggccttagaacattcccaacttttatcacacagatatctttgcagtaaaaaacacaagcctttgttaggaactaacaaaataagaattcacttacaacatctaacccatctcctttacagtaggaacaagaaaaggcacaagacgacattggtgaaggaaatgcaaattgttgcagcatttgcttcagtggagaatatttaaaagtccaccttcctagaaagagggttaataaaaaaaaaaaggtatcttagtcatgctgatttttttaatcacacctgacataatttttagttaaccttttgtttttgctttcattgttgcactttaaatgatttgataaaccagctgactatcctgtatatataagtcaactgctgtcattgaaaaggttgttaaagctttacgcacacattcttaattcacttaactttaagaaaccaattttcattcaattttctcagcaaattctaggcattaagaaactgattcatctactgacaccttaaactctaacttgttaggaaaattcatgattcattcttcaaatctgttgtctacaaatatatagtacctatattctaaaaatgggaagtcatagattaataccattgtctgtgaacataaggactcccaagaactaccaatcgtaacctgcaaagtattgcccccactgaaaagtgaccttctaagaagttcctcaggacagaattttaagttattctggattacaaaaaccctaagaatcattataaaagcaaagggtcatggccaacacggccataactccaagtttacatacaagctatcctcagtttgttagtattgcccctttaaccctcaaaagggtcctgttttgaggcaaaactcatctgtggtgacagaagtcagaattgtggttgccttggggagggggaatgtgtttactgaatggaaaggatacaaggcctgaaaatgttccatatcttgatctgagtgtggttatcagggcatatacatatataaaaagtcattgaattgtacccttaagatctttcggtaggttatacatacctccataaaaatacattgttaaaaatctattcaaataatcatataaaaccattctggatctagctaccaagatgttttttccaaatgaattttaataaagacacacattgcgagcacttttatgtagtacctctcaaaatatacactgtgatttctaagaatctttcagttaagaaagccaccgaattttcgaactgaaagcacccccaaacatcatctgtttatcttaatgttgcaaataaggaaaatcaaagctacaatgggtaagaaatgtgcccaagataaggcagttagtcaatgacaacggtaataacagaactgtttcctgatctctggccgtttctaccaggccgtaacttttctgacatcgcaaacaaatcttaactccgaatctacctacggcctaattcaacaaatgcctcaaaacgctagtcaacaggcctcaaagtgtacacatgaagacacatcttccttcatcctctcgccagttgacaaattaatgattacacgttcaggcattttacccagatgcaataaaattaagaatgacatcttagaaaatgtggttcaagagaagacatacgcagggattgacaaaatccatcttacttcctttcgaatctctttgatggttacttggttctcaaacacagatcactgctaacaggactcaaaaacaccacttgggaccatcaaccagtgctgcttcgggcgacccgctgggaacacccccacctgacccaagcgtccaccactccttgagcacaagctctgggggtgacctgtgcctgccggcttagttttagaccctacgggaacagctgacatcttgtgaaaaacttagcataacgtacatcctttccgcgggaatttatttctgttcgcacaaggcgtttctgctccgcacagagcaggccttgcttcccaggacgccgctcgcccctccacagcctccttttcagcgtccaaaatcggactttaggaacagaaatcgaaacggtcgcggacctcccgagcggcaggtcggggcgctgccgggtcggcgcggggtccagcggcggtgcccggcgggccgcggcgcgggagaggcccgctcacttcacaacggcggcccggagccaccggttgcggcggccactagacgctccgccaccgcgcagcgaccgcccgggccctccgaagttccgaccggccgcgcgcccggccccagctgcgggttcgcgccccg

SEQ ID NO: 1020 - DNA, 142507 bp, Homo sapiens; identical to SEQ ID NO: 1018

SEQ ID NO: 1021 - DNA, 65104 bp, Homo sapiens
atcggtctcttctgttccgcgtcctccacctcggtagcccctggtgactctgtcacagcctctgttgacctatgatctgcagggagacgcacagccaggacatcctggaacctgggaaagggtgagtgtgcggggttgggcaacccgagaagggagaccaggctgtgaaaccagcagaaccggcctctccacagcccgctcccaggtcgccgacctgagtccccgctggcgcagctccgtcccaggcccctctggccgcaagatggcggctgggcccacagccgggaccccagcgtccagccccgtccgtgcggggccatgtctggagccccctgagcaagctcttcacgcagcctcgagtatttcccaggttgttcagggatgccaggcgggtcataagagcagaatcccgacccggtgtttgcgtgggaagaactgcagcctatggggctcccagtgtcttttgttaaacattttgtttgagacggagtcttgctctgtcgcccaggctgaagtgcagtgcgtgttcacggcaacctccgcctctcaggctctggtgattctcgtgcctccgcctcccgagaagctgggattacagacctgcgccaccccgcctggctaatttttgtatttctagtagagaagtggtttcgccatggcggaaggtggtctggaactcctggcctcaagtgatccgccagccttggccccccaaagtgctaagattaggaggagcatgaggcactgcgccaagcctcttctcttaaaaattaaagggagtcagggttaaaaccttaaagaggttatttgagccgtgattggtgaaatggaaagcaccccagccatagtatgtggcccacctgagagacataaagcaaagggttttataaagggcgtgtgagaaggcaaaccaaatgcaagaattggttagttatgtagtcaccttatttgtatgatacaggtggaaatttcctggttatgtaatcagaggttaattgcaggtttatgattggttaataaaattcaattatgattgaattttgtttccgcctaaaatagtaatctataagatataaactcgagttaggttttacattttttacttatgaacacagggcactagggccacttcagtctaatttcctgctttttaattactttaacactccacaggaggaggactggttttcctctgtgacttcctaatgtatggcaagcaggacttcttctaatccactaccctcttcccctagcttaactaaggcttgcagtaaaattataaatttccactttctttcctacattctcaaatgtaggaaatgaggacaaacaacttcctctctccaatttacaacactatcaactatttgtcctttattgtgcatttcagacacagtgttttaattgttaatcatgtttttacactgcagtggatggcaggtttttaaagatttgttttctgtttgtaaacacttttttattggagacagagtttcattcttgttgcccatgctggagtgcaatggcatgatctcagctcactgaagcctctgcctcccaggttcaagtgattctcctgcctcagcctcccaagtagctgggattataggctgccaccactgtgccctgctaatttttatattttgagtagagagtgggttttgtcttgttggccaggctggtcttgaactcctgacctcagatgatttatctgcctcagcctcccaagtctgtaaacattttatgtgagaaaaaaagtagaaaataatcctctggaactccactttaaaaaaaaaaaaaagtctgcgcctctccttcttttatcttccctaggcacacacaccctactagtacgtctttgggttgaagttttgctttggagaaattacagggcctttacagcagccctttagtctattcttggtaatgagtttcagaactgtctggggtaactcaacatacccacagtggccatatatcttggagtgtctaatgagtatcatcccctgagtcgtctcttagaggacagtctgaggagtaagagtgtagcctctcagaagagcaactggatggcctaggcctgtggaaaatttccttgtatactatttgtctaaaaagctaacctcttagaaaattaaaattattttttcacaaaggaatgcttctacactgttggtgggagtgtaaattagttcaaccattatggaagacatggtgggaactccctgaagacctcaagacaggaataccatttgacccagcaatccattattgggtatttacccaaagcaatatgaattattctattataaaggcacatgcatgcgtatgtgcaccgcagcacacttcacgatagcaaagacatggaatcaacctaaatgcctatcagtgatagactggataaagaaaatgtacatataaaacatggagtactgtgcatctataaaaaaaaaatgagattatgtccattgcaggaatgtggatggaactgtaagccattattcttagcaaactaacacaggaatagaaaactaaataccacatgttctcattataagtgggagttaaataatgggaacacatagacccgtagaggggaacaacacatgctagagcctattggaggagggagaggatcaggaaaaataacttatgggtagtaggcttaatacctgggcgatgaagtaatctgcacaacaaacccccatgacacaaatttacctatgtaaaaaatttgcaatgtacccttgaacttaaaagttaaaaaaataatttgttagcttttccaataattccctgatagcgttttgattttatgtgtgtatgacacctattatgtatcagaaatttggattacacagatgaacagggttcaacatacctgccgtgtaggagtttatagttcattagcatggataggtgtgtaaaaaattaatttattctggagaataatacttgtacataaaaagacataaggtattgagctgtaaggtaatagtgatcaattctgccactaacatagcagtgggaatatcaaggagggctttatagaagaggtgacatttgagtgggtgtcattgtttaatagaactttttgtattaatgttgctggtgcggatatttcatttcctttttttttttttttttttttttttttgagatggagtctcactctctttcccaggctagagtgcagtggtgcagtctcggctcactacaacctccacttcccaggttcgagtgattctcccaccgcagcctcccgagtagctgggattataggcatgagccactgtgcccagcctcagagtgtaccctttaaaaaattattttaaaaaaattttacctcttgactctgaaatatattgagaggtcttcccccaatgagataaaaatgaacaagtgtgtaaacagttaagaagttttttctcaagctaattttttttttttttttttgagacagagtcttgctctgtcacccaggctggagggcagtggcgcgatctccccggctcactgcaagctccgcctcccgggttcacgccattctcctgcctcagccttccgagtagctgggactacaggcgcccaccaccttgcccggctaattttttgtatatttagtagagacagggtttcaccgtgttagccaggatggtcttgatctcctgacctcgtgatccgcccgcctcggcctcccaaagtgctgggattacaggcctgagccaccgtgccgggccaaatgtttttttttttttttttgagacggagtttcgctcttgttacccaggctggagtgcagtgtcgttatcttggctcactacaatcttcacctcctgggttcaaccaattctcctacctcagcgtcctgagtagctgggattacaagcgcctgctatcaaggccggctaattttttgaatttttgtttgtttgcttgtttgttttgtgtttttgggagacagagtcttgctctgtcatccaggctggagtgcggtggcatgatctcggctcactgaaacctctgcctcccggtttcaaaccattctcctgcctcagcctcctgagtagacaggtgcgtgccaccacgcccagctaattgtatttttagtagagacggggtttcgccatgttgcccaggctgttctcgaactcctgacctcagattatccacctgcctcgccctcccaaagatttggggttacaggcgtgaaccacggtgcccggcctaattttttgtatttttagtacatacggggtttcattatgtttgccaggctggtctctaactcatgacctcaggtggtccatctgcctggggctctcaaagtgcagggattacaggtgtgagccaccacgcctggcctctcaacctgatttttatttttagtagacacattggtgatgagacaatcaaatgttcgcattgatgagaaaaggcagaaatgatttttgttctctggattcttgaaataaaattttttccaaaggacaagaagatcccatcccagtaaggcaatgcaagaacctgcaagcaaaatgtacctgagactcacagtggggtacaaagtgtctcctgggaaggtggtcactgagtaatttaatgggcaggatggggatgacagaatattttgagtgatattatggtctgacttgacagtggagtcagacatgtttgtgtcccaatcagcactgccacttcctgagtttgtcaccttggaaagattttttcacttatttcaatttcagtttttttttttttttttttttttgagacagagtctagctctgtcgcccaggctggagtgcagtggtacaatcttggctcaccacaacctccgcctcccgggttcaagctgttctcctgcctcagcctcctgagtagctgggattacaggcgcccaccagcatgcccagctaatttttctatttttagtagagacggggtttcactgtgttggccaggctggtctggaactcctgaccttatgatctgcccacctcagcttcccaaagtgctgggattacaagcgtgagccaccacgcccggcccaatttcagttttttaataactgtaaattacatttcatcagaagagcttaaaagatgtttaaaaagtcaacgactatgaaaggtatatttcagaaaaatctagtgatatgttttatttgttaaatttatgtttttttctggttgtgtaattttaaatagaaccccaggggtttgctttgagaatgctaccagagaagagaaataggaaaaatcttttttccattatggctatacaaagtgaatacatttccacaagcaaatatgatagattaattggtgcattgtatatatttctcaaaccatcagctcctctttttttcaaagtctagaatttgtaatggtggatatctctgttctgtattctgttgtctagatatccaagtttaatgcaaaattttatgacatggaacttgacactttctagaaatgttcacatatggttgtttattaaattatctctcatggaaatatttaaatgacatgtttattgtctgaaaaggacagatatttaagctttttttttttttttttctttttttttgagaaagagtctcgttcttttgcccaggctggagtgcagtggtacaatcttggctcactacaaccttcacctcgcaggttcaagcgattctcctgcctcagcctccctagtagctgggattacaggtacacaccaccaggcccatctaatttttctatatttagtagagacagggtttcaccatgttggccaggctgttctcaaactcctgacctcagccaatccgcccgcctcaacctcttaaagtgatgggattacaggtgtgagccattgtgcttggccccctttaactattttatgtgactcttctctcttacctgaacgttgcccaaaaagagattgtgacatatatttgggcccagcaccaaggtgatgtaactctcctcttcagccgggccttgcccacagaagagagaatgacttattcctgagtttagcatacaggtgatttgattcttctgctgactcccagaagtcactgtaacatatatctgggtccatcgctgagactgtgtgactctcttctccctgggacctgtccacagtggggattgtgacgtattgcttggccaagcacctacgtgatatgactcttttcttaggcctgggccctacccactggagtgattttgacacattgctgggcctagctcaaaggttatatgtgacttcacacttcttcctgggccctacccatgaggggcactgtgtcttaactctgagacacttaattaggtgatgtgactctcttttttcgagatggagtctggctctgtcacccaggctggagtgcagtggcaaaatcttggctcactgcaacctccacctcctgggttcaagtgattcaactgcctcagcctcatgagtagctgggattataggcatgcaccgccacagtcagctactttttgtatttttagtagagatgaggtttcaccatgttggccaggctggtctcaaattcctgacctcaagtgatccacctgccttgacctcccaaagtgctgggattacaggcgtgagccacgatgcccggccgatgtgtctcttttgtttggaccctcttcttgggatattgtgacatattgctgggcccaaaatctaggtgatgtgactctactctttggtctctgcccaaaaagggattgtggcatatcactgggtcaagaacctagatgaggtgactctcctctccagtctgggacctgcacacattgtgtgttgagacatatcactgggtctaacacctaggtaatgcaactctcctgcaagggccccgcccacagaagtattatgaaatatctttatattaatcacctaggtgatgtgacactcctcttctgcctgggaactgcaaaaaaagtattattacatatcactgggcccagcacctaggtgatgtgactctttgctcatgcatgtgctctgcgaactggggtgtttgttacatatagttgggcctaaaccctaggtcatgtgattctttcattttcctgagccatactcatagcattttgacatatttttgggcccataatttagatgatgtgactctcttgcatgggccctccccataaaggtagtgtgacatattgttgagcccagtacataggtgatgtgactcatagttctctatggattgggctttgcccaagcagggattgtgatgtgttgctggactcaccacctacgtgttatgactctcctcttctgcctaagccctgcatgcattgtgtgttgtgacatatgcctggattcagcacttaggtgatataactttatgacatgggaactgcccatggaagtattatgacatgtctcctttccatcacctaggtgatgtgacccttttatttttcttgtttctggcatattttgggtatagtgacgtatcattgagttcaacacccatgaaatggaggcttctgcctgagcccagcacataagtggccttgtgaaatatctttgcattcattatctaggagatttaaccccccttttctgcctgcaccctgaccactgggaagattgtgacgaatcaccggtctcagcaatcaggtgatctgtttttcctgcctggtccttgcccacagatcattgtaacatatcactgggcctagcatctaggtgatgtgactctgctgactgtattctgctttcagggggagattttaacataaccctaatcaagcacccatgtgtgggtgtggcacttctgccttatccctgccctcagagaagattgtgacatatcactgccccaaaatgcggtgatgtgagtctactggtcaatacctattcactggtgggattgtgatgcatatcttatccaaacttacaggtgcaataatgactctcatacctctaaacaaccagtagcagatgtagtttctctcatagccagcgtcaggaaaatgagtaatatcctgggcctcctctttgtatgaaggtcataaagaattaacactctctcacatactgtgtaaagttgtcaagaggtacagagaatgtcctaacagaactcagcacacaggggaggttgtgacactcatatgcatagcctgccaacagtaaagactgtcatccttccacataaacacagctcaatgttgaggttctgaatctcatacccagctgcagtcaaaagttggaaaattgaatgtcatgttaattcagtccatagagaggtcagtgtctctgagaccaagattcagcacatgtgtgagttgttgacttcaataaatgacacaatttgcaggagggattgaggttttcatacacaaatccagaccgtcattgagactcattcatgtacttatacccaacatacagagggtattatgtctcatacctagaactaaaaaaatgtgtgaaattgttaatctcatacctccaccttcatccagatgtgattgtgacatacaattctgcccagcaactgagtgatttgactctcctgcctgggcccagtgtacagacggggttgtgccatattgctcaacccagcatttaggtgatgtgaatctattcttttgtcctagtgcttttcacagagggcattggacatatcactgtgagtaatgtccaggtgatgtgacttttctctacttcctgggcttttcccaagaagggactgtaatatatttctgggtccagaacctaggtgatgtgactctcctctcctgcctggtttctgttgtacattgtgttattgacatgtggctggttctaataccttggtgatgtaaatctcctgtatgggccctgcccacagaggtgttatatcttttcattcatcacctaggtgatgtaattctgtttttctgcctgggccctgccggaagggaggattgtggcatatcactaggcccagcacctaggtgatatgattcacctgtttttcctgtgcctcacatattttgagtactgtaaaatattactagacctaccacctatgggattgcgtgctcctgcctgggctctgcccacagggacattgtgacatatatctgcatccatgaagtaaaagatgtgacatttcttgcctgcaccctgccctgcacaggaaagattgtgacatatccctggaaccagacacaaggtgatttggctcttctgcctctgtcttgcccccagggagcattgtgacagtgctgtgactctgttgcctgtgctgtgctttcaggagagaattgtaacatatccctggctgagcacctaggtgatgtgacactgctgcttggttccttccctcagggaagatatccttggctgaaatcccaggtgatgtgactctcctcctaactccctacctacaggttaaatggtgacatatactatagtcagcttataagtgcgatgattactctcataactcaagtcagctattagaagaaatagtgtctctcatagcttgccttagatgagtcacatccttggtctctctttttatgaaggtcataaagaattgccaccctcccacatatcatataatgcccttgagtgttacaaagagtgttatcccagggcacagcacaaaagtgagcttgtttctaatatgcacacctcgccaaccattaggattatcaccttcacacatggaaagagcccattgctgaggtcttgaatctcaaatgcaaacactgtccacagttggaattgtgactgtcatatatgagcctccagccacagttgagatggtgacacatttctaaactcagaacatagcagatgaggactactatccaaacccaaccaactggagagatgtttaccccaatacctgggcttagggccagaagtatggtcatgggtgcttacaaacatgattttagagtaaattgtgactctcatttatactggataaagccattgagtagtacagagagtgtactagccgggttgcattgagttgagatcgtgccactgcaccccagcccaggtggcagtctgagactccgtctcctcctgtgtgtatgtgtgtgtatatatatatatatatttttattttggatggagtatctctctgttgcccaggctggagtgcagtggcacgatctcagctcactgcaagctccacctcccaggtgcacgccattgttctgcctcagccactccagtagctggtactacaggtgcctgccaccacgcctggctaatttgatatatatatatatatatatcaaattttttttttttaagacagagtctcactgtcacccaggctggagtgcagtggcgtgatctcagctcactgcaacctccacctcctgggttcaagtgattctcctgcctcagcgtcctgagtagctgggattacaggcacgcaccaccatgcccagataacttttgtatttttagtagagatggagtttcaccatgttcaccaggatggtctcgatctcctgacctcatgatctgcccgcctcagtctcccaaagtgctgagattacaggcgtgagccaccacagccggcctggagatttttactgttgtatgaacacacatcaaatagcatacatcatcattttctcacataaacatagcctactcttgaagttctgactctcacacatagaggtagtcagaggtggaaaaattgactctcatatgtggattcagtttgcaggtgagttgatgacacttagagcaagattcagcacacctgtgagtctgtgacttcactaattagacaaagtccacaggaggagtataggctgtcaggtacaaatttagttcatcgttgaaattgtaactcctgttcttagacacaatatataggaagggttaacttcctattcctaaaaccagaacatgtgtgggattgttaatttcatccctgcaccttcctgcaggtttaattgtaacattttcagcacctgagtgatctgactcttgcctaagaccagcccacagatggaatagtgacatattgctgaaccctgaactgaaaggatgtgactctatttttctgtgttggtgctgctcacaggggacattgtgacatatcgctgggccttgcacttaggtgatgtgagtctcctcctttgccttggcactgcccacagaatgcattgtcacgtatctctgggccccacacccaggttatgtgactctcctgactgtcccctgaccacataagcaattatgacatattgctgggtccgactctctggtataactctactgccaacaaggagcattgtgacatatatttccactcatcatcaaagtgatgtgactctcttctcctgcctattccctgctcacagtgggagttgtgacatatcacttggctccgtaccaaacaaatgtgattcttcttccatcatgagttctgctggcaagggagattgagacatattatggagctctacaccaatgtgacattactgttttgcctgggcctggacctcagaagccattgtgacatattactgggctcaacaaggtaacatgagtctcctgtatggaccctgacaacagagcattgtgacatctttaagagcatcaactatttgatgtgactctccttttacacaaggcttccctcatatgagagattgtgacataccttctggcccagaaatcagatgacatgtttcttctgcctgagctttgcttacagggagcattgtgacatatcactggtctcagcacccatgtgatatgactctactgtctgtgccctgatttcaggaggaaattgaacttatccctgactgagcacccaggttttaactcttctgcctggtgtctgctctcagagaagattgtgacatatccctggcctgttacccagatgatgtaactctcctgctcactccctatccacaggggagattgtgacatatacctttgttcagatcataggtgtgatgtttactctcatatcaaaaatcagccaataagagacaaactatctttcatatgtgggcttgggaaaatgagtaagattctggctctcccctttgtaggaaggtcagagagaattacactctcacatattgtatgaagccccgggtggtacagagagtgtcctaacaggttgcagaaaacatgagattgtttttgtgtatgcacactttgccagttgttaagattatcaccttcatccatggacagagcctactggtgtggtcttaaatcttacaggtggatgcagtgcagagttgaaattgtgactgttgtaagtgaacatcaggcaacagctgaggtggtgacttattaataagcctagcttataggtaggtggcaactctcatatctggacccagccattacagaggtgttaactctcatatctgggcatagagccacaggtacgatcatgggtccatagcagcagcaaagtctcccagccacaaaagattgcgactctcacgtgtaccttataaattcctcaggtggtacagagagtgttctaactaggctcagtgtagagtttaggttttcacactcatgcacacccagccaacagtaaagattttcatcttttcacatgaacacagtccactggaggttctgaatctcatatgcagagacagtcacaagttggaaaatttactctcataagtgaattcagtccaaaggtaagttggtgactttcagaccaagattgaacacacctattagtctgtgattccactaaggtgacacagccagtaagagggattgagtctgtcattcagtgattcaattcattctaaaaattgtgacttgtgtgcttagatccaacatacaggaggtgttgactttcataccaagaactggggtatatacaggattgttaatgtcatccctggtctttcctgcaggtgtgattttggcacacacttctgcccagcaccttagtaatgtaattcttcagaattggcccagcctacaaataggattgtgccacactgctggacccagcgcctaagtgatgtaactctgttctgccttggtgctacttgaaaaagacattgtaatatatctcagagccttacacccaggtaatgtgagtctcctctcatgccttgctgctgcacacagaagcaggatatgcacaggattgttaatctcatcttggaccttcctgcacgtgtgactgtgacagatgcttctgtgtagaacctgagtgattttactctcctgtctggatttaacccacagatgaatcgtgacatatcgctggaccagaaactaggtgatgtgaccccattgtcttgcctctgtgctttccacatggggcatttggacatatcactgtgccttgcacccaggggatgggagttttctctcctgctttggtgccatccacagtgaacattgtgaaatattgctgccctcccccctagtttatgttactctcctgcctctgctttgctcacatgggtcattgtgacagtgtgacatactgctgggtctaaaactcaggtagtgtaactctcttgtttgggttctgcctgcaggagccattgtgacatatctctgtgctcatcacccaggtgatgtgactcccttttactgcctggtttcttctcacaaaacatcttgtgacatattgctaggccccatacctagctggtatgactcttttaggctccacctgctgcagagattgtaacaaactgctgggcccagcagcataatgatattactcttttgccttgggcctgccctcagaaagcactgtaacattcatgggcccaatgccgaggtgatgtgtgtcttcagcctggaccctgcccacagggggcattgtaacatatcacttggctcattagatgtttgatgttatcccctcccctctcctaccctgtgtttgcctataagagacattgtcacaagtttctgggcccagcacctaggtgatatcttcctgggacctgccatatggggattgtgatatatcgcatggcccagtacttacttgatgtgactctcctctcatgcctgggccctgcttacaggtgtgattgtgacacatagcttggcctagcccctaggttatgttactttcctcttatccttcagttattttcacaaggggcattgtgacatattgctggactgggaacccaggtgatgtgactctcctctactgcctgaaatacaaccaaaaagaaagtttgatatattgcttggccaggatcctaggtgacgttattcttttctcctgcctaaaccctgcatacattatgtattttgacacatcgttgaggccaacacctaggtgatgtaactctcctgcatgggctttgcctacaggggtatgatgatgtatcttttcattcatcacccaggtggtatgactctccacttatgcctgggccttgatgaaacagaaattgcgacatatccctggacttggcacttaggtgatgtaactcacctttattgccagggcatggaatattatgagtattgtgacaaatctcttggcctgacacctaggggatgagagactcctgcctgggccctgcccacaggatgctttgtggcctgtcttctggttttattacctagaaagatgtagatgtgactttcctcttctgcctgcattcttcccacagagaagattgtgacatcactggacccagcaattagaaaatgtttctctcctgcctgagccttgcccacaagaacattgtgacatatccttgggctcagcacccaggtgatggaactctaccacctgtgccctgtctacttaggctattgtgaagtatagctggtttcaatacccaggtgatgtaactctcctgccaggccactgccttccagtgatattgtgacatgtctttgtgccaatcacccaggtgatgtgaatcttttcacctgcctggtccttgttcactaggggataataatacatattgctggtttcagcaccaagctgatgtgacttgtctcttcttcgtagattctatcccccaaaaaactgacatatcactaggcccatcagcaaagttattttgcctggtcctgcccttaaaagacattgtgacatattgcagtgaccagaaccaatgtaatttgtctcttgcctaaaccctgcctactgggggaattgtgatagatctcttggccaatcaactgtttgatgtgactttcctttgtgggttttttgttttgtttttgatggagtttcactcttgtttcccaggctggaatgcaatggcgcaatctcggctaaccgcaacctctgcctcccaggttcaagcgattctactgcctcagcctcccaagtagctgggattacaggcctgcaccaccacgcccagctaattttttgtatttttagtagagacagggtttcttcatgttggtcagactggtctcgaattcctgacctcaggttatctgcccacttcggccccccagagtactgggattacaggtgtgagccactgtgcctggtgactctgtttttttaccagggctttgccaatagtagagatcgtgacctatctctgggcctaacacctagatgttatgactttcctctcctgcctggtccatgcccacagaaaagagagtgacttaccgctaggctcaacacacaagtgatgcgattcttctgcatgatcccagcccacaccgcttactgtgacatctctagacccatcacctggatgatgtgactcttcttcttgggaactgtccataatgaggattgtgacacatcacttggcctagcacttatgtgataagactcttcatttgcctgggccgatcaatttgggcgactgtgtcatatagctttactcagcccctaggttactctcctgtttttcctgagtcctacccacagaggtcattgcaacatatttctgagcccctcatttaggtaatttgactgactctcctgcctgggccttctgctcagtgatttttgtgacactttttttttttttttttttttttgagacggagtctcgctctgtcgcccaggctggagtgcagtggcgcaatctctgctcactgcaagctccgcctcctgggctcatgccattctcctgcctcagcctcccaagtagctgggactacaggcgcccgccaccacacccggctaattttttgtatttttagtagaggcggggtttcactgtgttagccaggatggtctcgatctcctgacctcatgatccacccgcctcagcctcccaaagtgctgggattacaggcgtgagccactgcgcccggccatgacacattttttgactgagctcctaggtaataagactcttctccattgcttggactctgtcagagaaggtattgtgatgtatcactgggcctaacacctaggtgaagatactgtcttctcctgcctggacactccataaattgtatattttgatatgttgctggggttaacacatgggtgattcagctctctcacatggatcataagcatggggttattaggacatttatttttgctaatcacctaagtgatatgactcctccctgaaccctgtcagaaggaaagattgtgacttattactgaaaccagaacttaggtgatgcgactcttctgtctagcaaccacgtattttgggtattgggacatttcacatgtccaaacacctagaagaatgggagactttggcctcgtcctgtccacagggtttcttgtgacacatatctgtatccattacataaaagatgtgatgccttttctatctgcaccctgcccacaggaaagattgtgacatacttcaggccccagccaccaagtgatgtgtctcttctgaatgtgcataactttcaggagaaaattgtaacacgtcactggttgagaacccagatgatgtgactctcctgccttgtcacagtcctcagggaaaagaaattacatatcagtggcccagcatccaggtgacgtcgctctcctgcgtgatttctgccaagaagttcgttggtaacctacatctcagcccagctcacaggtctgatgataactaatacctcttaccggtcaatagaagagatactgtctctcacagctaggcttacaaaaaggagtaaaatcccaggtctcctctctgtatgaaggttatagagaattaccactctctcgtatattgtataaagcactcggatggtacagagcatgtcatcataggacccagcagacagatcatgtttcatgtaaacacaccctgccaatttttagaattgtcatcctcacacatggaaaagcccaccgatgaggccataattctcatgcacagatgcaggccacagttaaaactgtgactatcggccgggcgcggtggctcacacctgtaatcccagcactttgggaggctgaggtgggcggatcacaaggtcaggagatcgagaccatcctggctaacgtggtgaaaccccatctgtactaaaaatacaaaaaattagccaggcgaggtggtgggcgcctgtagtcccagccacttgggaggctgaggcaggagaatggcatgaacctgggggatggagtctgcagtgagctgagatcgtgccactgcactccagcctgggcaacagtgagactccgtctcaaacaaaacaaaacaaaacaaaaaacaaaactgactatcatttgtgaacatgtggccacatttgagatggtaactctataagatcatgggtccagagcagcacaacgttctcagagcaggttgcaactctcatgcacaccatatacagtcctcaagagagtgcccttacagggccaagcacacaggtgagattgtgaaacttatattcacacccagtcaatagcaaagattgtcatccacttaaatacagcctacttttgaggttctgaacctcacttttggagatagttgaattggaaaattgactctcatttgtggattttgtccacagttgggttagtgacttttttctttgagacagtctcgctctgtcacccaggctggagtgcagtggcatgatctcggctcactgcaacctccacctaccaggttcaagcgattctttcacctcagccttcagagtagctgggactaccggtgcatgccacaatgcctggctaatttttgcatttttactagagacagggtttcaccatgttggccagactggtctcgaactcctgacctcatgatctgcccacctcggcctcccaaagtgttgggattacaggtgtgaccgccatgcgtggcctcgggttagtgactctgtaaccaaaattcaacacacctttgtgactgtaacctcactaaggagaataatttatttatttattttgagatggagtttcgctcttcttacccagactagagtgcagtggtgtgatcttggctcactgcaacttctgcctcctgggttcaagtgattctcctgcctcagccttccgagtagctgggattacagatgcccaccaccacacaggctaattttttgtatttttagtagagatggggtttcaccatgttggtcaggctggtctcgaactcctgacctcaagtgatctgcccacctcggcctcccaaggtggtgggattacaggtgtaagccaccatgcccagcctaaggcacataatttgcaaaggaaattgaggctctcatgcacaaatccagtccaccattgagactgtaacccctgtacttagacccaacatacaggaggtgttgattctcatcccttgactcaggacatgtgtgtaattgttaatgtcatcacaagacctttctacaaatgtcttgtgacatacaccttggcccagcatctgagttatttgtctctttttcctgggcccagttcacagggctgtatcactggacccagacccttggtaatgtgattctattctgccttgatacagcccacaagggtcattgtgacatatcacagggtgttgcacccaggtggtttgagtctcctcttctgccttggtgctacccacaggtgtattgtgacatattgctgggtctgtgttatgagaatcttttgcttttgccctaaacatataggccattgtaacattgctgagtccaacacccaggtgatgtaacgcttcatcctggacctgtctacagaggggattgtactgtatgtcttcaccaatcaccctggaaatgtgatttacttttcctgcctgttccctaatcacagggggtattgggacatactattgggtccagcacctagctgacgtgacatttttctttttttaaggttctgcttagaaaagagattatgacatatgactgtccctaacactaaggtgatgtaacttcttttgttttggctctgcccttagaaggcattgagacatactgctgggcctagcactaagatgatgtgagtcctctgcctgaatcctgactacagggagcattgtgacatatttcttcacccattacaatctctcctatagaccaagctcaggtaaatgccctttatacctacgtgatgtgacattcctcttctgccggggccatgcccacagaatagagagtgacttattgctggggcaagcaaaacagtgatgtaattattttgcctggtccctgcacacaggagtcactgtgatatatgtttgggcctcccacctagataatgtgactcttttcttctggggtttgtccacagtgggaattgtgatatgccacgtgacatagctcctgtgtgatgtgactcctcttcattcttgacttcttccaactgggttgattggaatataaagctgagcccagcacctaggctatgtctctcctcttgtctatgagccctacccacaagagacattgtgacatgtctctaggcttctcacctaggtaatgtgacttgtttgcctaggccatcccctcaggggtattgtgaaatactgctggaccaagaacctaggtgatgtgactctctgctactgcttggggtgtgcttaaggggaaattgtgatgtgcatttaggtgcgtccatcacctacatggtgttactctcctctcctgcctgagatctgcatgcatcatgtatttcttttaattaattaattaattgttttgagatggagttttgctcttgttgcctaggttggagtgcaatggcaccatgtcagctcaccacaacctccacctctcaggttcaagcaattctcttggctcagccttctgagtagctggaattacaggcatgcaccaccactcccacctaattttgtatttttgatagagacggggcttctccatgttggtcaggctgttctcaaactcctgacctcaggtgatttgactgtcttagcctcccacagtgctgagcttataggcaggtgccaccacacctggctggaatcatttatttcaacatatctctgggtccaacaacatggtgatgcaactttcctgcatgggccctcccacagaaatattctaatacatcttttcattcattatcttggtgatgtgacttttctattctgcttgagcactgccaaaaaaaaaaaaaaaaagattgtgacagatttctggaccaagcacctaggtgatatgactttactcacttgcctgaaacctgcatattttggttattgtgacatatcactgaagcaaacacctaggggttggaaagtttctgcctgagcccttcccacagagagccttgggatgtatttttttaatccatcacctgggagatgaaaccctatacttctgcctgcattctgcccatagagaagattgtgacatattgctgggtcaagcaaccagctgttctgtctgtccttctggactttgcccacagtgagtcttgtgacatatatctgagcccagcatgcaggtgatcttactctttttcctgtgtcctgctttcaggagaggattgtaacatctctggttgagaaccctgtgatgtgactcttctgcctggtgcatgctctcggggaagattgtgacataaccctggcccagcacacagttgatgtgactcttgtgtttgttctctacccacaggtggaattgtgacatataacttgacaaagcacacagatgtaatgatgactctcatacctcaaagaagccagtaggagagataatgttgctcacagctacgcttaggaaaacaaagaatatcctggctcttctttctgtacaaatgtcatagagaattaccactctctcacatctgtaaagccctagtgtgttatagagaatgtcataacagggtccaccatgcagatgagattgcatttgtcctatgcacagcccaccaacctttagaattgtcaccctcacacatgggcagagcccactgggtgaggtcctgaatctcacatgaatgcactccacagttggaactttgactgtcatatgtgaacatctggccgcagttgagatggtgactcatttctaaacctagctcataggaaggtgaggactctattatctggactcagccaattagagagatgttgactctgggcttagaaccacagaaaaggttctggatttccttcttgtatgaaggtcacagaggatcaccactgttgcctattgtatgaagccctcaggtgacacagataatgtcgtaggagtacacagcacacaggtggatactgtctcttgcatgcacactcagacaacagtaaagactgtcattctcccacacaaacatatcccactgttgaggttctgaatctcaaatatggagtctgttgatagttgcagaattgagtctcatatatgggcctggtcaacaggtggactggtgactctgagaccaaatttcagcacacatatgaggctgtgactgcactgacggtctgcagaagaaattttggctctcttgcaaaaattctgtcagctattgagattgttactcatgtacttagacccaatatacaggaggtattgactcccatatctagaacgtggacacgtatggaatttctaatctcattcctggactttctttcagatgtgattgaatgtgtctgctaagcgttttagtgatttgacttttctgccttagcccagcccacagatgagattgtgacatatctcttgactctgcacctcaaaagaagtgactctttttccagccttggtgttgccctcaggtggcattgtgacatatggctgggctttccacttaggtgatgggaatctttttttcttgccttggtgctgtgcacaagttgcattgtgacatattgctaagatctgcactcaggttatgtgaatttgctttttttccctaagccctgaatattttgcaagttaggacatattactagccccaacacctataaaaagggaggcttctgcttgggccctttctacagggccttgtgacatatctctgcatcagtcacctaggagatgtgactctccatttttgcctacactctgcccacagaaaaattatcactaggcccaggtaccagacaatgtgtctttcttgcatggccttttaccatagaaagcattgttacctattgctgggctcagcacctaggtgatgtcattgctgcctgtcttgctttcaggagaaggttgtaacatattcctggctgagtattaaagtgatgtgacactcctgtctggtccctgccctcaggaaagattgtgatgtattcttggccaaaaacccaggtgatgttactctcctcctttctgcctgttcacaggtaggattgtaaaatatattttggtctagctcacaggtgcaatggtgactctcatacctcaaaccatctaataggagaggtgctgtcttttatagctaggcctagggtaatgattaagatcctcggtctccttttttgtacaaagtcataggaaattaccactttcttgtatactatacacatctcttgtggtacagtgagtgtcattccagggttcagcacacaggtgagattgtggttctcatgtgcacaccccaccaattgttagaattgtcaccataatacaatccacagttaaaattgtgactgtcatatgtgaacatccagccagagttggaatgatgatttatttctaaatccagtactttagcgggtgaaaattctatctggacccatgaaaaatttacctgggcttagggccagagtaaacacagtttacaggaggaatgaaggctctcatgcgccaatccagttcattggtgaaattgtcagtactgtacttagacccaacatagaaaatgtggtgattctcttacctagaactgggacctgtgcgggattgttaatttattactggaccttcctgcgggagtgattatcacatatgcctatgttcagcacctgagtgatatgattttgctgcctggtcccagtctgaagataagattgtgatttatcactggatccagcacctcggtgatttgactcttctttttttggggacccaacaaattttaagtattgtcaattttgggtgaatcctgcacccatgttatgtgactctcccaaatgtgccttacatgttgtgccatattggggctcaatatatcacattagacattgttacatattgctgggttaaacacccaggtgatgtaactttttttttctgggactgcgtgcaggggaccttgtgacataactcaatgtccatcaccatactgatgttactctcttctcctgcctggtctctgctcacagagaaattgtgacagattactggcctagcatctaggtgatgtgactctcctctttttttcaggctccgcatatttgggtattgtgacatattgctgaactcaacacctaagggatgagagtctcctacctgtgcccttcctataggggacattgtgacatgtctctgcattcctcacctaggagatgtgactctcatcttctgcttgcaccctgcctacatggaaagctgtggcatattgctgtggtcagcaaccagatgatgtgtttctcctgcctgggtcttaataaagacaggaaagatggttgacatattactgggcccagcatccaggtgatgtgggtctcatcttctgcctggtccctgcttacagagaaattgtagcatattgctacacccagcacctagcttatgtgactcttctcttcttttaggttttgccttcagatgacattgtgacatcgctgggccctgcattgacaatttgtgactcttctgcctgtgatttgcacacttgggccattgtgacatattactgggtgtgacactcaggggatgtaatttttatgcctgggccttgcctataggcggcattttgaaatgtctttgtggctgggtgtggtgactcatgcctgtaatcccagtactttgggaggctgagggaagtggatcacaaggtcaggagtacaagaccagcctgcttaatattgtgaaaccctgtctctactaaaaaaagaaaaatacgaaaagcagccagccatggtgactggtgcctgtagtcccagctactcaagaggctgaggcaggagaattggttgaattcgggaggtggaggttgcagtgagccaaaatcgtgccactgcactccagcctgggtgatagagtgagattccatctcaaaaaacaaaaacaaaacaaaaaaaagaatgaatgaatgtctttgcaccaatcccaaaggtgatgtgactctcttgtgttacctggtctctgctcacaggaagaatcgtgacctttcacagcatatggttgatttttttcttttatttcttactttttcctgcaggaaagatggtgaaatattaatgaactaagtaccaaagcgatattacttttttttcttggacctgcctacataatacgttgtgacatattgctgcgccctgcccatagatgatatgagttttctgcccatcaactattttatgtgactctcctcttttatcttcgttttgtccgtaggttagattgcaatatatctttgggcctgggtcatgctaacagaagcgacagtgatttattactgggcacagcccacagggttgtgatattcctgcttgactcctgcccaagtggtcattttgacatatctcttggccagtcgcctaaatgataggtctctccttatctttctgtacctgtccacagtaggaaatgtgacatatctctgggcccagcacctatgtgatgtgaccttcctgtcatgccaaggccttgcctactgtagtgattgtgccatatagctgggcccagctcctatgtatctgactctcattttcttcctgagccctatgaaaagatagcattataacatctttctgagcattttaccaaggtgatgtgacttttcttcctgggttgtcctctcagggcattgtgacatgttgctggatgcagcatttaggtgatgtgacttcctctactgcttggactctgaccaaaaagggattgtgatgtatcacttggcccagcacctatgtgatgggactcttttctcttgtctgggccctacaaacattttgcattgtgacatatagctgggtctgccacccagatgatgtgtcttctacgtaagccctgaccacaagagtattatgaaataccttttcattcatcacctaggtagtgatgtgactcttcgtcagcctctaccctgccataagggaattgtgatgtatcactggacccagcacctagatgatgtaactcgtattttgactggaccttgcatattttgcatattgttacatattattgggtctgacattacgggatgggaagctcctccctgggccctgcccacaggtggccttgtgacatgttttggatccatatcctatgaaatatgactgtcctcgcctacatgcttcatgcacaaagaaaagattgtaacatatcactgggatcagccaccaggtgtgtgtctcacctctcagggtgttgctcactgagagctttgtaacatatcactgggcccagcacccagaagatgtgacttgtggcctgtgctcatcttttcttttttttctttctttctttttttttttttgacagccaggttggagtgcagtgatgtgatcttggcttactgcaacctccgcctcttgggttctagtggttctcctgccttagcctcccaagtagctgggattacaggcatgcatcaccacactgggcttatttttgtatttttagtagaggtggggcttcaccatgctggccagtgtggtctcgaactcctgacctcagttgatccacttgccttggtctcccaaagggctgagataactggcatgagccactgcatccagtctgcctgccaccagcagacatcttacagaaatagattttaatgcatccctgaccaggtacctaggtgatgtgatatgactctcctgtctggttctttccttcaaaaaagattgtaacatctttagacaagccccaggtgatgtgactcttctgcttactctctactcactgatgtaattgtgacatatatcttgccccagcttgtagttgctatgatgattctcacaccttgaaccaggcaataaaagagttactctctctcctagctaggcttaggaaaacaagcacaatccttagtctcctctttttgccaaggtcctagagaattaccactctctcacatattgtataaagctctcgggtggcacagacagtgtcatcaaggaacaaaatcacagatgatattgtgttacttttttttttttttggagacagagtctcgctctgtcacccaggctggactgcagtggcacactctcggctaactgcagtctcagtctcctgagtagctgggactacaggcatgtaccaggaagccaaactattttttgtatttttagtacagatagggtttcactatgttgtccaggctggtctagaactcctgacctcaggtgatctgctggcctcaggcttggaaagtgctggtattacaggcatgagccactgcgcctgccccccagcttcttttttgtatgtatatatttatttattttttgagatgaagtattgctctgttgcccaggctggagtgcagtggcatgatctgggcccactgcaacctctacctcccgggttgaagcaattctctgtctcagtctcctgagtagctgggattacaggcgcccgccactgtgcccggctactttttgtatttttagtacagacggtgtttcaccacctttgtcaggctggcttggcacttctgacctcgtgatccacccgcctaggcttcccaaagtggtgggattacagacgtgagccgctggacccggcctgattttctcttgaacaataattttatgtattgttaatatacataaaatattttggttcacattttgaatacattgaaaaagaaagaaaaaagagaattttcccatgttctggggtgggcctggctcagttcagggaggaagtcctccctgaaaaggctgcaacttaggctgtctctcttgtgttaggctgatcacatcttctgtcactcagggccttgagaaggtggggtcttgaacgatatccagtcagcgacattggactggaaactgtccaatcacacacacaactggagcagacagagcgacttccaggttgtagttggggggactgtgtctctagctgcagatggagctccaggtgtcgtcttcactgctctgtgtcctctgacttagagtcccagcctgtgtggccctgtgacctgcaggtactggagatccacagcaaagacgccaggacccgctgaaagcctagaaatggtgagattgccagttccgacatctggagaggggcaagggctggttggaactggtgggaagcagctgtggtgggactcaggcctccccgcagtcagctccacaatctgcaccctgagttctccttgcccaggttggcatccgtcccctgcagccataagatggcagctaggctgacagccgggcccccgggcgtcctgtcttcccagtgcattggctgtgccatgtcctggagccctctctgggcagctctgcaccagtagcgccacatctctcccagattgtgcagggaccacgggagaatcatcagggcagaatcctgactcagggttattaaaaatgtatgggtgtcacaatgaaagtattaaataatttaatcaaagggtgattcaaaaattgtagagcacccagctatggttttaatttatggtctgtggaaggggcttctcgaactcctgacctcaggtgatccacccatctcggccccgtaagtgctgggattacaggcatgagtcactgcgccagccctagtttcttaatttttacacatcagggtggaaatatcttggttatgtaatcagagtttaattggcagtttatagttggttaagcctgaagcttgtttccggcaatgtagtaatttaccaaaaaatgctcttgagtttagattattttttagaagtacaaatccggggactagagccacctcagtctaattgcctgccacttaattattttcacactccaatggtgactgatttttccctgaatttttcacacgtgtgccaagcaggacctcaagtccacccctcatcccatattcctccagcctaactctggcttacagcaaaatactaaatttccagtttcgtctgatattcccaaatgccaatttcccctccctaattcactttatcaactatttgtccttgagtgtacatttttatattattttaatcttttcttttttttttttcttattgagatgaagggagacttgctctatctctgagactggagtgcagtggcatgatcttggctcactgcaacctccaccttctgggttcaagcaattatcctgcctcagtctcctgagtagctgagattataggtgcctgccaccacacctggctaatttttgggtttcaccatgtttgtcaggctggtctcgagctcctggcctcaggtgatccacccaccttggccttccaaaatgctgggattacaggcatgagccactgcgccctgccgactgattgtttactacatgatttttcatacaaataataaaataattgtctgaaaggaataaatgattttgcttttcttactgagatataaaatgtaagcaccttaaaagtttcttcccttatgtgaacactgtgtttgagtaatattgctgaatttttctaacacttagtttcacaaaccaagttaataactctgacatggaaattaaagcttaagcccagtgactccaagctgaggctaatattgagcctgcaaaaggaggttattaaggcccagttccttttggggaacctcccctgcaaatttcccaacctgattatccaagacatggaagaagcctctatactgagagaaactacagagccttggaatgctggggatccacaggcagatgcagataaggttaatataaaggagattgggagggtcttactgaagatggagttgttattgttttgaggcagtttctagacttttaaaaataaaacagatgtatataaaaaattgaatttcgaaggagtattgcaacaggagaaagtagcaactaagtttttttgtttttgtttttgtttttttttttgtgacagagtctagctctgtcacccaggcagcctcctgagtagctggaattacaggcgcgcaccaccaagcccggctaatttttgtatttttagtagagacgggctttcaccatgttgatcaggctagtctcagactcctgacctcgtgatctgcccgcctcggcctcccaaagtgctggaattacaggtgtgagccaccgcgccaggccaagagttttaaagattgcaaagattaggcagaaaagggctttgccttccagagaaaagcaaacaagattagaaaggaggttggaggggaatgtttaaattgagtgtaataaaatcagattttagattagagaatgttttacccggacgtcagtatgttcttaggagggacataaaatggggttgtatggtggctcagactgagggtaagctcaaagttcatatcctgtgggaagagaataaacctaagcttgattaagaagtattttatgttgactactgaagacaaagtcagcttgtttttcagtgagtaaaaagaaaaagtacaaagcgtttttctggctgtgtgataggtaagaaaacagcaccatttcagtcataatggaaagaggtggctttcttttttttttttttttttttcccttaaagtcttcctggagaacacaaaggatgagaattttattgatcacagctgtttctcacctttgtgcttcatcttttcccaccttttttcttggttcaatacatttatttcacttttttggggttatatctttttttttttttgagactgagttttgctcttgttttatttgtattttattgtattgtatttgtattttattttctttgtattttatattatgttatgtattttgtttggagacagggtctcagtctgttgcctaggctgaagtgcagtggcatgatcttggctcactgcagcctcaaccttccaggctcaagcaatcttctttttttttttcttttgagacagtctcacttttgttgcccagactggagtgcaatggcgtgattttggttcagtgcaacttcctcctccggagctcaggtgattcttctgtctcagcttcctgaatagctgctattacaggtgcccaccaccatcatgcccagctaatttttgtatttttagtagggacaggatttcaccatgttggccaggatggtcttgaattcctgacgtggtgatctgcctgcctcggcctcccaaagtgctggggttacaggtgtgagccatcccgccaggccaagcaatcctcttgtacctcagacttccaagtagctgggactacaggcatgcaccactaaacctagctaatttttcttttcgtatttttttagagatgggatttttccatattgctcagggtggtcttaaactcctgagctcaggcaatccacctgccttggcctctcaaagtgctgggattacaggcatgagccattgtgcctgatcataccgtattttctttattcagtctaccattgataggcattcaagttgattccatgtctttgttattgtgactagtgctgcagtgaacacgcttgtgcatgcatctttatgatagaataatttgtatttctttgggtatatacccaattatgaggttgcttggtgaaatggtaattctgtttttagttctgtgaggaattaccacactgctttttacaatggttgaattaatgtacactctttaacagcagtgtataagtattcccttttctctgcaaccctgacagcatctattttttaactttttaatagcccttctcactgatgtgagatggcatcctgtggtttttctttgcatttctctaatgattattgatgagcattttattacatgcttgttagccacgtttgtcttcttttgaaaagcatctttttcatgttttttgtctacttgttagtgaggtcttttttttcttgtaaacttgtttaagtttgttatagattctggatattacacctttgtcagaagcatagtttgcaaatatttcctattattctgtggttgtctgtttactgtgttgatagtttcctttgctgtgaagaagctctttagtttaattaggtccaatttgtcaatttttgcttttgttgcaatggcttttggtatcttcatcatgaaatctctgccagtttctatgtctagaatggtatttcctaaattatcttccagggtcttttataattttcaaataaatatttcagcctttaattaatgttgagttgatttttgtatatggtgtaataaagtttcagtcttctacatactgctagctagttattccaccaccatttattaaatagggaattctttccacatttctattgtcatctttgttgaagatcagatggtagtaggtatgtggcattatttctgggctccctattctgttgcattggtctatgagtttgtttctgtaccagttccatgttgctttgtttactgtagctctgtagtataatttgaagttaggtaatctaatgccttcagctttgttgtttttgcttatgattaccttggctattcggactcttttggttttatatgaattttacaatagttttttttttttttttagttaaagatattttggtcatctgattagaatagcattaaatctgtaaatattggggttagtatgaccatttttaggatattgatattttctacttatgagtgtaaagttgttttccatttgtttgtgccatttcttacttctttaagcgttgttttgtaattcttatcatagagatctttcaccttcctgattagctgtattcctagatattttgttctttttgcagcaattgttaatggtattgtgtttataatttgtatttggcatggatgttgctgatttacagggatgatactaatttttgtacatttattttgtatccttaatgatactgaagttgtctgtaagtttaaagagtttttccaccaagactatacagttttccagacatagagttatgttgtctgcaaaaagggatagcttgacttcctctctgtttaagttcctttttttgttgtcttttgcctgattgctctgaccaggacttcctattttatgttgaatagaagtgttgagagaaggcatctttgccttgtgccaatttttgaggatgaatgcttcaagcttgtttttttcctttatttttgagatagagtctccctttgtctcccaggctggattgcagtggcacaatcttggctcactgcagactctgccttctggtttatgcaattctctttccgcagcctgtaaagtaattgggattacaggcacccctggctaatttttgcatttttagtagagatgggattttgccatgtcagccaggttgatctcaaactcctgacctcgggtgatccgcctgccttggcctcccaaagtgctggaattacaggcatgagccactgcacccatctgcttccaggttttgtccattcagtatgttggctgagagtttgtcataaataacttattattgtaaagtatgtacttttaatgcctaggtttttgagtttttaacataaaagatgttatattttatcaaaagccttttcagcatctattgaggtaatcttgtggtttctgtctttagttctgtttatgtgatgaatcacatttattgatttgatttgtgtatgttgaaccaaccttgcattcccaaaataaattctacttgatcatcgtgggttagcttttttgatatgctgctaaatttggtttgtcagtattttgttgaggatttttgcatgaatgttgaaagatattggcctgatttttttttttttaatctcagccaggtttcagtatcagaataatgctgttcttatataataagttggagaaaagttactttttcttaatttcttaaaatagtttcagtagaaataataccagcacttttttgtacacagctgtgaatctgtctggtccttggctttatttggttggttggctctttattactaattcaatttttgagcttcttactcatctatttagggctttgatttcttttttgttcattcttggaaggatgtatttgttcaataatattttcattttttttagattttcttgtttgtgtgcacagaggtattaatagtagacttaaatatatttttgtggggtcaatagtaatgtctcctgttatttctaattgtgtttatttggatcatcccttcttccttcattaatctagctagtggtttatttatcttattttttttttcatagacttaattcctggatttcttgatactgattttggttatttcttgtctgctgctagcttagggattgatttgctcttgcttctttcattcttttatttatgatgtcaggttgtcaaatgaagatctttcaaacttttttagcattaaatgctataaatttcccttttaacactactttagcagtattgcagatattctgatgtgttggttttttatttttatttatatttatttatttatttattttgagatggattttcgctcttgctgcccaggccaagtgcaatggcacgatctcaactcactgcaaccactgccttccaggttcaagcgactctctggcctcagcctcccaagtagctaggattataggcatgtgccaccatgatgggctaatttttgtatttttagtagagatggggtttcaccatcttggccaggctggtctcaaactcctgacctcatgatctgcctgcctcggcctcccaaagtgctgggattacaggcatgagccaccatgcccagccctggcctgtttttttgttcttatttgtttaaaagaacttcttggtttttgccttaatttcattatttatcaagaagttattcaagtgccggttgtttaatttttatgtaattgtatggtttcaagttgttttctttttgttgaattatatttttgtcaagctgaagagttctgtagatgtctattaggactatttggtcaagtgttgagtttaggttctaatgttttgttaattttcttcttcagttatctgtctattagtgcctgtgggatgttgtagtctcccactattgttgtgtcagaatctaaatctcttcataggtctctaagaacttgctttattcatatgaacccatgaattttatatagcacctttctcttttctgctttttcttccgtaaacattctttcctgtgtgcacaatgtgcaaaatgtagatgtccatgagttcaagaacatgtttagagacctagctgttgtaaaagaaaatataaattagaaataagaggcttaattagtccacataaaaataagagaaaatatcttactaaaatctcttttcttaaaacacttagattatgtgtagatttttatctcctttttttgaaatatatgtaaatcattaacagctaaataaatctttgttatgtatttattttttttttactcacgattgtctttatctgggacctgagattaattgctttgtttctgctttggcaaaaggttattcttattatttttagtcttttaaagttgacacagatttgttcacagtaaaactcattccaagagcacacaaaagtttagcataaaaataggattaaatttagcaaaacagaattataaggactaaaagatattggtaatttgattgacagaaacctgtttatccaacatgattatttacaggctgaagtacttacactacaaaagcaaaaatagtacagtttataaactgaacagtggagtatattgtcataccttggtttctatttattacttcagtacaattagcatagttatgtgtggtgttgttagacaacctgcattcatatacatttaatagtattttctacaatagtatgaatataaagccacaatgtctactttgaatgaattccttaattcttttattattgtgattcatacttttgaaatgtaaagtttttcaattgaaatatagttacagaaattttttaaaaaatcctacatacattatgactagtatgttaaaattattcctacttacatatttatatctaatatccaaagaaattttactaccacattgttacagtagatattagtctgctatgcttattaatttaaccaatagagataattataagtaagcataatttcaatgtctttcatttcacaaattggaatgctgctattgtaggacaaataaagacagatgatgtggccacccaaaaactgtagtagctctccagttagctaccttgcaggttcatgtatattccactatattaacacagtcagattttaattttttatcaaagtgctggtggaagttgtcagatatatttgaatatagattctgcattcaaaggctagaaaattagagagcagcagagatagaaaaaatattttatgattctgctgataatatacctcttttcttcataatactcatgtttctcatgctgagagtagctatgcactttgggtatttagagagaaattgtttttgcaggaatattttctggctgacttgatcaatcttatatctaatttcagttttttcttaagatgcttttaacttcttttttttctctcaatataatctttctcagagtgagagctgtttttctgtagaatgctttgtgtatctgttttagaagccctattagtatcccataatgtctgtgaaagacgtggctgtcacagtgagaactcttggagctatctctatctggatgcatgctggaaatctagcagtatattttccatgtcaccattataaatagaaactgtggcttaaataatgctctcatttccgttattgtgaaggtgcagttctacccagggaggctctcttcctgcagctcaggcttcactctttgatgtgacactaaagtgctgctatggcaattggcgttcacctatgatgtgagctgccagctgtgagccctgtgctgtggtccataccgcagtggcagatggtaggaaacaaaagaggacactggccaccagaagaggggaagccggagtactgtaaccccgtcctcagggaggagagaggtactgctttaaaatgcaagtagccaaaaagatagcaccctattcaaccacttttgtagaagagtgaaagtctgccttcagcaggcagctggcttcaagttgcagaactatcttgtcaggaagatgtgaaaaggttattttgtcattgaatataaccaattagcatatatggatgacctccccaatgtccaggtgaatttaggatgaactatgtatgacatggtgctgtgaattcttctacttgtgaactatttatggtaaccatctttatgtcttttcgatctcttaagcagactgactgtaatacatttgacattcagatttaattgtgtaatgaaagagttttctttttctttttttttttttttttttgagacagagtctcgctgtatttcccaggctggagtgcagtggtgtgatctcagctctttgcaacctctgcctgtcaggttcaagtgattctcctgcctcagcctcccaagtagctgggattacaggcacatgccactatgcccgtcttttttattttattttatttttttttattttagtagagatggggtttcaccgtgttagccaggatggtctctatctcctgatttcatgatcgacccgccttggcctcccaaagctgggattactggtgtaaaccagcatgcccaacctctttcttttctattattgtggtttctctggggctgaagagaatttttttaaaattatatttcctagaattaccggacataatataaacaaataaggtgccaaccaagctttactctagaggggactttccctctcaggcttctagccaactcacagttatgctgtaaagtgcatactgtcacctaaatatgcaggcagaattgtgtctctgcctatttggtatctatagtcctccacagtcacttctagaggggctagagcagatttctacaaactttttttttttttcttagatggaatttcactcttgttgcccaggctggagtacagtggcacaatctcagctcactgcagcctccacctcctgggtttaagtgattctcctgcctcagtgtcccgagtagctgggattacaggcatgcaccaccaagcctggctaattttgtattttcagtagagacagggtttttccatattggtcaggctggtcttgaactcctgacctcaggtgatccacccaccttagcccccaaagtgctgggattacaggtgtgaggcacctcacctggcctagatttctacaaacttaatagggcagatattaaccattttacttctttcaatgactcttgtatcttcagacctgaaactgattcagagaccatggagcccagaaacccaatcagtgtaacaagtgtgcattgagtagacatggagacatgagaatctccacttctctttttctcctcttgctaaaatgctcacaattgcaggtaacacctgctgctactccacccatccaggacctaaatctgcagctccaaattctaaatctaggtctagaaattaaaaaacaaaacaaaacaaaagtttcatttgagaaatgcaagtctttttttttttaggggagggttgggggggatggagtcttgctctgtcaccaggctggagtgcagtggcgtgatctcggctcactgcaacctcttcctcccaggtcaagctattctcctgcctcagcctcccgagtagcttggattacaggcatgtgccatcacacctggctaattttgtattacttttttcagcagacatgggcttcaccatgttggccagtatggtctcgatctcttgacttcgtgatccacttgcgtcggcctcccaaaatgttgggattacaggcgtgagccactgtggctgtctgccagtctttttacttataaaactcagacattaaaataagagcacaattatgtctttctccctactttcaactatatattgatctcttgaagctgttcactattgacaaaagtaggtataagttaaaccaataataagttatttatttaaacaaataagaatttctcacaaactagtttgtatcaccccactctctatctctcttctttttttcccttcacaaatccacttgtaattgctgctaatcagtatagattccaggcatcttgaatatttcttctcaagttacaatgcttaagcttggccccaataaactgtgtacttatattcatgttgtgtcagcttttttttaggtaaaatattatttagaattttctagagcagtctctgtgagtagatttctcctttgattgtactcgctgtaacagccaaaaatgcaaagtgatgttgattttatctagaatctgcacataaggtctggtctctgcctggaatttacaagacagggccagactttagattgagaatgtacagaaaaccaacaggaggcattttctgcattgtgagatgtccacatagacacttcagatccctcctttgagagtgtgactctttgaccttttcacattgctacctttctgtgagaggctacaggtttaaatagaatctgatggcagaatctctaagtgtaaacaagcatcttaggagtgagagatcaaggccacaaagtagccagagccctgagcacaactatagctacctggaaaatgtgatactagagtgttattgtccaaaagctagctaatcaggacaggagatccaggttctggagctccaccaggatagtttcattttctttttagaatcagcctgagtctctcctgctggcttattattggtccatcagcccagggtcactggaaatgctctcacaatcacccaggcatctgagacatttgagaatctccagaacaattgtgtcaggctgacaagagtggttaattttgcttctgtcttactgtaaaagaaatgaatcatctggtgtgtgttcctcccatcatacaagagatgtctttggttggtacccagatgagagtttctctggttccctggtacttgagtgaaaaacaaggaggaggtctggagactcaaacagataaattgattccatttcatatagtcattagaaaaatagatgaagcagtcatggtccctaccatgcaagaacttttagtcttgactatcaactggataaatgatttaattatgcatcatatggtgggtacaataaatagacatgtgcaaaaatatgggatatatttgcaccattttctttatattgttgagacttctgatgtctacacctgaacatatatttataaacaagagttattatttgcattttttagcttgctaagaacacttatttatcttctaaaaaactattttagaaaaccttaagagatttgttaaattgcttattagtatgtgatataaccttgagaggggagtggggtttaaaaagattaaaaattatacaaactctgagatttaattttttttttttttggtacacttaaaaaatgaaacagaactgaaaatactccccagtggcacaaaaaacagaattttacattagctctacaccctgtcccaaccctgatcagattcaccctttttgaagaccttatttaggtgtggccatactctggagtcttgtctcacagaactaactagaagagatcagagttttgggtgatgcatcctgttgcttttttagggttggtgctcatgattttctgaaacccaaaagcagataaatggaaaatataaaatatgatttatagggtcttaattaaaaaaattttttttaaaaccattgtttgcagagacattacatttagcaacttgttttctctccctgcagatatagttgttgattcacaaatcacaaaatagtaaatataaacacaacaaaaattcatctaaattatatgaaactctatctgtatccctctcatctgtctatatttatattctatacattttttaaaaaaaatcagtgacagccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaaaaatcagtgacagataaacagaagaagaaataaaaatgctgggttcttattctaaatccttggaattattgaacacagtataaactcacagggttttatcagaattaaataatgggtcatcacagtgctctgtaacgtcttattgagaacacagtacctgcttaataaacattgcattagtacatgtgtacatgttgttttctaaatgcagacttactcagaaattgctgctttctgttttctctgtaaactttaaagagccaggaaataatatgatactttaagataaagaatggttgtcttcatttgtatcaaaagtatttgtgttgtgacaagactgctgaatataagggactctgtcctgtgcctcatttttctttttcttttttttctttttggagacgagtcttgctctgtcgcccaggctggagtgcggtggcgccatttcggctcactgcaagctccgcctcctgggttcacggcattctcctgcctcagcctcctgagtagctgggactacaggcaaccgccaccacacccggctaatttttgtatttttagtagagatggggtttcaccgtgttagccaggatggtctcgatctcctgacctcgtgatccacctgtctcggcctcccaaagtgctgtgattacaggcgtgagccaccgcgtccggcctgtgcctcatttttctaaacagtgctaataatgagcccagagagagcgacatcagcactgacaggggacttctttaaaacacccatttatggaccctttccaaacccacagaatcgtattacatagagtggggccaaatttacgaagtgatttataagctcattaaagcttgagtagcaatgcttaggtaagtggttataagcccagacttctaattagaatcacatggccaatttgcagaactctcttgtgcccttttcacagtttgcttaatgttctgggtgaaagcatctatttgttttaattaagtgtctcatgtgactctaatttgccagaatcaagtatgacgagttcaagatacatttatgagagttaagtgccgcctttgcactaaagaggggtccaggaacctgttctgtttgggtttgttaaggacaggacagtgtggccaatatttctattactgtagcagaaattgctagtgtctgtagcagaggagagaacctgaggaccaaaaaaataaaaagcacacacacacacacacacacacacacacacacacacacacactttttttctttttttttaagatggagtttcactcttgttgcccaggctggagtgcaatggtgcaatctcggctcactgcaacctccacctcccgcgttcaagcgattctcctcccccagcctcctgagtagctgggattacaggcatgtgccaccacgccctgctaattttctatttttagtagagatggggtttcttcatgttggtcaggctggtctcgaactccctacctcaagtgatccacccacctcagcctcccaaagtgcaggattacaggcatgagccaccttgcccagctgcagagaaacttatagttcctaaatcatttctgttataaaggacagaaatgggtagagtttttctgtcttgggctttctgcctttaggtgtggtggtaagagatgaacatgtggtgctcaaagtttttaaggcatattctcaagatgcaggtataattagtccagaaaatgtcatctgagaaataattctagaggaggaggagaaagagaaaaaatgactttttttcagctaaacatttctgacatcaagagctgtgtccgctgtgcctcctggattgccatgtgcttagtatgtgcaaatctttacttctaaacttgtgttttttctccctaatgagtttttcttaactacttttataaatgcttgtgatagtcaagggtctctgaaaaatatttcgtttctatatatcacagacttctctacatcacgacttcttatatgccgtgcagaattctcaccatgaattcgtgatctgcaatattaaaaatgttgtctttggctgttgaacatggataggtgtggattatctatctgtctgtctatctatctatctatctatctatctatctatccttctttctttctttttttttttttttgagacggaacctcactctgtcgtccccgctggagtgaagtggcatgatctcggctcactgcagcctccacatcccgggttcaagcaattctcctgcctcagcttcctgagtagctgggattacaagcatgcatcatcacactcagctaatttttgtatttttagtagagacggggttttaccatgttggtcaggctggtctcaaactcctgaccacatgatccacccgcctcagcctcccaaagtgctgggattataggcatgagccacagcatccagcaatgatactctagatttctatggggaaaacctgggattcttagtaaagatggagaacatgtaatgttgaggttccttctgtgttcttaatggcattacaccattaagaaaatgctcatttaaacagaatggcatttattacccaaaaagttctgaaaaaagtggctgggtgatgtggcttatgcctgtaatcccaaaactttgggagactgaggtggatggatcatgaagacaggagattgagaccatcctggctaccacggtgaaaccccatccctacaaaaaatacaaaaaattagccaggcatggtggcacgtgctagtagtcccagctactagggaagctgaggcaggaaaatcacttgaaccttgaaggcagaggttgcagtgagccaagatcgcaccattgcactccaacctgggtgacagagcgagactgagtctcaaaaaaaaaaaaaaaaaaaaaaaattaccaggagatacctgcttatttgggtgctaaagagagactacttaaagtcactattaaaaattgtagaacatggaaaatatctctatcttggactttccatataaccgatgttttcttatggttaaattgagactgtaatttactttagtggggggccatatctcagtagtgatgctgtgtccttctgggtgcatcagcacactatgaaaacttgttcgagtgcatttgatgttaataactcacttgcttaataaactctcttacagatttttgcactatagaggttttttttcctcttcatcattaagtatctttatgcagctgatgtccatacaccatcacatttaatctggcagctgccctgtttttgaggttttctttgtatttatctttctttggtaaatgaaagctctcatctttgtttacaggccagaaaaactgaaaaagacacaggctcttccacttactggatgtttgacaaaatgatattttggggccaaaacattggcattactggtaaacttggtagagattcagtaactcagactttatttcagatctcctgaaaaaataatctgcattaacatgatgtccagtttattgtacacattaaaatttgagtggtaccttctaagtcaacatgtctattttgtctgaaaaatgtaaagaactatgtctttttcatctgaaaaacatatataactcattctgtattatgtaaatatagtactcaaaaatgtgcatgttagtgtctatgccctcaattttatactttatcatccagacaagtatcatatatacactgatgttgtggatattatgccactctcttttctcagagttagagaatacattagaaaaggtttgtgtgttgacaattattttattggataatttcagtcactcttataagtcagaaccagttttttttactctctcattttgccttgagtcaaatggaaaattctgccaatggccactttgtacatatgtgtgtttgtgtgtcttttccagggactcttgacgtttaggtatgtggccatagaattctctctggaggagtagcagtgcctggacactgcacagcagaatttatagaggaatgttatgaaaacctggccttcctgggtgaggataactttaatacaaaattccttatataaactaaaggtttcatttctcttttgtagaatgttttctggtaatttatgctttcaaatttctgttttcaagaaaatcctggggatttgtctgtttagaaaagaatttcttcaagatatttcatcttgacctgaactttccacattcctgagcggatctgtgtccttcactttagattattggtaatttcagaagtttagttgcataaaatattgttactcacaccttaaaatctaattatcatcaccagtttttgattcagtagtaccaggcagtgaaattaagaacctacaaaattaattttttttttttttggagatggagtcttgctctgtcacccaggctagagtacagtggcatgatctcggctcactgcaacttccgcctcccaggttcaagcgattctgcctcagcctactaagtagctgggattacaggcacccgccaccatgcccagctaatttttgtatttttagtagagacagggtttcaccatcttgggcaggctggtctcaaactcccgacctcgtgatcccagcctcccaaattgctgagattacaggcgtgagccactgcgcctgaccaataaaagtattttctaaatagttaaacatttctgttataaattagtatattgggataaatttattagaatattctattatatcctctttactgaacacattactaagttggtaattggagaatatgagcaagattcatgttagttatttttaataaaacaggtattactgtctctaagccagacctgatcacctatctggagcgagaaaaagagccctggaatatgaagtgacatgagatggtggatgaacccccaggtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagatatctccataattttgagatactctatgttaaactattttttaagttctctttttacatcacgtctgaaatgcacgagagtgacggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatctatgttttagggttgtgtttttcattactgtgaaaaaaaaacactggaattttgacagggagtttattgaatctagagatcactttggataatatggcagtttcacaatacttattctttcagtagaaataaaatatttttaaatttatttgtgtcctctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgttttttttttatatataagattacatggtctaccaacagcaatgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggcccccccaatgtgatagaatgccctctgggtttgtggtgaagaagggttgtagcttggtcttaaggctgctgggtttgcacaagggttcacctttagttgtcttgttaaaaggggcttggataggctgggtgcggtggctcatgcctgtaatcccagcactgtgggaggccgaggcgggtggatcacgaggtcaggagatcaagaccatcctggctaactcggtgaaaccccgtctctactaaaaatacaaaaaaattagccgggcgtggtggcaggcgcctgtagtcccagctactcgggaggctgaggcaggagaatggcgtgaacctgggaggcagagcttgcagtgaaccgagatcgtgccactgcactccagcctgggtgacagagcgagactccctctccaaaaaaaaaaaaaaaaaaaaaaaaaagggaaaagggcttggatagttgtagttttcattttcatttaatttttggacagagtgaatatctttcaggactttgctgtgtattgcagacccaggggcaggtttctgcagtcgggtctgcatatggtgttctttatatcaggatgtgatgagagtggctttcactgagtacaagagagaattttcccaggtcactttgggtttctacataggcagaaccggccatgaactgtggctcagggagctggaaatgagtcatggaactgcctcagggaccacagtaaaggccaaggtctgcaggcctctcagcatagctataaatgggtgtcttcctctaggcctctggaagagcaggacctcccccagactgtgactgggaagagtttgggatggttacagagtaagttcagaattctcactggaaccaagttaggtggaacgttttcttgtctgtagccaacaacagtagtcctgtagtttgccacctgaatgagggcctgccttctaaacagaattatcttcaatattgggctttagcagagtttcacaactcccttcctggatctcagaactctcttaaaggcacttttttttttttttttttgagacggagtcttgctctgtcacacagactggagtgcagtggcgaatgcagtggcacgatcttgactcactgcaacctccggctcccaggttcaagtgattctcctgcctcagcctcccgagtagctgggattacaggtgcccgccaccacccagctaaattttgtgtttttagtagagattgggtttcaccaggttggctaggctggtcttgaacttttgacctcaggtgatccacccacctcagactcccaaattgttgggattacaggtgtaagccaatgtgcctggccaaaggcacttatttttgagatggggtcttgttacataacccaggcaagttttagtattttgactgtaagcaattctttaatgtatcatgtagctgtcattactggtgtaaaccatgatgcgtgattctcttaaaaaggcattttcatcaggaatgactgacaaattttcttgctgtcaggggataagcaaataggatgccttttttttttttatcttgttaatgtcactctccatataaatttttactttattttctactttaaatttgtctgcaattttagattcagacatttagggcaatatactagaatttacgtgttgtgcctgaattaaattaggtaattagtatgcaggcaggcaaaaaggaattataaaattttcaaccacttttgtcagcctatatctaaataataacatagtttatttcccaaatatttgttttatatatgaggctctaaccatattctgctaaatatatgtataatttagcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattatctctgtgtttgttttcctgtatacaaaaataaatgttatccttgtattttttttctaacttgtatatttgttgtgtaggtttgttgtgaatggttttctaattctgcgtagatgagtcatcataaaattctctttttttttgagatggactcttgctcttcttgcccaggctggagtgtaatggcgcgatctcagctcactgcaacttctgcctcctgggttgaaatgattctagtgcctcagcctcctatgtagctgagattacaggcatgtgccaacatgcctggctaatatttttgtatttttagtagagacagggtttctccatgttggtcaggctggtcttgaactcccaacctcaggtgatctgcccgcctcagcttcccaatgtactgagattacaggtgtgagccaccatgctcagcccataaaatttttataatttcaacaacctatttatttgtaaatctatatgatttctgtgtgggagaaacacttttggatttgaatataatttaaaactatcataactctgtatctcttttagttattattgtttatttcttgtcaaaaaaaaacaaaatttaccacaaaatatttttaaatatttagtcatatcaattatcttgacattgtcatgcaacatattgctagaatgtttttatcttgcaaagctaaatcttaacacatattaaacaacaagtactaatttttaattttttctttttttcttttttctttttttttttgagctggagtcttactctgctactcaggctggagtgctgtggcatgattcacctcactgcaacttccacctcccgggttcaagcaattctcacgcctcagcctcctgaatagctggaattacaggtgcccatcaccatgcctggctaatttttgcatttttagtaaagatgcagtttcaccatgttggccagcgtggtttcaaactcctgaccttaggtaatctatctgcctcagcctttcaaagtgctgggattacaggtatgggccaccatgcctggccacaattttttctgttttatagcgttttgcaaacaccactctgttttttgtttttaacagtataactacttcatgtatgtcataaaatctgtgtctttttgtgattggctcatttcattttgcataatgccatcaagatttatatttatagttggtagaatatttcctgcttttgaatactgagtatattccagaatatatatatatattttttgagacagtcttgccctgtcacctaggctggagtgcagtggggcgatcttggctcactgcaacctctgcctcctgggttcaagcaattcttttgcctcagcctcccgagtagctgggattacaggcacgtgccaacacgtttggctaatttttgtattttttttttcagtaaggacagggttcaccattgttggtctggttgatctcgaactccttaccttgtgatctgcctgccttggcctcccaaagtgctgggattacaggtgtgaaccaccgtgcctgggaagaatttttatatttcaaattatatctactgaatgatttattgaaagatatttgcattgcttttacctatttgcttacagtaacaatgctgcagcttttccgcgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaa

SEQ ID NO: 1022 - DNA, 16167 bp, Homo sapiens
gccgcgggtcctgcgccgcgtccagcccgcccgcccgaccccggcccgaccccggccggccctgcccgcccggccccggggagggatgcggcggcgcggcgcccaggatgccccgcagccccgggacgcgcctcaaacccgccaagtacatcccggtggccacggccgccgcgctgctggtcggctccagcaccctcttcttcgtgttcacgtgagtcggcgccgcgtctgggggcacgcgggcagcgatgggcagggcccgcacagcccgggcacgggggcagcggtcgcgggggctggcggggccccgggcagtgggcgggcggggcgccggctgcaggcgatggcagtccctctccacccgctggggctgggggagttgaagcggtgtgccggcgtcccgggcaccggggtgagtcccttgtgtggggacaccagtgcgggctgggcacctcgggagtgtccaggcaggccctggcggggagcgctgggccctggcaggggaggaggccgggctgccctgggtgtggctgcagcccttccctccccatgggacccccgaggggacgtgggccacccacaaccatgagtcttctctgcaggtggccgtgggtgcctctcgggtctcctcctggctgcccgccccgggccagagtcaagttgttcccacgtaggtgtggcctggcctcgttgccacgtgcctgccccacagccactggtgacccgggcctggcccttggcctccttctcaggaagacccagtggtcatcacagctggagggcccaggccaggccacacccagggcccgatgttagcacatcacctccgtgggctggccatggtgcacaccaggacccttgaggtcctgtttctgggagtgagagcccgcgcctgcaggacactgggcccctccagcctcaacttcttcacccaagatacaggctggcttaggaccagagaggcatgcggacagcacagcctccctctgtggctgtggggtcaccccagggctccttcaggcacaaggagggttgggggctccaggcttcggttgcacagatcttcaaccacccaccccccttccaccaatctggggttgagacatagcccaggtggcacgaacgatggccacctgttccaaggtggggccacccctgagcatgtgagcctggagaggggcaggtaggggctgcctggcgctcgtcacctttgcaagagtttggggggcccccacgtgcatcgcaaggctgaatcgggtgcccgtggaggcgagagagttacctgcaggctggggctgggtgggcaccgcaggctgccaagagcatgtttaaaaaaggcctgtgtggacgggcttatttctggctcgggcaagccagtgtgttcttgtcacttagttgctgctggtgtggggcagagagaggtgggtggggggcagcctggggagcctggcctggggggacacatcccaccaaggcttctggaggggtgggcccagcccagtgctggtccccagggcctctgtccttgggcggggggtctggcttggttccttactctgtccatgcaattcagtgtcctttctcatgactttaaaagtaatgtgtgggccgggcgcggtggctcatgcctgtaatcccagcactttgggaggccaaggtgggcagatcacctgaggtcaggagtttgagaccagcctggccaacatggcgaaaccccgtctctactaaaagtacaaaaactagccaggcgtggtggtgggcacctgtaatcccagctacacaggagactgaagcaggaaaatcacttgaacccgtaaggcggagtgagccgaaatcgcaccactgcactccagcctgggtgacagagcaagactctgtctcaaaaaaaaaaaaaaaaaaagtatgttctttatggggaacttgtgaaatacagaaaaaaaaaatgctaagaaattaaaatcaaccccacacaccccccatctcctgtcctccttggagggctcctctgttcctggcgccgcgtctgcagcctggctgtgtggtggctgcagctgctggttccctcacgcgtgatgtcagagggccctttacgtgactctgactgtgaacctgacccagccctaggcatggagtgcttgggtggctcccactctgctgagcaccagtttcccctcctctgttctggggttctggtttcggcgacaccagcagtcttgaggtatggggttccctcctggggcagtgcaggccatgcctgcacccaaccctacacctggcctatgctgacctctgccggccctgctcctgggagaagatgccatgtgtccctgtagcaggatggtggcctgggtgctcacctgggtttgatgtgcagtggccacctagcaaggctaagaagccctgcttgccccctcagggcaggtgaggccacacccctgggctgaatggctgtcagtgatcctggcctcttccccgacccgccccgcctctgctgaactcctccgagactgctcagttcctgagaaggggttctgttgggtcggctggcccattgatgccacccatagcagctgtgctgattctgggtaggcaggggtccaggcggcccccttcttggggcaggccacttgtctacccgttgccccacctcctgccctgtatctggtccaggcacacaggaaggggagcaggttgctcttgtgccccgaatccctgcccttagtgcctatacagggttcccgacttcactgtttgctcctcggacgttaccagacagtgagtggccccagccccctctctgcactcagtaaacatgagttgctgccggtggggtggcttcacccatgcaccaggtgggcaggagttctgggtgtcatgtggtgtggggagctggaggcctgagaaccagggacccctccctcagccagatcgccaagggtcttgggaccagcaggacattcacacatctctctaggagggtctgggcatggaaggatgcccagttgtgaagagcaccctctcaggatggggcacatacagcagggcagtttctcagaggccctcttccttcaggaagccttcctaggattttgttgttgtttgtttgtttgagacagggtctcactctgtcacccaggccagagtgcagtggtgctacctcggctcactgcagtctcgacctcctgggcgcaagtgatcatcccacctcagcctcctgagtacctgggatgacaggtgggcaccctcacacctggctaatttatttattttttgtttttttgtttttttttagtagagatggggtctcgctatgttgcccaggctattctcctgagctcaggtgatctgccagccttagcctcccaaagtgctgggattacatgtgtgatcactgctcccggccccttcctatgtttctgggggttttgtatccccctgggcttcagaagccctttataccatggtataatgctaggctgggtcagctgctggcagagggttcgaagacccctaggccaggctcccgaccctgccctgacttcactccagagccacattgcagaatgacagggaccctgtgaatgtccgagggctggggctgcctggcaggctgccagtgcctggggctgagccaggctggcttatctctgtctggggcatctgggatggtgtggctggtccctagatcgtcctgagccctctccttgcctggaggcccagctcaggacagcagtcagaacaggccctgggccagactagccttggtgggccaggagggactgaactgctgactgggacctcatgagtctggggaacctgggagtgaaaactcagtgtgagcccccctgctgggacccaccgcatgtggcctggggtattcctggcccccgagcctcagtttccccatctgtccaggtgtctatagggattggacaggtaggtgcaggtacttcgaggcccaaaggcctggcctgacaagggcgcagcagcttctgccccgccggtcccgagcgccccacgggcgagtgccactcatacacaaacagtgctaatgaagaacctgatttaaatgaaaacgtctgagttaaaattttccattccacatttagctgtggcggacattctgcccctaagccacccctcttgctcggcggtatctccctgccagcccaggcgggacttggggcctcagcccgggtggggcctatggtggtggtgcatgtccctgcctgtggccctggaggagggattggaacctcggggctgggccccctggacctgccctccacccgtagcttggctggagccagccaggaggggctcagagggacatggcgggccagacactccacctccagcccaggcccagagcctgtctttgcctggccctccggcaggcgagcctggtgtgcaccatcaggtctgggtgggagtggagcctccccgagcctggacccagactactgcctgctaggccctgcctgtgggaatgcgtgtctttgagtgtccctgagcatccacacatggcctcccctgtccccatgtgtcctcatgcatccttgcatgtccttgtgtgtcctcccgtgttcttgcgcaccctgagagtgcttgtgtgtcctcacacttgccctatccacagaggggcaaagggaagcccagagagtgggagggccgtgtctgaggcccagagtgaggggcagccgagccgaggctggatagggctgggtgcagtgtgaggaggcatgtgtctatgcatgcctgtgttcacgcgtgttcacacataggtcttggtgggtgagtgatgtgcaggcgtgtctgcgttcatgcatgtgcaccagtgtgtgcacgtgtgcatgtctgcatgcaagtgttcatgcatgtatatgtgttttgtatgcagacatgattgcatgtgtgcatgtgtgccttctgtgcaccagaacaggttgtctgtgtgtttatgtgtgtacatgcctgtatatttgtgtgtgtgcacacatacccatgcacatgtgccctggagcatgtttgtgtgtgtgtccatgtcttcacacgtgtctgtaggtgcctgcgtgtgctcctcatcttctctcccactgagccctgagagctctgggccctggtgggttggcctgtgagctggtccctgttaggcaggatctgaccttggggactacagagaggacagttgcctcactctggaggactggaggagtgggcagcagctcaggtcccagtcagagaacccacaacaagcctccccaacccctggattagggcccatatgggccctcacaggcatgtggcaggtacccgcactgggcaggagggacccggtcacactgcagatttcccaaagtagccccacggctgcaaggctgctgtccagcccgcctggtgtgggggagtccaggctcagggaggacacagcagtaccgcctgcttgggctggcagggagctcaagtcagcatggggttcaggccccgcctgcctgatgggcgaacacacccccaaggcccccgttagggccaggaggcaggctggcagccagcgcaggtgcagaggggccccgaggcttccatcctgaggtcagcactgggaggacagaggctgcctccttgcagcccgagggttgaccaatggcactcgccgcatcccttcccagagcaggccagccccacgggcatcatgagggcctgcgtttggtttaatgctccgctgtcaacatcttgaaattctctgtaatttttaaataaggggcccgcagtttcattttgcacagactatgtagccagccttccccagaaggctcgtggagagctccacaggccctgcctctccctgggggagctgctcacctgcctgtgcccatcttgttgggccgaccctgccttaggggcctgtggtcctggctgaatggcgttgcattggaggccaggcacatgtttgagtgctgcctgtgtgccaggcagggctggggagggtggaaggaagcctgggggctgagccactgggcagggacagggagagccctcccagcagagggaggtgtggccgcagctgtgtcctcaccctggtgtctacctccacgggctgggccctggacaagaggaagggtaacttgggctcccagccccgccgaggatggctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatca

SEQ ID NO: 1023 - DNA, 16167 bp, Homo sapiens; identical to SEQ ID NO: 1022

SEQ ID NO: 1024 - DNA, 46908 bp, Homo sapiens
tggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccccagccagcatgggctggagaaaggctctctactgcacaggggcctcacgtgactgcagggctctggggaggtggggcacctgtagcctgacccccaccttgctgcttccaaagcttccttgcccagggctgggccttgtggggcaccccccacaccgtggtctgcctgcctgcagggtgcccagggagaccctccgcctttagaagtccaagttctttcccagccccctccctgcctagctgcctgcccctggcgccagacctggcccgcaccactggggcactgtgttcccaggggcaccctcctatcccaccagccccaaagcccagccaggcacccttccctgccacctccctgggccctgccccagcagcccagtcggcctcctcgggccttctgtcactcgctcacacacagcaccatgtcagtaaacagctaactcaggcctagggagttaggtaggatggggggagtggggtgggggggcaggagggtgtccccaaagtcaggcttggctggggcgaggcgctgccaacccctgccgccagggggctccaagctccacggcacgatctgctcagggtggcccttcttccacgatccaagccctaagaacaagaggctgggcctgggccctgcagagggaaaggggatggtggacgctgcagccactgagtggcacaggaccacgtgtaacctcagggcagggcagccaactccacaggctacatggatggagatgtggatagaagcatctgccctgggtggtgtgggctgaccccaagggtcttggcaccagggctgatcctgacttgctggtccccgaagggcgttggagggtatggtgcccatccctactctggtcccatttcctcaggcccctgatcccacagtgcctgggacagggctgtgggcccagggagcaccctccctctctgacctctgcctggtctttccgggaatgggccactgggctgctggactggaggccaaagtcctgcggggaacgtgcgggaagagcagagcgtgcaggcagcggagactaacaagaagccctggcccagagggcaggaacaggtggacgaacaaccagatgagagaacgtaccaggcatgcaagctagacccaggaatcaacgggctgaggcttagcgtcccctacggcgtccaccagcctgaccgcgggcctgctgggcccggggggaggggccttcctgctggggtcgagctgcagcgcacgggtgggcattagaggcacaatagagcaggttagttagagctcctggggggacagggcaggggcagggccgaggctggcgatgtaagggttggcctgccaggacagcacaggtagcaccaagggcgcagggagccggaaacgtgtggctcacacgggcccagggcgggcacgtgcacacacacaggcctgcacaggaagccaggggattggcacacagcaggcagcaggtcctgccatcgctggtggaccctggtgggctctcacacgcacatgcacagaagggtgcacacacactagctcacaggctctggcccatgcagggtgtggccgggcagtgttgtccccagtgggtgggagctgcaaacttgtcagtacccacagactgactggcgtgaaggggctgcttcctgggcttggccccacaacccagctgtaccccagggcccagaccagacccagcatggcctaggctgctctccagcaacccctagacacggggcctcaccggggacctgcccacagccacatgaccacttactttcaagggttccttctcagaggcctctcctgcagagctggcgccccgtggcctccgctccctccggtccaccgtggagtatccgtctgtagatggggtaaggtggggcatgaggggcgctctgagggaggccctgtaggagcagatctccctctcagcccagacacaggggactcgtgggacaggggctttgggagacagcccccacccaccctgtcctggagatccaggctggtgccagctctcaccaacaccctgccaactctccagactcccctccacttgtgggtcagagcccctggctgagcactaatccctctctagctgccctgtacctcaccctctaagcacccctaaaccaaatatctctcctccacccagcaccatctacaccccataaaaccagcaggcccacttcaggccttggtcccctcccggcacagaaaaccaaccacactgcatctgcactcacctgggcccagcgcatccatggggatcacatcccggctgccagttttctcgccctctgcaaggcaggaggaggagacgggctgcatgtggcagccaggggggatcggggcagagaagcccacacagggctggcccaggtagccctagaggctctctgtcactaaggtgcccaacctctgccagctggcagcctcaccccagcttgacaacagcgcggatgctgtgggaagggagtagccaagaggcagagggcagggaaagtggcctatggaagccgtctcagtgggaggcctgactcctccttcaccttcacccaagggtcaggcaactggggcagctggggtcgccaccctctaggctccctaagctccaccactcaccaaggctcttgtccaccagtggcagcgtgctgtcatcgaagcccccaggactcagtgctcccttaggccccttggcagtagcagcagctgactgagacataaaacacagacacagggtgggtgaagcacatggagtgggaataaggcaaagtgagcagggaatggaaggaaggccagggaagccgcacctggaagcgcgccttggtccaaccatctttctgcaaggtaccacgcagctccttgtagctccacactgtctgcagcacgtgtgacgccgccttcgcttcgcgtaccgattggctgtggggccgggggcggggtcagtggtggcccctcccccacctccgcggctccccaagccaccgaccccgcccctccacacctggaggccacgagagccaccaacgctggcaccccgcgtgcctgcaggagcgagcgcgcgttatccaggctgtcggacacgatttcgtggatggtgttgagcaccgccaccacggtgtcttcctccaggcaggcccccggtcgcggcggagcctgtgcattgcgcacattccgcacaagctcagccatggcgtagctccctgaggggcaggactaggtgtcagaacacacctctgccccacctctccaggaaggagcagggatcccgcgagggcgaggggcactgccaggagagcccctggagaccgcctgtgtgcaggcggtcacaggagcccctgtgagcagggcgctgagcttcagagacagggccggggggactggagctacctccagttgggacagcgcccaagcgagagggccggggcctggactcccaaaccactcatcctccaagcccctccgatgggaccccaaagctgcaggcacagttcggtgcccaggcgtgggctttgcaggcgtcctcaccgatgaggtctttgttgcgccggtccagcgagaggttgcgcagagcgatggcgacggcgcgcaccaccttgtcggtctcagactgcagcagttccacaagcaccggcagcccgcgctctttgcgcactgtggcgcggatgtacgtggcccactgcggaggcggggagagggttgctcagacatacatgccaggcactctcccacctccagacgctgaccgctctctccagctggaccttcctgctcccgtgcccgacaaagccctaccccaaaagctcaacggcacctccaccgaggttttcccaccgtccagggtgcacgcattgcccgcagcccatacacctcttggatcctggggtggtggtgtggcccctcctttccccgccagccgaggcaggagctgcaccagtgaggtgcctgggattccctctctcaggacttgcccaccctgcccgacctggtccctcaccatccagttgccggcactgaggttctgcagagcgccggcggcagcctccagggtgttgaagttccggctctccgtgaggagggagaggtagagacgtaccacctcgggctggtacagcagctcaaagcctaggtgcagggcaaccgccacccacggtcacccagaatctgctctcatccatcatacccctcccgcttcccgcttcagagctcccagggcgtgggtgagctggggccagggatgggtgtggatgagtcacgtaatatttactatcaacatatagtcacccaaggggaaaagcgttcccatttcacagaggaacaaactgaggctcaaatcagttggacctgcctggcagcaggagcatccaggaggcctggggtggggagggaggtgtcaaccaggaacgctctcctagcaacaagacccgcatttcccggtaggtccctgaagctatgcatcctggccacgcccctggtaatagggcccaccctccctggcaacaagaccagcattggccagtaactgagagttgtataaccaaggccacacccctagcaagaggacctgctttcaccagtaactgaagctgtgcagagagctacgccccctagcaacagggcccaccctcccccactgacaatagagcccaccctctgtaagtcaactgatgcagtgcaaccagggcagctgccctagcaacaggaggcactcttcctggcaaccactccaagttcccgggcaactgaggcgccgtcctgctgctctgcccagtgctccagaaatgaggggtcaaaacagccttccaagcttgcctgtctccaaactggggcttcagcctggcttgggtactacctcgatctcccctgtacccacccagtgacatttcatcacaccctcgccagtcctcatgccccatgctccctctactcctgccctgctgggctttctgctccaacacactccaagcacactccccgctggggtatctgcatcagccctgctctgcctgtaatactcccccacagccctcctgcggctggagccctccaccctggtgacatgcaggctcttccaactggctaggccccaccaggacagacctctctctcaagccagatcccagcatacagcccaataggcactgccctgtccctgcaggtgttcgtctggcccagcctctgaacctggatgtgagcatgcccgcctggctcccagccccctcagataactcagctttgtggctaacacaggaggccctgcctccactggaggcgtccctccaaaccttcccacctcttacgcaccgtgaggccgagcaagccctcggcctctctgtgcctgtctcccccaaccttgcctgacatgacccatggcacttcctcccattctaaaccctcagcaggtgtcctggtgctgaatcaccctccaggaaatcctgcacctaggggcctgtttccccatctgttccctgaggccctccaggcctgcttgatggctcaaagcttcactaccagggcaatcctgagcccagacatcccccagtggagctggcttcatctcagcccactcacctttggcggcctcagttcgcttgggcaggtctagcgtgtcaaagttccggtccatctcaccatccttctttcctggaagggaaaggtggtgggaggtgaggcagaccccatatggggaatgggtgtatcaggagagttgggcacagttctctcctacccaggccccaaaaggcacccccatgtccaggcctgggcacctgtgggagtggagcaccgttgtcagagtttgggcagacagtttagcctaggggtaggagttggtggcagtggggcctggggatgtcccagccctgcccctaggactcatctcccaccaggtgctgggagctgtaccacagaccctcccggtggctcccttgcaactgccaggtatgtagactgagggaagccaggagccctggctggatggtaggtggatacaagccaagaaactgaaggctgaccaggacaagactcacttgggtcacacagtaaggcagaactagggggaaactcccccagctggggtcaggacattgtcccaggatctactagccaggagaaaccccacagcagcccacctaacatttgtgtagccctggcttgcacacgtctgtgacagtgagcccactgtcaaccactctccccatgtcagatgatgcttctaccccttcagaaggcagcagagtggagccagatgacctggggtccctgccctgctcaccctcatgggacccttgtatccctccgagccacatgatgccccattctatcagagaaacagactgctccttggtgcccctagagataagtacccccgggccctgcccactcttggctctgcccaactctgcccaggtaggcaagtctgaggttacagaatgagccccgtggccttcccacctgccactgtcataaagatggcagcccgagtgatgaagccaggggtggggcagggccctggggctggaacgtgctcgcctcttcccaggtacccactgcacacgccaggcctggagagcaggataaaaagggactcaccttggtggaaccactcctctgggaggccggaggaagcagaggagagaggagaggagcctgaacaggcagcactcatcacccccccatgccctcccggaagcctcaggttcccactgcacaccctggatcaagcaggcagcatgtggaacctcatcccatcacttctgggcactgagcacccaccaggggtacaagaagagggaggcctggggtcagtggggcaggggcaggtggcgtacaggtcccccacagctgctggggaggtcctgggaacctacaccctgctagtgcagtagagaaggtgtgcagggcatcttgcccaggcagatggggggctgccccacaggttggtggcagtctacagctattctgtgaacagtgagcaggcagcagccatggctccttcccaactcatgggcaagtggaactctccccggagtagaaagactgggtctgggcattggttggtttcccttgtgtactccctgggggtcccacagtgtagatggggaaggttggacctgggtcccatcaaccatgtgacccagggcagtccagcctccttgactcctggcttccctgcctgcctgttgggggctgaccaggtgtcctctagcctccatgatgggctgctgtgggtgtacagagagccttccgctggggcaggagttgagatggtagagatgataccccagtccgccccacccacctttggccttcttgcctccaaagcagctggcatcatcccgcctccggcgctgggagcctacagcactgcccaggggcccgggctcggcctcctggtacctgtcggccccgggcacctccttgtgcacgtggtaggacaggttccgcatgatgcacacgcagttctccaccgactgcagggagaggtgagtgggtggggcagggcaccctaggcacagggctggccctcaggaaagactggccacagctggtgtgcatgagggcaccgggagcaaaggaacagggagtcctcagtggaggggagcaaaagggcggtaaccgccaggaagggtccatgggaggaagcctctgccctcacggcacaccttctgcctgcaggacggtgcccacttcagtgtggtcactgcgaggcgggccacacccagaacgccaccccagacccacaagcccattcccctgtgctgctcccacagttccagcctcctgggacctgcatgatcgtctctccagcccttggtatgaggctgtgaccgtccctgcccaccttgttgtcagtgtccttccggcccacagccgactgcagggcatgcaggagcgcgtccaccagcccttcacactcccggagtcgccgccgggcctcagcaccatcggagctcacattcctgtgtggccaagagcaggccaggtgacccctggctaccagaaactccctggctccaccctggccttgtgggcttgtcttcatctgcaaaataggccctgctgctgccctcctagcactaatgggaaaggaccccacagtctggagctcagtgaagggggagaagctaactgcccccaggcctcaggaggggagccctggcagacaactatcttggctggggatagctgggcagggaaagacagggtttccctgcctcccagctgacctggaaagggacaggtgcactctcagagagacctgaacctgtgcaagggcaattctgggtccctcgccaccccaatggcagctctgggccccaccttaccccaaggtcaagagcctgcagggctgcgcgggaacaccctgatggacaagcaggactgtggggacccaggactctgtggggtcagcagggcctcccaggggtaggaggggaagggcagaggtcacaggtggctgggatgagcctcccaggcagatgaacaggaaggtcccagctccccctctggctgtcaagtgatgggaaggtaggtgagagctgggcagggctacggtaccacagagacccctccagagggtgcccctgggaagactgggacaccacttgggggtgaggacagctccatcaggccccacttctcatccacaggacttgtgccacagctctgaagctcctaagctctggcgctcctaagctcgccgccatcttccacactatctgggaccacgaggacggggcctggtgtgcatgtgggctttagcaccaggtctggtccacacctcaggcagcccgacgtgttcttgaagacagttgtccactcggcgtcccgtggcttggagtcctcgttgggctcacgctcccatcctgagtggggcacgatcacctcgtgggtcagcgtctgcaggccatggtcaatgatgaccatcttcaggggctcataggatgacaggttccacagggtgcctgtggggtgcgattggccaatctgtgctgaccatatgcaccgcctgcctacctccccaggtggccacgctcaggacctgtcccactctcctcatgtcccagctcatgcagaacagtaggaagtaacaaaagccgtgagtggttccgggggacacccagtactggtttccagctaggaaggagccccaaaggggaggaggtgcagaggagggtgtggcagtgctgtcccgtcccacccattccctgccatgtggcaggtggcactaacactcctgaggccacagggcctcacagagacacggtgaccctacctgtccctcagctctcacaaggcacaagccccaccactgcacggttggggtgggaaccaaggaggtgggtcccaggagagtttctgtgggggcaggaggtgtgaaggcaggaggtgaggggacatgcccgaggggcgcagcgtcagcctccctgctatggtagagactggggaacctgtcacagtgtctgggcctgatgcctggctcctggggcaagcgtctcagcagctgcactcctgcctaccgggtgctttcccaggcggtcgcaggccgagtggcctcgttcctcccgggttgagcctcacactcttctcttcccaggggatgtgagcatggccaggtcccactcaccagtgacaagctcacggacctcgttgtcccgggcagccctcagcaggcgcaccagggcaggcacaccaccgcagtcccggatggcggccttgttgtcagtgtcgcggccataggagaggttgcgcagtgccccacaggcccggcgccgcacctcagcccgcgggtggtccagcagtgccacaagcagcggcagcccccgcaactgccgtacacgccgcttgacaccctcgttctcaaagcacagatgctgcaggtaggcggccgcattggccttcacggggtccacggggtgccgcagcatggccagcacctcaggcagctcagggtcccgccagcgcggctccttgcgggcgctatccactgagggcgagcgccgcaccagccggtccaggctgcccatgctgccccgttcaggctgggccaggggcgccgtcaccattgggaacgcaggccgctcgtccgccagctcgccgccatcatctgctgtgtcctcgtaggccctgcacaggcaagtggggcgcgtggacatcgtcacagcagccgccagccctgcctctgagctgccccatcacaccttcttcaggactgcaaactcacccagcagcgctgggctgagagcacctgtatcttggcccggagcatggtggggacacagagagtcatgcaccagcccagtgagaaccaattcagagccaaatgccaaaccccagccagcggctaccaggacccaggcaaccctcccaggacagcaaactcactcactgctgtcaccgggcagtttcccaatcccgagcaaaacaagtttctgtgagacatctgctatggctgctggagagaccgtctcacctcccttccacaaaaccaccccatcttccatgaggcccatctctggctgtgccaggatgtagggggagtaaatggccctctccgcatgaagccatcccagtaggaccacctgaggagtattcaggccaccagccccttggggcacaagatctccttagctctcagtagccctgtgggttgctgtcatcaaaccgcctgccctgaggctaggagtgacggtcaggtgacttggccagggtcacacaacaaaatcctgacccgggctgtggtcacatccccactccagagatgcagaaactgagggcaatggggacagaaccaggggctgtgacaagggccagggctctgggttctggttacccagagtgtggctggagcaaggccagtggccggcactcttcccagctttcctgggccctgggcctgcaggacagtgcccagccgaactcctaccaccccagggtccacctttcttctgtccctgacgagagccaaggccaattcaaactaacatgcatgactaactcaactgcgccacttgacaagtggggcactctgtagttggggggtggagggcagacttcccagaggaggtagccacaggggacggggtgcagctcacctggtatgaaggccccgcccacactcaggcctcctccttgtggccgtgccatagtcaggctccagctcagggccaccctcgtcatcagcggccaggctgcgcgtgtcatcctccaagccatacggctctgcctggaagcgctcgggcagggagcggccacctggtggcccaggctcaggacccaccgggaaggcttcccggtggccaggcagtgtgaagcagccatcaccagggcctgggccaagggggccagcacgtgggggccgcatgcccagccctcgggacaggctgccatagctggggctgtcccggggctcggggccttcgggaaagccacccccactgctgaggtaggctcgagagagtgtggccactgggccaccaccacgcagcaggaaatgccggtccagggcaccatctgcaaaagggcctagtggggggccgccatccagcagggggagtccatctgggcccacgggcacctggcgtactgtccgagtggtcaccgtcttgacagtcttggtgacctggtggatggataggcaggtaggtggggtagcacgagaggcctagaaactgctttgctggggtctggctggccttaatttcccactcgagcaatgagaggccccacgtggcaagcttccatgtccactctgcaggtgggacagctgcagcagcctggccctgctcacccacccactgcctgggcctggccataccttggtctcggtgcgccgggttgtgccatcttcggatgtgacaatagacacatgggaagtgggtgtgccggggtcctcctccaccgtcacggtctcctccagcacatcaggtgcctccggcatcgtggccagtgaggcctggctgcctgggctctgctcctggggcaaggagggacattggtgggcaggcctgctgctcagtcacccctggagtgcaggtctccacacacagcagctctgcctcagctcatgctggccagcacaccagggtgccttcctcctggtcctgaacccacccaccccaaggcctgtttcggcccaagctgacaaggacagcaataagttcttgccctctgaacatcgaggtgctaaccctgccccggcaccccatcctggggggaccctggggctggacccccatctcaggtctcctcaggctgagttggcagataaggacatagaccctggggggtgaagtcttcagggccctccccaagctgcatggcctggctgccacaggctcctccaggccccaggaggtgccagtgagacctgcagcatgccttcctgatgtcaaccaccacccctagctgggacatcatggtgtcctggggcctcctccctcacctgccccagacaccttgagtatagaagccttgtgggggctgtttcagcactgcctactgactcctgtggccacactaaggttcccgccaccaacgccagccagacgccctcaagggacagaaatacgcagttcccagaacaccccatgcacctgcagcaccagtatgtccttattccttccagcccagacattcttgagtgttgtgtaggcacaggtttgccctacctcgggccagtggctggcgcccccagtgactgagactctgggcatcatatcagagaccagacacagtagatttgagcctatgggtgcccttgccaccattctgcatggggtgacgacactggaattctaggcaagacaactctggactgagacttttctatccacatgcctactgactggacttgccagtggggaaactgaggctcaaagaggataggctggcccacatcagagccaggcccaacccctgccgcgctgagtggcttgaggacctaagactcacagcctgccccgggcctctgactgcacaggtgcctggccccagggccacatggcaccaacatccggggatcggcatctagccaggatgggcaggagctgaaacccaagccctggtgggtgggtcaggcggagcacattcccaggcagccagggcagggtcagcaggaggacaggtcctgctttgtggcccaggcccctggtccctgcacaatgggtcccttgcctgggccccctggggcctgcacagacactaagctctgccaggctccagaggcagactctgcccattcttgggcctgggaggtgagccaggttagatgctcagcgctgccctcaggacctgcctgccaaggctcgtgggctgggaagcctccccaggtcagggtcctatcctgggggaatacttgacccccaaatgcatgcagtgcaggtgtccaggaaggggcctgcaccaacatgttaggacaggtgtatccctcaggctgacagaggaaagaagtggccacagaaggcacctccccctctcccacaggcagggtcttggaggatgacagataactttatagatggggaaactgaggcctggcagggggaagaggatttacctagaacttcacagtccaagtgggatttcaagcacccccagagaaggcaatctggcaaggaaggctttgggcctcatctcgccctcagtcttgagatgtaggtggaatgcctgctgtggacctggctaggaaaaggggacctgttccctgggaaaaagaaatagactgaggcctagagtggggacaactggcacgctgccaggcagggcaggctgggctcttctccaaaggcactggggagctgggactgctctgaagcaggagaaggcttgtgtggcccatcactgctggggctgggctgccccatctgtatctggcaaatgtgtgtcaggccctgagctctctctgctgggccctgggcggggctcatctgagttcaagcaggggcccaggcactgaggggctgcagttctggcgacagagtgaggagggtataaagcaagactgaggaaacgttacccaggactctgccagtgggatgtagcccctcatatatgtatatatttacatctattaaaaactcagagaaaaaccccctcttccctagctaggcagtgggggtaagcgggagaggaaaaggggaggacatctcaggaccccgatgccactctgtggcccagcttatccctcccaccaaggctgtggtgagggtctgacaggcagagctggggtggtccaggagagccacgcccccgcagcaagacctggcaaccctgcggcaccacccatcagccccggcctagcagccccgcagtaggatccagaggccccaagagtccctgctggcaaatgacctcagggagctaaaaacgagggatgacttcacccgggtggcaggtgcatgagtcagccagtgatcacaggaaagcccggcccctgctacacatgcccaggcacacacacatgcatatacatgacccctcagacagggacacatgcatgtacatacacgtgtgcaagtacccagcccggcacaggccgagcacatcaacccgtgtgctctaacagcaccccaagggcacggcgcccactgttcccagaggcacactcgtgagcacacatcctcccgtcctccaccgtgtatcggagacccttatccatgcagggcctcacagagtctcaacacacagggacaggggccaccaactctgccaatcatctgcccagcatccactctgggagtctcagagctggctggcagatggagaaactgaggtgtagagtagtgagaggcccatagccagctggtggctcagctctctgcaacatctttagggtggggctgtggaatggtgggctgactctcaacaggagttggctgcagtccctggatccctgtctggccccagtgtccatgtctgacgtgcacctgcccaggctggcccactctcagggaccctggccctgcagccccacacagcctctgcctcagacccaactctgggctgctcccctctgtaccctagacatgggctctaccctgaacaccccacctccagcccaatcccacatgctgcatcctgtcagtcgtctctcatcaccccctccccagctggggccccatccttgctcctcttgcaccccgcccggcctcccagcactcatccctcccttggctcttcaatctctggtgcaccaggtctggggcccccaggactggcccagaaacaggctgctgcccaggcctggggtttcccatgagctcccttgggcttgtgggaggggccagagtgaccagggaggtagaccacctacccctgctcacaagagggtcccgggaacacagggctgagcccagcataggggctctgggccccatcacgcaccttcggctcagcttcttcacaaggaggtgagaaggacagagggggctggggtcgtgggacgtgctgggtagcatcagtctcacttttgtggcaaaatgcaaggaacacagggagcagaaaagcaagattggaccaacacacagagggatgctggggcacaggtggctgggccctggtcccatattacttatctacccaaaccaccggacttcacagatgcaccacggtctgtgtcctgaagaacagactgcaggggcaggcccctcccctgtccaaggcctggctagcacacacagagaatgagttaaggtgagattgcacacctggatcccacacctgcaggccaggctcccagagggcaggaggtggctgctgtccgatggatgaatgaatgaatcttctccatccccattatggccctcccaggtagagtccaggacaagccaggctggcatctctcaccaggcagcaagcccttggccaccacaaaatgccctttcccttggtgccacagcctctgaccagtctccaagacctggagcttacttctccacacagcagtgcacctgccagggcgtggccccaggcagagatgccaaaaagccaagctgggggagcaaacttggggtgggagagcagggctgactgtcatccacctcagcttccccaagctcagcttggggtcatcagacacactgtgaccatggatttcccaaaaactggtccctccacctctgagggccagaccctgggggccacaccagggccgtaggacaggcaggggcctagttgcccaggtagcaggtgtgtgggagacctgcctcccaccacagagggtcttggctggtctctcctctgctcagtttccctgcctgttactgaacccagcactgctctgagcagaggacaaactgcctatgcctccccccacctcaatgctgagagggggaggatcccgttttccttagagatctcctccagcatccattagtgggcagggcctgtctctatccctcccatcacgtgcgcctcggaggcagagaagacttccattaaagctccggaagctcctttgcaggtcccgggagtcagagccggcgtagggggtgtggaggggagaggaggaaccctctcagggagcagaaggcctacccgggcttccctcttcagacttcagcctccttcctgcacagacagaagccgctcaggaaggccctggctctccacccgtgtccccaggcacctgtcctgggcgctggccaagaagcgtccatccggtccgggccggtgccaagaggagggtcaaactgccaggggtcccgacccccccaggccccgcggatgggctccagagaccctgcggcccgccctgcatacccgggggcaccgcgctcacaccgccacccgcccggccctggccccagcctgacgcagcccagccaggggcgcaagacaatagctgcctcgggccagcggctccgcggaacaaaagcgggtcctcccgggcaggccgacgccccgccctctgcctccgaccccgggccagggtccccccaagccaacttccctccaacctgtctgagttcggccggcatcgggccgggactcggggggcgctggccagcagcgggggaggcggtggctggaccaggctcggctccggcgcctcggccgctcgggctcaggctcggcggactcgctccccgcgggggcggatctggcggcggtcacggcgagcagccaatcgggcggggccgcgcccaggtggggcgtggcgggggccggggtgggcgtggcgggcggggggcgggcaatgtgaggtcccgccccccagagacagggggcggggccctgcagccccgggtcgccccctgtccccccacttcccaccacctccccccacccactgccggcctggacttctgctccctccccctccctgcggcaggggtgtcactttcccgccgaaagactttggccaagtccttcccaggcctcggtttggcctcggtttatgaccacacttcagtccgcctgcaaagggggaaacagttccggcagggcaggtgcccgtgctgcgatgcacagagcacaaggcctccctcactggcacaaacctggctgcgactcagtttcacctgccatgaaatgggggccgatgagacagtagtcacggctctgtgagatctctccagtctcccagatcccccctcaccctcctgcccagccgccactctgaatgggcctgcgaagaactgtccccacagagttcgatggggacctggaaaagggccctgcaggggacccccactttgtatcttgggttctccccatcgaggcacagaagccccgaatgcacccccactgctcccccaggccagcctcaatgtgggccacaccctagggaatctagttctgctgcagtgaaaaatgggaggggaagggccaggctggagccaccttcttatgtcaaaccccacaaaggccaagccaatggctccagcatcacgaacagggaaacaggttctgagattaaatgagctgagaccaacccagggagactcagtgggtctggcaagagaaagggctcgggcccaggcctcccactggcttctccgcagacccctcagaaaacagcctccgcagggaccactccctgctgccctgagcgccatatacagaggccactcggctagcatgctcaagattctaggtacccaccatgtgcccctctgagcctcagttcccccacctgcagaggggtgagctaccctaccactggctggacccctgtatcttgcatctagggccaacctgcctggaacccctggagcagagcgcagaagaccagacactgcgccaaaaacgcgcccgcatcttatctttaagctggctccatcttctcaactgcaccagcagctagtgccccagccacctatccacctaagacgagcccaaggcaagttccctgatggcacccctccccactgggtgggcgtcagccctgtttcagctggctgtctagaggaggggccccttcctgctggaagatgaagggcaggtagccaggaccctggagcagcccagtgagtgcagcagcactccccctagcctggttccccagcctcagcccccagctacctgccttgccattgccctggcttcccaaagcccgggctctgaccctgtggctcagcaggtagatcgctaggcacttcctactgaaaccaatctgggaaacctggccagcccaaggaggccctgcctcccctagtatcctcatcagcccagccagttgagctgcagccctggcaacacatgctctcttcaatcccagcctgagaaaatcaagggtagggggtcggggggagagttcaggggcaggggtggtaggtggaggggcagtagcctgaggtcttgaagtcttttgcctgaggaggtcagggtagctccaggctgtgggaacatcttcccaccagggcatcaaccctccggggtgccttgggtcctcccacactgcctgtccgaggacagttccggtctgggagggttggactgagcacactggcgcctgagaggcggcctcggggtcactggcttccactgtccctatatggcccagctgggcccagcgttctgcttccccgcctcaagtttgagggtagaggcctcacattttggagtatctcaagtctgagggctgtgagagtggccccagcaccgagacccaccagaggcctctgagcaccaggggccatgaaaaagggccccctagtgagtctcggaccctctggggacattaatttgactctcaccatgcactggtgctgggctgggccttctatgtgggtctcatgagcagacgtaggaagcatgacgcctgctggccgacaccaagtctggacaccaagactcaaggagtagtcaccaaccccaggtccctcggcctgacacaggctgctggttctgagccccacatgccccagccaggtgaggagagcccatggggctgcctcaacagagaccagcgtttgctccctttctctctagatgagaagggccaggctgccccaagctcctggcatgtgtgtgccaggcgcaggtccccagagtcagggcccagcaggaccaaagaagggcgggtggaggtgcaggtgctgggagtatgctggggggaggtctggctgctgggtttagcggggcagggagctgagccagggagacaggactctgcagggagagccctctagggtcactctgtgaagaacccagaggccgcagcaggaggcaacccccccagcctctaagctgggtggtgaggagagcccccttccccgtggctgctgggacagctccaccctgactccccactgtgctagccctcagtcagtaacaggaaccatgataatcacaccacatcccaagtctccctgcatgtacttgttccggcctcctaaccccaagccaggggctcttgctgtttcatctacaggttagagcactggggtgctgggaatggggtgtcccagtggtctaactgctcactgcataccccaactttagagttcttagggcctggccatggaacacagaaggctctatacctcctgaggctgagtaggggccggagcccagtctgaggataatggccagcagagaaaatgaggctcccaggtcagcctctaagctgcaggcagagctctgggcctcctcctggggctgacccaccagtgcatgcaatgaacactgtggcagggttaggcatggtgcaggcaaacccctaaagtgtctctaggcagaccaaagagctgcccagaacagaccccatccagctgcctgggccctgagggctcagtggagggtgctgttctgagtgttgggctgtgtcctgcccactcttcacatggtgcctagtacacccaagtgggacttccagcccaacctgggatcccattttcctttcctccccaggagccccagcaaatcttgcaataagcgagcgcatgctggcttgtggtccaccaggacccactgattgttttcccacttggcaattttcacccttcccaagtcactaggctgttacctggaggaccagctgttgccaggccattggcaggggctgcccactgcccatgccaccactgaccatgccaggctgctgggcacgctccagctgtagggcaacatggcgccgctcctgctccagtgcccgtgtcagcctctcgaagcgggcctcctgctccttcaccgaggccaggatgctggcggccgagtgcacattgcagtcctccatgaccagagcgcccgccagctgcaggcaaagcagagtaagctcagtggggtggggcacagcctggcaaggccatcatgggcccctgcccgccccactcacagaccatacaactcactcccagaccagagcatccagccctctagagggaagcacactgattaaattctaaattaaaagccattaatccgaggctggccggaagcagccggctcactccccatgggttttgggactctaacctggctcctctgcttcctgctagacctagcagaaacatgggccgtgggcggcttggagcccgctgggaagggcaggaagagctcattagagcttcttacctcccaggccctctgccactcataccacatgccagcccaccctccatttcacagggccaccccactcccatctcacagaggcagatgccagggccaagaaagggtgggggaccatttgtagccacacagctggtgtggcatggccagtgtggccagcaagcagggagtgagaagctgctccactgatgggtgcccaagaccccgaggcaggcgcaggtgaccatagcctgagagctcctggcaacactggtctgcagaccagcagtccagcctccactcatatccacattggccagaaacaagagtggtgctgctacacatgacagagtaaaaactgaggacaagcctggttgaggttctggctgggactgcatgaagttaagagaccataagcctgaagtggctggtgtgtgtgatgcctcatccagaaaagggcaggggccaggcatctgaggccaagcacagggtgggattgggcctgctgggcccagcccagtgttgcccctcagggccccagagccccaggggagcaggcgggggccatgagggcttggcagccgcagagacaaaccagcactttccctcccagcttgccccctggctgcccagaatgtttgtttttcatgggtaaaaagaagcaggacaagtatgcggagctccaatccaggctcaccacagtgggcagggcatagccacgaggccacactgcccggagcacagtgagcatggccgggtgcccagggctgctcaggcatcctcctgcccagtcccgccagcccactgaggccaactccgctggatcccttgcccttgcaccaatatagggccctccacggggaggacacgcactgcgggtgacatccccagagcgtcagcactgctgctcactggtctggatggagccagctgcaaggacagagagcccccaagaggaaaagcagcgctgggctcagctgcgccagcaacacggtgcggggacatgggtgcacctcataggtgaagagacactgtggagcccagccccaccgacagctgggaaaacaggcccagcaagagcgagagaccagtgcaggcccccaaagctgctctccatttccccagcacctgtcccacaaatgaaactgtcaacacaacctttcggggaagccagcatgagtggaggagctgttttaagccagccacagaatggaagaatgcagggagagctgggggccgccgcccgagactgaggtgcagactgggcgctccagcaaagggataaacagcactgcactccccaagcatggtcacacagctcttctctacacacctgatgctgtctacccacaggccccagacccaacacaggggagccttgtgcactaatggactgaacctagtgctaggcccgaggtgggaatggtagggtattccccctgggacggccagggcggatggcagggcccatatcactccagccctcagcccagtcctggctgcagcaccagcccatctcagccgaacctcagaagcaagggacagaaggaaatgggacgctgccttggatggcaacaatcaggaccacaggatagccactggcctcatggacctggggtggcttacttccctccctgtgcagagacatggaccctcgtctacaccacacaccccatcccccatctagcaggaccaggcttgggctgcagaccctgcggacagcttccctgacctaagcccctccagcacaccctggctctggggactaaagatgcccaccctaaagggggcccactggctctggctgagggctcagtactccaaggccacagtgggaaggtgaccaaaccccacgatgaccttctcattgccgaacttggcttgattggtgcaaaacaatcatgtatctccctggaaacatccagaaacactggccagtgttgtggggagagtctggcagccatgctcaggagagcagagaccttggtgctgggcctgtgccatctgccccagccgcagggtgcaccctgcatttgccctggggggaagtgccctaggcccgcaggtcatggcctcggcatctcaggtgtctcaagagcaacccgggatatgctccaggcagagcacagaaggcccaggcccactcccctgacatggtggactctggcctatgacaggagccagtctggatacaagggatcctggcccagaaccaaagagggctgcttttcagatggtaactcaaaatgctgtttttatattcaagtaataaatatatgatgtcaaggaaagcaaaatgtgcatggattcttaagatcgatggggcctgagtggatgctgggcagagtgggcaccggatttgcttttgctagagcccaggagggccctgggggaaggctaggaagggggacactgcagggaccttggctgtccagccaatgccaccttggcctcccctaacctggtaagggcccagcattgccttgtcgggtggacccctcatgaccccccacccaaaacacagcaaccagcttcatgcccaactctgaggaggccacttcttgccaaacatgctggccccagaagtttacttagccgcaaggcaggaatgacattgcacagcccacgagtgaccagacttcaggaccatgtggacaacaccatgttccaaccagaaaacatcaggaactgaaggggggctggaaaggtcggggctaaactgaaactctgaaaaataaactgcaaaacaaaagtgacgacccagcccccacccagccccagccacaatggacattggccacgtacccaagggaatccaggaccaggacgtgagcctccaggtgctctcacaggacaaactgctgggcaagcaggtggcccgaggagagaagcatggcaggagaagagggtggccccaggcacacagcccatggaagactagagggagggcaagcaaaggagagacagcgaaggatggacagacagatggatacaggggtggatgggggatggatgaatgaatggagggtggctggggcagtggtggaggatggacagagggacggacagattgatggacaggtcggaggatcgtgggagatggacagagatgaatggatggatgggggatggtggggaatggacagatggatgaatgaatgggtcggggggatgctgaaggatgaacttatagatgaatgaatggatgggtgggtggagggatggtgggagatagacatacagatgaatggatggatgggtgggtggggggatggtggaggatgaacaaataaatgaatggatggatgggtgggtcgggggatagtggaggaagaacatatagatgaatggatggatgggtgggtggggggatggtggaggatgaacatatagatgaatggatggatgggtgggtggggggatggtggaggatgaacaaacagatgaatggatggatgggtgggtggggggatggtggaggatgaacatatggatgaatggatggatgggtgggtggggggatggtggaggatgaacatatggatgaatggatggatgggtgggtgggggatggtggaggatgaacatatggatgaatggatggatgggtgggtaggtgggggggaatgatgggagatggacatatagatgaatggatggatgggtgggtcgggggatggtgggagatgaagatatagatgaatggatggatgggtgggtaggaggatggtaggcgatggacagagagaaaaacagacgcatagatgggatggtgggggatggatggatgaacgtatggatggatggggggggatggtggaggatggacagacggatggacagattggggaatgaggggtatggacagacagacgggtgaatggatagggaggtggatgaagtcatagaagggtagacagctagatggatgattggatgggtttacagatgaatggatggatgagtaatagatttgtgggtgggtggctggagggatgggagaagaggaggccagatagaagggggtgtaactgagtgagtgaacaagtgtgtggacaggagactaataggtggttatataagaaaatgaggggagatgagaggatgggtgaatggtggctagttggatgggaaggtggctggatggatacgggtggtggtagagggataaaatgatgatggaagaatgtgtaggagggtgggcagatgggatgctgaaggctgggtggatggaggagtggatgaaggagaaaacagagtgcgatgcatgaatggaagggggggtgggctgtgtaagggccggtgggcaggaaggaaatgctggaacctcactaagtggggaaagccccggcccgcaaaccctctggggcaaaccatggtcagcacacactgtcaggaacacgaaggcatggtgaggaacctgagggtagaagctaaatcctttccctgaaaccaaagctgacatttgacgacatcttgccaacccagacattcctcctcgggagtgcggccagagccttgtccggaaaatgaaattatggggcccgagtccagtgtgggttgaggaattagaggaatttccgaagggtcaggccagtgaagggtggcaggcggggcctggctcccatcctgaccccttgccagctgtctaccagaacacagccagggctgcgctggcccccccctcgaggggagagacgggacggatgaccatcgagcctcctcccataccccctttcccctccacccttccctacaaggaggaaatgatgccagaagtgccctggcaggagttggacccaggcccagcacccaccttctgcctgggaggacatcctgggagctgccagcacagagacttcctcgtccccctagctggccaggccttgtgggggccccatgtttaccctgttgcccctactgtggtcagatggtgcccaaagccttgtgggtagcttctggccaagcccactggccgggcactgtactcaagctgggacagggccagagccgggggcctggggttcacagggcggagtccacatccatctgtgccaaggccaggaccacagtcccttgcagactgtgttggatccggggtgcctgggctggggatgactgttctcagcctccaagcagcagaaagaacccccgaggaaagacgcacaagcgtgactttgtgagaatgaaactttctgtatatccaaaaaaaaaaaaaagggccacacagtgtggtcatgttttttaaagaactgacaccatttagagcaacacatgcagtgagcgttttgatgaaatgacgggtgctggcgttactcgcagaccatgactccagcatggtgaggctggtgtggggtgtgcaggacccatcacactaggctctccacttctgtgcttttgtaattttccataatggaagaagcagccacaaagaaaatgaaaagacaatcgacatgttgggatcaagtatttgtaacatacaacaacaaagtggcatcctcagcccattaggtgctctcataggctgctccagagccccacagtcctgcccctgccagtctaccactcctcgaagcacgcgccgctggcataatcagaacctcagtaggaaatagacaaaccagataccctccccaccaggcaggcgagtgaaagcagaggccagggaccaatctccccaggggccagggcggtgcccactgtcagagagccataatcagattcagcctggaaatttgatttccccagcagaggcaatgagccaggctggatgagacgccatcgggggttgggtagagggacagagatagctccccaggctgtccacatgctcactcagtggcacccgctgatcatgtgagggaccactcccatgtccagggagaatactcagaaagggcctcttcccacgctgctcctgccctgcactaatgcagtgcccaaggccaaaggtggccaagaccaaagctacactggccagccccagggggcatgctggatgggaggtccagggggactaggggctgtgtggggctgatacggaagctggggtccggtcaaggcagggtcactgctgggggccagggagctgggaagcctaaggttagggcaagggctggctctagtggccgaacgagcccagtgactgcaggcaggacgtgacaggtgagcaggcagggcaggcgagtgtcccagcaactgtccctcctctgtgggaggcatgagccacagggagccactgctggaggtccctaaagggtctgggcttaagattctcaatccagcaggtcacagacacctgctccctgtgccaacagcagcatcctttaagtctccttggtctcctgagacctgcctctccatgaggagacatgagatggggtggaaaggagtcctccaggtcccgattcaaaacagcccccaatgcccttcctgtgcctgacccagactctagctacagctgcagcagtgggtggtcctgcagactccaagccgtggagtagtggcagtgaggggccacattctctgggctccctgctgcatcctgcccagggcaccaccaagggctcaaaggctggggagctccagggagagggctgcagaggctgccagtgcagtgtcttctcccctgcacactcagcccacccactccgcccccaatgatgagcatgaagtttgtaggagtgtggagaggtgtagtgccctactaagtgggccggacattggtggcggtggctggcccattgcctccacggcttaccgggacgggcacccaccccgcaaggtgccgtgtggcccatgccctgccttagggagggcaggcgcagtggaggcggaggcggggtgtaaaaggcccagacatggagctgagccccgtcctctgtactctggggtgggcacagggaccaaagcatccctgaggagcgaactgacagggttcacagctaggctgggatcagaggcagacagccacagggcctgggagccctgccctaccatgccctacggccccactgaggcactgtaggagacagctgtccaccaggctgaggggcctcagcgggcaggtgcagcagtcaccacgctggccaccagcctgagtgcacagggccgtccgcctgcaacgccctttcccccctcattggaagacggggttagaccccttcttcccagcccctctatcaccatggaaacacccaggcttctcctgagggacagagcctctttgtggtgacacaaagcccctttgaggggaggtggggtgcagcccctgggagcctgtggccaaagggcccctggggggtaaagcagggcccgccggcccagcccccctcccaggtttcggagccaaggaagctgaggtaggagagccttcaggttaggccagcccgccccagctgcccacccagaagggtctccggatggatgagccggacagcccaggaggccaggctgaggctgggcagagacagcaccgagaagcctctctgcaggagctggggggttcctgctttcccctctgttgttttgacaaagaacacactctgcttagataagtggaaaacagcactggcaggggagctcccgccagtcaggaaatgcccaggatggctgcaggaacagtgcctggtgggagatggggacaggaagtcctccgtgggagggcaggcaggggccgtgagacggcaggtcagacagtgggaggtctggcaccaggtgtgccgagaggactggccctggcatctgggccccactcagtttactgtcctctcacttctcaagcctcagcctccgtcttcacctatccgcccagggggaaatgtcactggccttgctgcagccacaactctgggacaggccagagttggataaaacggaacctcaccatggcttggcttattccagggctggggaaatggaaccctgaggatgatgtgggtccctggcacagtgacagcatggctgtcccatccatgctacagccccacagccagggaggcagaggaggccaggccacatttccccagactcccagccctggagcccctcctgtactggcctgagagtccctgcccccacccactgactgctgctgaccaggcacctggcagctccctgcatgtgggcgccctgcctagaggccctcccgagttgacctcactctgacccacagcagctttgctaactaagcccctggggtggggttggggtggggatcactggccccctgcggcagcacgaggaggcactggcccagggagagatccatccttttgtaggcaaatctacctgactactagggagtggggccaagggctgcccccacagggcagtgcctgggtcagcaagcacttgctgcacccccaatggaggccctcaccacacccctcccaacctgccttccccactggcaccccactctctgctgacacctgcaggcacaggggtgggggttgggaccctccagctgccgtggcagggagtggccatagggtggttgctgtggtggacgtaggccatatggttcagaatggatcagaggatggtgtgggtgggagaattaagtctgggctgaccgcaagggatcaggcctgggtggctggagggaggggccgggaccctgagtgggagggtgcaaagggagtctctgaggctggagaggctgagggaccactagatgcatgaagttctggaagaaaggggttcaggctggagacagaaccaccggcaccttcagcctgtgaagccgagagataagacaggtgcaagccccactgcctcctccaaaggaccctcccctgaccttctagaacaaggggacaaagtcactttcccagccatcatcttccctgcactggaaggggcagaacgaggacccagcactgagaggtgagcctcaggaaggaggcagtgctgccagcccttggggacaacagcctgtcccctgaaagtcccaaaacccttgggaaaggtgctcctcactgtacccttctcccacccagcacatcagaggagccagtggtgtgagatcttgacccagcatgaagtagagcccaccctgtcatatgcagggaggttccatgtcccctttggtctgcccttgccccagggtcctgtgtggcctctggccagagctggctgctcccagggtgcctggggcaccgctcatcccttccagagcctgagctggatgctggccttgccgctcccaaccccctcctctgctgggagccagctccactccggagtgcccatggcaacaggcctagacaccaacctccagcaagtgcacaaagtcctgcctttcatatgcaagcaacacagagggccaggcagggggctgcaccaccccatccagggcagattccaggccctgcagcctcccatctggctcccaccgccacataccaggagagcctcgggacttgactgtgtgtccagtccccactacaaagaggtgggagaagtgctgacagtttggggccctcctcaaaggcacctactggcacatgtgtgcagccacccacactgctacggtgtgaatgctagtgttccccaaattcacattaaaacctaatctccaatgtgacagtattaagaggtagggcctttaggaggtgattagtgcccttatatgatcagtgtccttatcaaagcggctcttgagggctggtttaccccttccaccatgagaggacacacagcgccatctatcaatagccctcaccagacacggaatctgctggcgcctcgatcttggacttcccagcctccagcactgtgaacagtatgtttctgttgtttataaaggactccatctaaggtatttggtggcagagcgtgaatgaactaagacacacacagacacacacacaagcacacccaggcacagggacccacagctgccccacaggcacacgcaccagcaggcacactcgtccacacccatatggctgctgcttatcccacctagaagtcccgacaggccctttggggggtgggggacatcttggctcctggtgaagatcagcatgctaggcagactccattcctgtcttggacaccgggcaaggcagaccccctctgagacccctgaggccgggtcaagcctgcccctgacaccaagatctgcaggaccccctgcctctgatcccacatgaggttcctctgagacaggtgggagtggctgggcctgcagaccccgagcttgcacagacccacctgcagggacaagcacaacttacagcagcctagtgcccagggaagacccttccaccatgggaggactcaggaagccgcttcccgctgagtcacatttagcgcatttcttaggaaacagctggtatgtgccctagaaggttaaagacggtgttcaactccgctggccacagaccacaatgaaaaggagctgctggctgggcacgatggctcatacctataatcccagcactttggaaggccaaggtgggaggatcacctgaggttgggagttcgagacctgcctgaccaacatggagaaaccccatctctactaaagatacaaacaaaattagctgggtgtggtggtgcatgcctgtaatcccagctactcaggactgaggctgaggcaggaggcagaggttgtggtgagccaggatcacctcactgtactccagcctgggcaacaaaagcaaaacttcatctcaaaaaaagaaaagaaagaaagaaaaggagccgctataaataatgaggatcccatggagatttaaaggaaatcccagcagaggcagtaaacagcagactgtagaaaacacgcagtgtgaggctggagaaagtacactaagacggtcctcccaaccccaacagcaaacaggagagatgacaagaggatggtaggagccacagaagacagagcccagggccaaacttccacatgataggagtttccagagcgagaacgacagacagtgctcttccaaccacagaaaaacggccagaaaccacctcaacaggagtacgtccaacggggctatcagcgtcagggctggaatctgagttagggtgtgagccttctgtccagaaaagaagcccaggaagtcacggatgtgtctacctctggcttttacaattcagtctcatttcctctggctcctaaatgcgctgtgtccacttcgaggtgtagggaggagggtgcccagctctgacctgcgggctgtgctgaagcctgggcctctctctataccaggccgtctgcaggcctgcaggggctgcatactgtccctctgtaaatgtcagcctcaacacgctgctgcctgctgcctggctcccgtctctcacagctcagaagctgttttatgataaaaaagagctgacagctttgttaaaacaaacaaacgcctctcctctctacttgagatcttttacaaagttaacatcgctctgaaaccccataaggaaaaattatggtgaggtttctggattttcagaggcagcaaactcatcttacctagagccctggactacccagagaagtagttttaagaaccaaaagaagagaagaattcaggagtaaatgaggcctggataacccaagggatcctgtgcttgcactgctgggattcaaatttgggggctgccaccaccacaagtttgtgagaagcccacagcctgcgcatgaagattgtgtcaagggaatagcagctgctgatgtgtggaattgattttttcagcaagggcctgcgattctgaatgcattaaggcagctccagttgtctgtagcagtcctctgtcagctgcccattggaagcatttttactggctcaggaaattcatgggtttgtggactgatgactccaacagattaggtacaaatccaagaaccacaaaacaaaatctaaccaagccaaacaacaatcaaacaataaaacagaacaaaaaaaaacctcaatttgttttccttttctttgtataacattaaaataaaaagatggtaacagactaccataaagaattatacaccaacaaattagataacccagatgaaatggaaaaatttcctagaaacacacaacctaccaagactgaatcatgaagaaatagaaaacattgattagatttacaactagcaacaaaactgaatcagtaatcaaaaacctccagcaaagatggtttcactggtgtattctaccaaacattcaagtaattttaacaccaatcgtcctcaaacttttcccaaaaataaagaggaaggaacacttcctaattcattttatgaggtcagccttaccctaataccaaagccaggaaaagacactacaagaaaagaaaaccacaggccaataacccttatgaatactgaaacaaaaattctcaaaacaaacaaacaaacaaaaaaacactagcaaaccaaattcagctgcattttacaagaattataaacctaaccaagtgggattttactcctggaatgcaaggatggttccatgtacaaaaatcaatcaatgtaatacgccacagtaatagaataaaggacaaaaatcacaatcatgtcaaatgatgcaggaaaaacatttaacaaaattcaatagtctgtcatgataaaaacactcaaactaggaaaagaaggaaactttctcaacatgatgaaagctatatgtgaaaagcccataacatcatactcaatggtgaaagactgaaagcttttctcctaagatcataaacaagacaaagatggctgttttgaccacttccattcaacatagtactagaagttttagacagagtaattaggcaagaaaaagaaataaaagacatccaaattagaaagaaagaaaaaccatctctgttcatagacgacataaccttatataaaaccgtaaagattctacatgcattttttaaaaactctattagatgtaaaaaatgaaatcagcaaaggtgcaggataaaaaatgaatacccagaaatcagttgcatttctatatatgaacaatgaacaacctgaaagggaaatttaaaaaaactattccatttacaataccattaaaaagaatagaatacataatactaaacttaagaaacttaagatctgtacactgaaaactataaaacattaccaagaaaaatttaaaaagacctaaatcagtggaaagatatcccatgttcatggctgggaagatttaccactgtcacaatgacgatactactgaaagggatctacagattcagtgcaattcctattaaaatcccaatgacagccaggcatagtagcatgtatctgtaatcctagctagtcagaggctgaggctaaagaactgcttgaacccaggggttcaaggccgcagtaagctaggatcacaccattgcattccagcctagatgacagaacaagacctgtcaaaaaaaaaaaagaaaagaaaaaaaaaatcccaatgacattgtttgcagaaacagagaaatctatcataagatttatatcgatctttaaggagcccaaagagccaaaacaatctggaaaaagaacaacatttaaggactcacacttcctgatttcaaaacttactacaaagctacagtaatcaaaacagtgtggtattagcataaggacagacacaaagaccaatggaatagaatacagagcccagaaacaaaccctcatgaatacggtcaaatgaccttcaataaaggtgccaagaccattcattagggaaatgatggtattttcaacaaatgatggaactggatacacacacgtaaatgaatgaactcacacccttaccttattacatacacaaaaattaactcaaaatagatgaaagatctaaacataagacctcaaactataaaactcttagaagaaaatataggggaaagtcttcatgacactggatttggcaatgatatcttagataagataccaaaaacacaggcaacagaaggaaaaataaattgtactacatccaaatttaaaatgtatgttcatcaaaggacacaatcaatatagtgaaaaagcaaccaacagaatgggagaaaagatttgtaaatcatatatctgaaaaggaattcatatccagaatatgtaaagaactcccaaaacttaacaacagcaaaaaaacacaaataacccaatttaaaaatgagtggagttgaactgacatttctccaaagaagatatataaacggccaacaagcacgttaaaaaatttgctcaacatttctatcattagggaagagcaaatcaaggctgcaatgaaatatcaccttacacctattaggatggctagtctaaaaaaaaaaaaaaagttttggcagagatacagacaaattaagacccttgtgcactgctggtgggaatgtaagatcagtatggcaattcctcaaaaaattaaaaatagaattaccatatggtccagcaatcagaaaattctgcattatgtatctaaaagaattgaggccaggcgtggtggctcacgcctgtaatcccaacactttgggaggccgaggcgggtggatcacaaggtcaggagatcgagaccatcctggctagcacggtgaaaccccgtctctactaaaaacacaaaaaaattagccgggcgtggtgacaggcgcctgtagtcccagctacttgtgaacttgggaggcggagcttgcagtgagccaagatcgtgccactgcactccagcctgggcggcagagcgagactccgtctaaaaaaaaaaaaaaaaagaattgaaagcagagtctccaagagatatgtgcacaatcatattcacagcagcattattcacaatagccaaaaaggggaagcaacccaagtgtccaccagtggaaaaatggataaacaaaatgtggtatagatatacaatggaatatcaggcatcaaattctgacatatgatattctcatgatactaagtgaaataagccagtcacaaaaagacagatactgtgagattctatttatgtaaggcatctaaagtagtcaaacaataggaaaagtagaagcacttcaagaaaggggcaaacggggagttttctaatgggtacagagtttctattttgcaagaataaaaaaaagttctgaaattggttgcacagcaatgtgaacaaacaacactactgaattgtacacttgaaaatggttaagatagtaaattttgttatgtgtattctaccataattaaaaattaaaattaaaaaagaggctccctggccaggcgtggtggctcacgcctgtaatctcagcactttgggaggccaaggcgggcggatcacgaggtcaggagatcgagaccatcctggctaacatggtgaaaccccgtctctactaaaagtacaaaaaaaattagccgggtgtggcggtgagcgcctgtagttccagctacttgggaggctgaggcaggagaatggtgtgaacccaggaggcggagcttgcagtgagccgagatcgcgccactgcactccagcctgggcggtagagcgtgactctgtctcaaaaaaaaaaaagaggctccctcacataataagtaagaaattgcataatacccttttatttatttattttttgagacggagtcttgccctgtcgccaggctagagtgcagtggcgcgatctcggctcactgcaacttccgcctcctgggttcaagtgattctcctgcctcagcctcccgagtagctgggactacaggcgcgtgccaccatgcctagctaatttttgtatttttagtagagacggggtttcaccatgttgaccaggatggtcttgatctcttgacctcgtgatctgcctgcctcagcctcccaaagtgctgggattacaagcatgagccaccgcgcctggcctacccttttgaaataaatagtatatcaaaggtaaaaatttaaggctgggtgcagtggctcacacctgtaatcccagcactttgggaggccaaggcaagtggattgctggggcccagaagttcgagaccaacctgggcaacatggcacaaccctgtctgtacaaaaaatacaaaaattagccaggcatggccgggagcggtggctcacacctgtaatcccagcactttgggaggccgaggcgggaggatcacctgaggtcaggagttcgacaccagcctggacatggtgaaatcccatctctattaaaaaaaaaaatttaaaaattagctggtgatggtggcaggcacctgtaatcccagctactcgggaggttgaggcaggagaattgcttgaacgtgggaggtgaaggttgcagtgagccaagaatgcgccactgcaccccagtctgggtgacagagcgagactccgtctcaaaacaaacaaacaaaaaggaaacagttcagatgcagctgtaaaaacaaagttaaatccttgccgtccatttacatcagaataaatactagtttgtgctatgggctgaacgtgtcccccaaagttcacgtgttggaaacttaattcccaacgcaacagtgttgaaggtaggacctctaagaggtgtttaggtcacaagggctctgctacatgaatggattaattccgttacagtgggagtggatttgttatctcgggagcaggttactgataaaaggatgggttccgcctccttcagcgctctctcacgtgtgctcctgcccttctgccacctcctgggggatgtagcgacaaagaaggccctcgccagatgtggcccctcaatcctggacttccccatctccaaaattgttagaaataagtctttgtttttcaggaattagccagtctcaggtattctgatacagcagcccaaaatggactaagacagacagattaaatgctgtgtacaaaactaaagtaaaaataccttctagaagaaaagacaggtgcatctttatctggctgcatgctagggagagttgactacacagagagacggaatatctaaaaatggggaaaaatccaacacacttcaccacaaaatatgaaacatttttgacatcaaaatgatcataaacaaaaactaaaagggtgagaaaaatgtgcagtaggcagaaagaggagtgaagaattaatatctttaatatacaaagactcatacaatggctgagaaacacatcaaaacccaagagaaggcctgtcataggggccaggcggccgcaggagacgaagccgcaaccccctgcaggcacacggcggctgatggaggaggccaggctggtgctggtctctgagaggacaccactgctggccagctatgggaaacggcagggcatctgtgtccccgccagcccttctcactcaggcctggtctcagcacgcaccaccccatcacaccctcccagctccccctcctaagggagccatgctactcatcaccatcttgtaaccccacagttggccactggttcctctgtgtgttgtggatctcctcaaccaggctgggagctcctcaggggcagggctgggcctgatgtgcctgtgatgcccaggacccagcatgaggctgggtgagtgggtgctgagtgtggtgacacatgggtgtttacatcagcccctgtcccagctgagccctgaggctccctccccagctgcctcccgctgtggacaggaccacaccccagggcccagcagagcaggcagccgcaagccagagcccaggttgcccaagccagagcagagatggcacaaatgccatcacccatcgcaccagtgcccagggcagacatgaaaaaccaatcaccacagcagacaggaataagcaatcaccacattccagatgggcaggataggagatggggaaaggcagagaaagaggcacagagagggccacagagaaacatagagaagaccaagaactggaggggggagggaaaagaagggacaagaaaggagcaagcaacaggagggagagtgagcaagtgtgcctgggcagcctcggacctgcccagccaaccaccctcctgcggaccctgttaccagggctgtcgtttggtgtctggctgacctggcctccctgaagtgtggtgacctacgaggagttaagggcagtgggacagcccctcctgccaccctgagatgccctgtcacctgtgccacaagcaagccaagtaccctgcctgagcttctttgtcccaacccagaagaccctgcatggccaaatggcctgagcagtgacattctcggccagacgctggtcctcccacacagccaggcggcagcagacccagctcccactaggctggcccggccggcagctttccatgcccaaggacttgggaacaggcaaggagtcagtcatcctgtccctcccatctgccctagatccctcagcctaggtcactcaggcatccggaggccatggccttctccctaccacttaggcacagcactggctgggccatgcctccacaatgggcactaattgtcactgagaaaccacagggctgtcagccatgcctcccacagagactgctttttggggggacaggcagatggccagggtggggactggaggaacaagaatggccaggagccattctcttaagccatcacccactctgctgaacagcacccatcgtggcaaaactctggcagcgtggatgtgagcagggtatgccttaccatccttcagagggtcctgggggacatggaccactcagcctccaaccctgccatgcttcccaggcgctatgcctcagtcccactggagctagcagccatgataagcagaggaaccccaaacacagataacacctgaggccacgggccagtacacatggcctacggctgtgatcagagtacattcagactattcagttatgggctgtctgcagccattttcatcctacaatggcagagaactgcagctgtgacagagaccataaggcctgcaaaattgaattacttactatcagaccttttcaaacaaagttttgtgtgcctggcctccaggactatcctctgtccctgtggctccagtctctggggggcaagcgaatggcctggcccagcaggctgtgccaatactggatgccactgcggctggcatcctagctcaggcaggtgaagagcagacccagtgaatgtccaaaccaacactgaccagcaacctcgtcagccagccccaaacaggcttgtccctaaagccagacatcaaaccagtggctgctgcccatattcaggccagtaacaaacccaagctggtggcaggaggccctcacatccaccctgtccagcccaggggctgtgcctacccagggtgagaaggaccaggagcacacagtgtccagggccagtccatccctgtcacccccacccgccaggcccaccagaacactctgctgtcctatgtgggagaggatgtccccaagctaaacccaggccactcacctgtcttgagggaagatcagcatgtcccgacacccaccctgcaggctctggctcctgcagggaaaccagagggcatgagtgaggtcaatccagctgggtaggtccctgccggataaaggtacacaagcccagaccgtcctctaagcaggaccttgtcatgcctgatctgaaggtcatcccgtggtgctcctgactcataaccacacactcatgtgtaccttcttgcccccacatgtccaggactgtaggtgacactgggctgccacggttccttgtcagcatgtctaatgctgttgaccatccttcagaaacgtgatccttcagagatgtggactgataatgacgtcttccccatcacacacagcacagcagtattcccaccccagggtagccaggctcagggtcctgttgccccacgcaggtgctcacagccccataagacatctgctccacctccctagagtccgctcccgccttgtgggcgaggccacgtgcctctcctgaggttccctgaggccaacatagatcctgggccctcccaggcaggcagctgcccccaacagtctccagtacagggagggcggggaagcaggcaggttcctggccctggagctgtggccaggtgtgaataaccatttgtctgggatgggggacctggcactcaagcctggggagctgaggcttatgggctggagcaggagacaagggggtgcctgtactcacacagctttcagccttcctcaggggaggaccctgcggcttcctgtctcagctaatggccccggggacacattccctctccttatatctaggcccggggatattgccagagtgttcatgtcataaaaatgaaaaacaggacactgcagacagacagggaagggctgggcctcggatgggaggctgtctctgggggacatcggtaatgagagctctctcccccgcctctacggtgttttctagattgttctgaggccccgcccaatagtcctttgtggtcatggtccattctggtgccccaacggtgtgtttccccgtctcacgacagcctcttcatcatgggaaggggtccaagtgagggtgggcgactggctacgcctcagggtgggatcatggggggtgggatgcagggcctgaggcagggaagaactggggaccaagccaggcacatgtgcatatgcatgtgcgtgcatgtgaatatgagtgtgtgtgtgcacctgagatgggcaggcccggttgggagcccatccaccagcactgcgccccgaggaagaggagatgctgctcctactccaaggtctgaggcttaggaaccagcttttgctctgagtgtgacatttctaggaaacctctggttttagcttaagtgttcacataggttttgtaccacagagaaccatgtgactttttttttttatccctgataagcaccagcctctcccccggagtcaccatgtgccacagaaccgagacacactggctgtgagccgtcatctcactgactctaccaggtgtctcaggttggctatataccccattttacacatggagaaactgggtcccagccagacaagggctgggccaggatttaactcaggtcttcctgcctccaggcctcccaaagtcccccccccccacccagttggggaagtgtgaccaaaggagaacatgggtccttcctcatgggcctcctacctcatggggtccagccaggccaagaacctgcaaccatatggtagagccaatagcagaccctgggaaggggtccaagtgaggcattggagagggcttcccccaggagatgggtgggagcagaggatagcagcaccacaggaggctgagtggtaggagcagccagagctgtgggtatccttcctaagggtgcactaggcacatcagcatcgtacaggcaggggcagagcagagcatctgtggacaacctaagggagctctgggcagtggacggacagagggacgacagacaggacagtgatgtgaaggcagaactagtgataggatcatatgggaaggtggggaggtgctcaccttggggagcccccctgagtgctctgcaagctctggggtcacctgcctggccaaggacccagtaccagccgcctcaaagcgggggaatgaccacgccctttattgggcccttttcccagtgaggatggcctgggcctacccatgccatgggacccccacactgggtctccccaccaaactgtccagacccgatggctggccatggggctctgtcagcccctggctacaccccactgatgccctagtaagccctgtggttctggcacggtatccatggtccaaccagagggctgagaggtctcacactggggcataagcctggcccaggccacacagccagattggcaagctacagtcctttggatagctgacggcacagggcagctcccatgggtacacactgggcccagaactgggatggaggatgcagcctgggctgggtaggcaatgaggggcccaggtgagctcgctctgcactccctgcagtgtggcctcagcaggccaccccctccccaagtctcctcgcttcctgctctatgagcgcgaggtgacactgactgtaggtagctgagaacatgccctggcaacagccaatgcaggcaggtgaatggagtgccccgtggccagtggacagggaaggtccatgctgctcaatgacaatgctgtccactacagcaaaaccgagtgttctcctaggcctgctgccaccctgggcacatagtgagaacacgcccacttctgctgtggacattgaggcacagaccacacctgggaaggcttgggaggcccctgggcacacacttgaaggacactgcacttttggggctacgcaggcacagggctagtccttcactgtccctgctgagcctgtgtgtggtcacccaccagctggccttcaggcttccttctgcctgcaccaagcatgttgggggtaccgaggggccttgcttggctcctttccaactccacgccctcaataggcggcttggaggccgagctccggtcatccaagccaggtgtctggggaagggtcctggtctgccgcaggaagctgggtggagccggtcttgcctgctgtggcggtcccagctgccctctggtggccatgctcagctccccgttgctctgccagaggcggcagcccctcaatcagcaggggcagtgggaagggcctgtgcataactggttatggagtggggggaactctgtggccccaggcacccaccagctctgggtcatcttcccgacctgaaacaggccaagatatgaaggccctgagccaggaaaacctactaagggatccctgatcccaagtcccctcagagtgacccaagacttcatcttgggtttttctgtttgtttttttgtgggtatttttttttctttttttgagacggagtctcaccctgtcacccaggctggagtgcgatggcacaatcttggctcactgcaacctctgcctcccaggttcaggcaaccctcctgcctcagtctccccagcagctgggattacaggcatatgccaccaggtccagctaatttgttttgtatttttagtagaaacagggtttcaccatgttggccaggctggtctcaaactcctgacctcaggtgatctgtctgcctgcctcggcctcccaaagtgctgggattacaggtacgagccaccgtgaccagcccatcctggttgttttgtttgtttttgttttttggagatagagtctcgctctatcacccaggctggagtgcagtggtgtgatcttggctcactgcaaccctcacctccccggttcaagcgattctcctgcctcagcctcttgagtagctgggactacaggcgcatgccaccatgcccgactaatttttgtatttttagtagagacagggtttcaccatgttggccaggctagtgtcaaactcctgacctcaggtgatccacctgccttggcctcccaaagtgttgggattacaggcatgagccactgcgcccggcctcattctggtcttaattgaagctgctgacaaaagaacagacacctccccatgactaagccaccatcagggaagtccccaggacccccaaggcccagctggtgctctgcagtgctgtccctggacccccaccctccattcctggccctgtctacagaatgggccctgactccctatcccagctctaccctgtcactccctctgccagggccaggcggggagcacgacagatgggctggacagagggtggtgcctggcatccgtgtgcagagctccctgctccacccagagaccggggatcctgctgctcctgcaccttctgtccttactcaggacagcctcatgctcccccaggccagactcctggggtgaaggagcacagggaactcaccctgaatccctgtgtagcacaaacagaaggaggggtgctaccctaccctcacagagccacagagatgcagagggccccgggactggggggagactacagggccacctctggagggagtgccagagcaaacatgggagccaagcagcccagatgtggtgggtggggagactcaaatttagcaggattgagggtcagaacttgttctcccaggaggaaccttggtcagaaggtccttgtgtttatgctgaaaagcctgacagggcagctcagccaagagctgggcaggggctggcttggctgtgctcaactaccctctcagctgggacttgagtcccttagcgaatgttctgtgcccagtcctctgctgggcgctggtggaccccagaatgggggtagggtggggacaggggacagctgggagcagacattgcggataggatggggcaagactgggggaaatgccttcccagacacgctgcggctcacactgtcgcctgatctaaggcctggatcacctgcttaggagctgaccggccactggcatggcacaccgggcaagagagcgctgactgcccccctgcattcagcaccatcccagctccaatagagtgagtacaagataggtaacacctgccttgtttggaccagacctctaaacaccgcccagatcccagagtaaaggcagataaggcagtagttaagaagtaggaagaagtaaaggcagctaccccagagaagctaaggtcgggagaggtggaggctcccactgcacccccctggcccataccataggggaggtttcccccacagcagcctgggtactcacctgaggttattagacagcagcattaagagcctactctaaaaaatacccacggggcacctttcttttccttatttctaaatatgcctggatgtagggaaagggagctgaagtcctttagttccattttaagtatgttacattacacatagctaagaaacggtgaaatattgtaagcagccaatatttaattatttaaaaattaaaataggctggagctctcaggccacctgcccagggcgactccccagcaaaccgagcagtctccctcagagtggagatgacatgtctccgcaccggcaccgagggggcgcagggcggcgtggggagggggacccaggccgggggtccgggtggcgcgccctctctcacccccgaggcggcaggagcagcgcggcgcgaggacacctccgggccgtcggtgcccctgagcttcccggcggcgcgctgccccaggaaagttcccggcctgccgcccctcgggctgttggaaagtttcggcggctgcagggccctggcagctaggcgccaagcgtcgcgcggggcgggcacggctgcggggtcgggccgcgctcggctggagtgctcagtgcaagacgcccggacgggtagggtagggccccaaggccacgcacaaagagacccgcccccgccggcccggggtctcggacgccgcagagcgcgcggacaagacgcgggtggggcggagattggctccgacgtccggcccagaccctcgcccggatctcgactccagggataggaccctgtccggaccgctgcccggaatgcgtcccatatctgcagccccgcccccagtcccggctccgacccgaggccccagccccgggtcccacaccccgcccactggctcaggcttacctggagcgcagcgtgggcggccccgcagcgcggcctcggaccccagaagggcttccccgggtccgttggcgcgcggggagcggcgttcccagggcgcggcgcggtgcggcgcggcgcgggtcgcagtccacgcggccgcaactcggaccggtgcgggggccgccccctccctccaggcccagcgcgcaacccgagacc

SEQ ID NO: 1025 - DNA, 44817 bp, Homo sapiens
cggaagtcggcggcggtggcggaggcggtgagtgcgcggctccggggctggccgactccgctagtggcccggccggcctgggctcgggggctccgggctctgggctctgggtgcgcggaccgggccaggctgcttgaaggtgggtgggctggccgcacttcctcaccctgcctcagtttcccctttctgaggtatggtatagaatcaggcggctgggtcaggggcaaccacgtcgatcccggccgacgaaaatgccccgcgcgttactggaaggtgtttttgataatccccgctggcacgggatgcgagggactctggcaggtgggaccagactcgctgcggggaggctgagatcggcagggttgggagctgcgtggtccctgcagggtgtgtgggctgctcggccttggccagcatcagggacagctctggcgcccggtcactctgccccctacccgcggcctgctgcgggccagcagggtgacagctaatgtgggtgtgagtagatagtaagtgctgggtcatccctgcgcctggatgcggccttcctggggaggtttgggtagttagatcccccacccccaactccagagcgtcagaggtaggggctggcagggctgcactcagggcagtccttgccccaccgctgggctttgtagcagcctgggctttgcccgttttcctctaggaagtgggcacagagggctgtttgctgagacccccaccttccctgcccctagcacctctcctgtgctcccttggcttcctgctggaccacaagctttagagtgaaccgtctgcccttggacaagtccctgggcctcaggcccccttcctcttcaggaatgtcacatgccctgccctggccaggcctgtttgcactgtcgtgtggctctagacctgctgaccactgttttgctgccactctgggcacagtgccctcttccatgaggcagatgtgacggcagctataagggggtagctgagtagctctttggaaggctttctcacgctagctcatttgcctctgggcagccttttggggcaagcattcattgatccagtcctgctcatacaaggaaaactcaggctaaggtggcagatcgtgttcccaaggtcattcagagccagggcctgctcccagtgcctctactactcctgggccactctcttaggagtgtccctgtgtctgtgtcctgcgtctgtgttgggtgggctgggagcagctggagagggtgaccatgttgttagatggacacagcagagcctctgttcccacaggatcctagtgctctggtggtccagggtagggtgccctggtgcccccaccccctttgacccctacacagctttgtgttacttgcatgtcctcagactgcaggcccctcagaccaagcccctgcctgctgtgatgtgtggtggccatagcccttccctgagctaaggtgaccagctgtcagctcttcctgggctgcccagcctcttgtgcttccttggtcttcacttgtgggctgtcattctgattacgttttgcagtgtgtggaatcacgtgcagtgtcctgggaacttgatcctgtgcccggcttctgcgccagacggcgaacttggagggcaccccggtgcccacccaagggtgctgcttctgaaaacacccacagggatatgaggggcttctcagggaccccagaaggggtctggagagaaatggcccgggatagggaggctgggaagacttctcgaagtagggccatgcttgtcattgacactccagatgcatgagaagcagggcccatcctttggtgacgtgtcagtcagcacatggcagcagcatggcagagcctggcctttgttggcccctaccatagggcttgggctgtcttgaaaacaagcctatccctaccatgaggatgggctccgtgaaaacaaggtcaccccagaaagactgagctgctttttgaggttatcacagctttttcccctttttctctcaacttcccttttagactgcaaaaatagtttatgcatgcttaaagataaaaaaggctggcctccttctcccagcggctgctcccctggtgcacttgctgacatttgggggtacatccattgagatcttcagtgccatgctaacttgaaacttgaagtgcttgccttcatcctctttgcgggcatggtaggagtgcccccctttttttttgtttttactaaccactcaggccgcaggggccgctgcgaggctggcctgtccctggcttgtgaggaagctgagtgttcctcccaggagggcctgaggatggggccaccctgtgtccagagcttgctgtctgctcacgatgcctcttgtttgtgctattccttggaactgggaagagacagtgatcctctggtgtgaggctgaagaaatgccccggaagcattgtgaagatctgaggagagagtaccactgtagaaaatgtgtcatgataggccaagcacggtggctcacgcctgtaatcccagcagtttgggaggccgaggcgggtggatcacgaggccaggagatcgagaccatcctggctaacacggtgaaaccccgtctctactaaaaatacaaaaaaattagccggacgtggtggtggcaggcacctgtagtcccagctactcgggaggctgaggcaggagaatggcgtgaacccaggaggcagagcttgcagtgagccgggatcgtgccactgcactccagcctgggcaacagagcgaaactccatctcaaaaaaaaaaaaagaaaatgtgtcataataaaatgccatttaggcccggcacggtggctcacacctataatcccagcactttgggaggccgagacaggtggatcacctgaggtcaggagttcgagatcagcctggccaacatagtgaaaccccgtccctactaaaaacaaaatacaaaaatttgctgggcatggtggcaggtgcctgtaatcccaactactcgaaaggctgaggcaggagaattgcttgaacccaggaggcgaacgttgcagtgagagaggtcaccctctccagctgcccccagcccacccaacaggaccattgcactccagcctgggcgacaagagcaaaactccatctaaaaataaaaataaaaaatgccatttaatagccagagagtgtaaactggtgagctcttgctgcggagataggagggagcagggcattgcagtggactggagactcagagggtttcctgacgtcaggactttcttcgcccaggccccgtgaacagcgacactgtgttcccacgtgtgtttacctcctctgctgacagccaccgggagcccgcgtcacatgtctgtgtctgcctttgaaaagagcaactcgtgctttcaagctctgcccctgggggctgccaccgctgatggagtggggattacaagggatggggattgggcgcccggctgctcagccctgcagcaccagcccttgtggccattgaggccattaaatgggggcagcagactgtagggcttagtcaccctctgttcagggactcaccatgtgcagccccaataggagcccgacttgatggctaccctcccaagtgtctaggtccccttgaccctgtggtactaatagcttgccattcctctgtcaccactgctttctgcttagcacacatcccctctgcccatgtgctatgcttgccttttcgcttgccaaagggaagtggttccgccaaaagcgtgtgtcccatcccctctggcccccagggtctccaggtgtggtgttgctgcgacagcccagctacaccccgtcctatgcagagctgtcttgcaccagggctgattgggtcttctcttgctttctgtgaacaagtgactcttgggttcttgcccttccttccctctcttccctgcccatagaaatgtcccagccctggcagggaaggagggcaggatctgtacattttctttttttttgcgttttgagacagagtcttgctttgtcacctcaaaaggctgaggcaggagaatcgcttgaataccggaggcagaggttgcagtgacctgagatcgtgccactgcaacctctgcctctcaggttcaatgcgattctcctgcctcagcctcctgagtagctgggattacaggcgtgcatcaccacgccctgctaatttttgtgtttttagtagagacggggtttcaccattttagccaggctggtcttgaactcctgacctcaggtgatccacccacctcggcctcccaaagtgttgggattacaggtgtgagccactgtgcctggccagtgcactttcttttgagggtagacattactgttccccgccgggaagcatgcttactgggtgtgcacgctttcagtgtctggcgtgacagattgtacaaagtgaacccagccacacagctaccgtccatatcacaccaccaccagcacccagatatctccctcgtgtcccccagtggctgcctagaccaggtggccctgccctgcctcctgtccccatgggcagatgttgcttatctctggcctctgcatgaaagaccaagcagagtgctatcttctggctgagacctccctgctgcctcatcaccatggaaaggcacaggctggcttcttttccaggttatggactttcttactgtgtcactttgtggacttgggcacctgcagagtgcctggcatggtgagcaggagttggggcatggcgtgatctaggcagggtttggaaggttctttgaatagccaagggggacagtctggagggtgccctccagacacctgagaatgcattgaagctagggtgactactgcagcatcagaggcctggtgacacatttaaggcctcaaggggcccatgtgactagaagtccaggatgtggctgaggtgggccagactggatggccagcggccacctaaggacaattggctgtgcgtttgggaagcatgggtggtccccacctcacagcagtcgcacaggcagacagtgggcagatccaagagcttcaccaaggctgggcggggtggctcacgcctataatcccagcattttgggaggctgaggcggggggatcatgaggtcaggagttcaagaccagcctgaccaacatggtgaaaacctgtctttactaaaaatacaaaaattagccaggcatggtggcacgcacctgtaatgacagttacttgggaggctgaggcaggagaattgcttgaacccagcaggtggaggttgtagtgagctgagatcgcgccgttgaactccagcctgggcgacatagcgagacttcgtctcaaaaaaaaaaaaaaagagcttcaccactgtgcaaccatacaaggtagataagaaaaaggagttctcattttgggacagggagggcctttagcaggacgggacatgactgctgtacagtaatgatgggaaaatcccatgtaatataaggctatttctactagacagcatcacaggcagagctgaaaggcaggggatggctagggagaaaacagttgcaggcctgggacaggcacatggttgcccacatcacaccagctgcactacgggtcagtgagacaaaggcctagcagtcagtacccatgttggtgaattgttggcaagaacatacaggaggtcacaagttgcccagccagtgggggatgcccataaaaccctggcgggaacatttcccacactgcatacaccctggaggcaggtgagtggcaacaggttctggtgctagacgttagcggggacttggccaagtctgtttatctgaaagcgtcacccatggatggagcaattccacctcttgcgtctatcctaggaatgtcctcagctgctctcccactgttgtaaagaaatacctgggactgggtcatttattaaaaaaagaggtttaattggctctcggttctgcaaggtgcacaggaagcatgatcctggcatttgctcagcttctggggaggcctcaggaaacttacaatcatggcagaaggaaaagcaggagccagcacttcacacggctggagcaggaggaagagagagatgggggaggtgccacacacttaaaaccagatctcgtgagaactctatcactgtacagcaccgggggggatggtgttaaactttcatgagaattctgcccccatgatccaatcgcctcccaccaggtcctgcctccaacactgggaattaaattcaacgtgagatttggtggggacacagatccaagccaaatcagcccatgtgcagagcatgtgctagggatggtcgcttgatgggacgaagacaccagccacagctgagaggcagagcagcgggaaagctgggcagtggtgaaccagtggggacatggctctggtggagacagacctcatggccaatcagggagaacggagcaatgggaccctagcgtgttaaccccacagcatacatgtgtctgctcacatgtgtgtgcaagcaggttaagaacactctggcgccacaggcagcccttggctgaggctttttttccttttttttttgagactcagagtcttgccttgtcacccaggctggagtgcagtggtgctatcatagctcactgcagcctcaaactcctgggctcgagcaatccttctgcctcagcctcctgagtagctgggactacagatgcatgtcaccatgctcggctaattttattttattattatttattttattttactttacttttttgaaacggagtctcgcgctgtcacccaggctggagtgaagtggcacaatctcggttcacggcgccctccggctcctgggttcaagtgatcctcctgcctcagcctcctgagtagctgggattacaggcctgcactaccatgcctggctaatttttgtatttttagtagagaccgggtttcaccgtgttggccaggctggtcttgaattcctgacctcaaatgatctgcccgcctcagcctcccaaagtgcagggattacagccatgagccactgcaccctaccttattttattatattattagtattatattgagacagagtctccctctgttgctgtgttgcggaagtgcagtgacatgatcataattcactgcagccttgatcttctaggctcaagccatcctcctacctcagcctcccaagtagttgggaccacaggcatatgccactgcacctggctaattgtttttatttgctttttgtagacagggacttgctgtgtttcacaggctggacttaaactcctggcctcaaacaatcctcctgctttagcctcccaaagtgctgggatgacagacatgagccctgaagggatggggctttggcccgttaaatgtcactggaaatgtttccctccagaatgtgctcctgggtgacctgagcgatggtattaacaactatgggtcccaccagcctccagagctgccagtcgtggctacaggagactcagccttaggctggggcacagagaggctgaatagagggtgaatgaacaggcagcgtatgggagggaccagcgtttcttggtattatacaaaagctagtggaggtggtgctggttggtgtggggtgggcgactggcacggtcagatgcctgatgcctgttggcctcctcagaaggggaggctggcagtagtgggttctgggacatgcaggagggtggcctggatttgccctgcagcactgaggtctgcctgttccccactgggtcctccatttgaggccctgtcagcatggccctcgtcccccttgcttcttttccccatgggcctctgcaaggttactgcccaccctccaccccacctacctgcctgtggtgggcactgagagccagggaagcagatcctcactgccaggcagcaggccatgtgcgcatccatcagggtgccagaccttgtccccacgcagccctggctggggtcactgctgctgctgctctctgcctgtggctctggcccatctttgcccaggcgttctgtctgaatggttttcttgtcgtgccttttttagacaccgcatggagtgaggtttggggcttgcctcaactggagtctcattcttcttagagagggagtttagcccgtttccatttggccttaggacagaaggccctgttggtttctctgagaagccaggggaggagccctaggctggagaggggattctagagcggggtggctctcagaagcagaaggtgggcagagaggacggtgcacgctgggagagttctcgaaagcatcagcagatgggcccagagtgcctggaaagcttccgtccttcacagacagcgccatgctctaagaataacccatgccaagtccaggctttcttcctgttttgcagaattaccaggttgttaggctaggggaacgtatgctgggattctgggaagaattccacccgcactggtattcttagaggacgggaagcccttggctgcggtgtgaagagggctctctctttccattcatatctcatagatcctctggccaggcttgggggtgttgagggactccaggagtgtggggggaacttcctccctggaagaggcctgtgctctgtccctgctgaggctggtggcatttgcagtcacatggtgagctcacagtgactgtccccctcttacctccctggcagggttggcaaagaccacaccaaagtcccaagtgattagttccccggcctccctgcacagaggctgtgcatgtcccctgggcattcactctagctgtctgggctgcagggaggcagggtgcctggcccaactggagatggcactctactgggggtggttaagtgttgaccatcacaaaggcgacctcttttgtcacatctgtgtgagaggagctggactttctcagatatggatgagcctcacgacgcacatcctttcgtcccttgcttgtctaccaagtccctatgtgctccaggaggcagtggtacaggccagccgctccgtatgaccagagaaccagtgcctcacactccagcgcatttccttcccagggtgcaccaggactcttgtaaagagggcattctcgtgtaagcagttgctttttttttttttttttttaatttttatttttttgagatggagtttccctcttgtctcttaggctggagtgcaatggcacgatctcggttcactgcaacctccacctcgtgggttcaagtgattctcctgcctcagcctcctcagtagctaggattataggcacgcaccaccacacctggctaatttgtttgtttgtttgtttgtttgttttttgagatggagtcttgctctgttgcccaggctggaggacagtggtacgatcttggctcactacaacctctgcctcctgggttcaagcaagtcttctgtctcagcctcccaagtagctgggactacaggcgcccgccaccacgcccggctaatttttgtatttttagtagagacagggtttcaccatattggccaggctggtctcgaactcttgacctcgtgatccacccaccttggcctcccaaagtgctggaattacaggcgtgataatttttgtatttttagtaaagatggggtttcaccatgttggccaggctggcctcaaactcctgacctcaggtgatccacccgccttggcttcccaaagtgttgggattacaggcgtgagccacctcgcccaaccagcagttgctgtaaaattttttaaaaggatgtcacttatactacccagtcattaagacttcctgaggtggaaagatcacttcagcccatgagtttgagaatagcctgggcaacataatgagaccccacctctccaaaaaaatttaaaaattagggccaggcgtggtggctcatgtctgtaataccagcactttgggaggccaaggtgggtgggtcacaaggtcaggagatcgagaccatcctggccaacatggtgaaaccccatctctactaaaaatacaaaaattagctgggtgtgatggcacgcacctctagtcccagctatttgagaggctgaggcaggagaatcgcttgaaccagggaggaggaggctgcagtgagctgagatcgcgccgctgcactccagcctaggtgacagatcgagactctgtctcaaaaaaaaaaaattagccgggtgtggtggtatgcagctgtaatcttagctacttgggaggctgaggtgggaggatggcttgagcccaggagttcgaggctgcagtgagctatgatcacacgactgcacctgggcgacagagtggaggtgatgtgcttcctcaaatagccatgagaacaacgcttcttttcttgtcctggctcaggaacctcaccaccatgccacgttgccctgctgcgctgtgctggtgtcgtaggtcggtggcaggacatttgcccacctcacaggctctgctttcagtcttgaagtatggctcctctcgactgctgcccacacggcctcctgttgtcagcctgggctacatatctgggctcttccatccctgtgggcctggtgaggcctggccatgtgcctgtgtcatgccagttgctttcaagatgatgtttctagtaggaccacatgtgaacacagtgaccaccatggccaggaggaagctggctgcccatcaccagcttgcccagggacctcttgcaccctggcggggatcagcagatcctgctatgagagagcagaaggcagcatgctgacttccaggagtgtccacagcgtggctgggcagagcagagctacaaatgaacagatccagtgccgaggccatcctgactctctcaggggctgccaggccgtgggtgcagggtccagcaggcccacttgatcccagcatcccacgtgtgcctgctcggggtggccagctcactgcttcttcacctctagcccaaccagcaggtgccccaccatgagcccctccaggctcaccttgcccatccctgccatgtgacctgggactcttgagatgagatcacagctgcagagcacacagcacagggaggagctcatcagcatcttcccacctgtggtgccctggcccagcctccttccggttggggttggacccgccctggcagccaggttttgcgtcacctgccccacccgccctgtaacctacttgcccaactgctatcccggtggccgtgaggccagttgacagaatggagaggggtaagcattttccgcctggagaggatgggcgtgtggccatctgactgcttctgcaagcctggtggttgtgtgcaggctgccctggtggtcttagccccttggggcaggcggggtcctgtgcaggatgcagagactgggcgtggcttcctgcagatgttcagatgcttctgggctgtggcctctgagacccagggcaaggctgctgactggaccccagaccctcctgcctgcctcttcctccagctgctctttgtggtctggttctggccgcctgggcctcagggccaaccctgcatggctttgaccactctggccttcttggactgccaaggacatgctgagagttggttgggcttggcccaagtgctgagcccagggcaggggtggggacaggcagggcggagcctcacctggaaagccaggcacgattctccctgggacaccaaccctcctgtagagttggccaattcgggcaaccttgagggcgagctctgtgtggcacaagagatgccctgaggagcccagcctcacctggtgtgatgggacctgtggaagttgtgggaagtggtcctggccacccgtgtgcccacatgccctgcgcccagatcaagatatggtgaccaaaaggacaaggactatatccatggctccctcccagagcctggcaagtcagcaggcatgagagggtgttggaatgctgtggtgggcctgtgtggggaccttgtaggacctagggaacctgcagggcttggcttagggagcacacaggggcccaggcaaaggcaaggtcacaggtcgggggaggtgaagctggcagggggagggggagacctgctggctagagctgggttgggggccggtgggcagtgggcctggctcgagcagggggcgagggattggagagaaaggcagttcctgatggtcccctccccaggggctggctttcctctggtccttccctcccaatgaccgcgtcttcgtcgaggccacagcccttggctctgcgcccacacctccagtgccaggctgtccggagatctgtttatggccttcccttggaccatggagccctccctgccactggtgcctggagggctggtctgctgcccctgcaccctggccagctaggatggtggggtcctgcagctgaactgggggtgcctttctgcctgtctgtcctacgtgtatcagtggccagaactgccctcatccatggccttgccagcagctgggcgtgcagcccagggagggctgaggtcggctgaagttgattgagaccaacggccttctctaacaccccagaggagcatgtccctggtgagcaggccttgggcagccctgggctccaggccagtgggattccagtagagaccagctggcagggcttctccagtgactgcagccaggggttctcatgtgcaggaaagaccagctcctccagagtaaagggacttgtgtcttctggccacatggtgagtgctgggcccaccccatcagtggcaccttgggtgcactcccaaagcccagcgtgttccccatcttcctgcactgcattcgggatggttctgcatcatcagctgcacctgattgctcttaaacccacagctgagctttaatgtgcagtcactgaagctttcatttctaaaatagcttcctaagagttcttttggccaggcatggtggctcatgcctgtaatcctaacactttgggaggccgaggtgggtggatcacctgaggtcaggagttggagaccagcctgaccaacatggagaaaccccgtctccactaaaaatacaaaattagctgggcgtggtggcgcatgcctgtaatcccagctactcgggaggctgaggcaggagaattgcttgaactcggggggcggaggttgcggtgagccgagattatgccagccagcctgggcaacaggagcaaaaacaaaacaacaacaacaaaaaaaaaccgagttccttttgctgctttgtaaacccagtttgctcttcatcacttcctttgccctgcagatgtttctgagctgtctgttttctttctgccatcagagcatggttggttgatgatgcatgtacggttatctttctgctggttcttgctcatggtgcttctttcattatgtggttctttctgactatgtactgcttctggtctttgaaaaatgattttgagacttctttgaagtataggatgaaggtatctttctccagagagaacttcaggcacaggggcactacgagtgctggaaccccttaaaactgtgcttggcttgtgggtccttgtacccccagtgtggacctggacggctggctgtgccacagcttctcagaaacttcccttcacttatgtgcaatgtccccataacccctgggggtggctgcggctgtagttcatctctccctaagcatcgctctttggagtcccagcctaacttagaggagagtcttctgttaggttcttcatcctgtgggggtgactggaccttgtcttctgtctccttcgcccccgaggccaccagagtatgagccccagtgtgttcagtgggcaaacgctctcaggcaggattggccactgtgttctgctgtcctctgtgggccacgctctccgaactgttggccaaatgctgcatgagctcatcagctcctggcaatttttaagatgttttcatatttcatccagcatcttgagttgtttttaccaaaaggattgcccctagtagcctgcccaccctcggatgatggccccctgtgggcgcttccagggcacccggcaaggggacccaacccacttccagccccacagtctgcttcccacagggcccccttgcaacaacacaccctttagcttcccatcctatgcagagtggtggccagcagaccatctcaaatggctgcccatccccctgacccagtgcgtctgcacgtggcgcttattgctatcccaatacttcaactgcacagccaccagctcctcactggagcagatggtccccaatggccatccctaatgcccgtgcctatggaggcacatacactgagccctcttcacctccgtccccactcattagacttttctcagaggaatctttttgggtctcttcagtatttgaacagcttcttggctgtcccatgtcccagctgtgagcactggctctgccctggagccgtgtcactaaatcattgcacatgtgcacatttcagggaacttgggtgtcacccttgggtggcctcggaatctaatctccgttctgcactcgtttgcattgtggaaaactgcctgctctgggccccagaggtccctgggtggggacgaggtgtatgctaagtgtgcagtcacccagcgtgtccccggcacgtgtccatgccagctgctgtgggtgtgtggggccttcgggtcctgtgggatggcgagtgtgtgtgctgagcaggacctgtagggcctgcatcccaggtgagtgggccatgctgttggaggcggaggcagggctgcccccactggtggcgtgtggggtgggtttggtgctgttgcaggggaggagatgtgcatgtgggggacagtcttgaaggaagaatgtatacagtggtctatttccaagacaaagtgtcttaaattggcttagctcagcaaactacagaagaaacaggatatactaggccaccctgcttggatagctgatgtgtgcttgtcggcctccactttccccgcacttagttgccttcacccgaaccaaagaagttcagtctaagctgaaagtttactagcctgcaaaatagctcattttgtctgttcttatcagcctgcctgctacttaggtcgtaagttaaatacttaaaaagtccctgagctaactaggactgcaatgcattgtgggctgcaacaaaatacagcaagacaagcccccaaaaaaacacctgaagcccctacccaacaattaataggcgacgtccgggaaaattgtgaccccacagtactcggcctatgaggaactgggggagggacctgcgtactaggggataaattgcttgtcgaaactgtgctgggtgtgcctgtctgacacctgatcttgcaagactgtcattaaaagtctcactttcgctgttctctgggtctgagttcattctttagatttggatgggtaagtttgtttctcacagtgtggctcctgccctcacttctgctgccccccggggaccccctcggcaccccagctcggtgtgtccaggccttaagactaccatggtgctgatgggatgcttctgttcagggctggtgttgcaggtggtggagagacagtctggccagtgccaatgagtgcatgggtttgggagttgtttgtgtggcaccggccaagagtgtggtgtccagttcccccacacccagcaagtagtacagacaccacagaggtggttctctctgttctggcctgttgcaggttcggagggcagccctgagtgtctgccatccgctcaactcagtgttttccttttcccgcagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggtaggacagaggagtgacatgggtccaggtgggctgcagttctatgggctttgaggagggtcgggcggcagaactgggacaacggcgtcagtgagtgagagccagcttgggctggcgggtcacagctgctggtgagaagtcaaagtggcggccaggctaggggtctgtgggtgggtcctgagctgaggaaaaagaacctggggaagaggggacgctgaggaccagccagaggagtcaggaaatcgaggccagaagccacccctgaccctggactcaggacggccacacctccattccccaggacaccccagcatttatccacacagagaacgaggcagagatataacccacatctaaaatgaaacgtgtaaccactctctaatgcaactgctcgggaagttttcatcattttaaaatctgtaccagaaatgatttgaaccatttcaagagggtctcagatttgagtcactgcaaagttgcatagacaccatgctgcttgacttcaaggctgagtgaagtcatttcaggccaaggaatcaggaaggaagggtgtctggtgttttccctttttgcagttgggtgagtggcaggtcccagcagcagacagcatgctgcagggaaggtggaagaaatgttaggaaagaactattgactgctacagggactggagtagtgttgggctggctagtgagtgaacagaactctaaagaatgtaggggctggccgagcacggtggctcacgcctgtaatcccagcactttgggaggccaaggtgggcggatcacaaggtcaggagatccagaccatcctggataacacatctctactaaaaacacacaaaaaaattagctgggcatgggggtgggcgcctgtagtcccagccacttgggaggctgagacaagagaatggcgtgaacctgggaggcagagcttgcagtgagccgagattgcgccactgcactccagcatgggcaacagagcgagactgcatctcaaaaaaaagatgaaggtaaaataaggtcatgtgggtaggccctaatcaatgtgatgggtgactcagatacgcacaggggaagctggtgtgtatacagagatagaagcagtcgtctgcataccgagaagaccctcaaaaggagccagccctgctgacgccttgatcttggatctccagcatccaatgctgcgagacaatagtgtctgttgttgcagccgcctggtctgtggtgcttagttacggcagccccaggaaactagcacgctgaggagagccagccagctctgtatgcgtttcagggctgcctcctgcaggctgctgaagagactcaacccaccccgagtgctcccatctctggaaaggaagcttgatggctggcctgcgggtgctggtcagtgccacccagccccttgggtggagaggaggagggttgacatgggcccctcttgctttcactcagaacccgtgtgttgctgccaggacctgtcctgcgggtcctgccattccagttggcctcgggatttctctggactattttccgaagccctaagccaaagacgaaatgtgccacctctgggtgactgagcaaatgtgcgctgtgttttcctgacttcatgggagggtgtgagacacttctggtggctgcttctgctctgcctgtggggtgtccagccaggggaagggcacgctgcaggctgggagcacagacacttctatggagcccctgacagcacctctgcagcactttgggaggcctcgtacaggtacccagctaggctgggctggactcctcacctgtggactggagtaaaaagtagggtgctttaggccactatgttttttttttttattattattattattattttagagacaggatcttgctctgttgcccaggctggagtacagtggtatgatcatagcttactgcagcctcaaactcgccggctcaagcgatcctcccacttcagcatgcctaagtaactgggactacaacaccatgcccggctaatttttttttttttggtagagacaagttctcactatgttgtccagggtggtctcgaactcctgggcccaagtgatcctcctgcctcagcctcccaaaatgctgggattacatgcgtgagccaccatgcccggcctcggccactgtatttggtaatttgatacccatcacggaaaaccaagaccctgcagcaagataacacaatcacttcatgatgtcaccctatctctttcaaaactgcctgtttacagccgggtgcggtggctcacgcctgtaatcccagcactttgggaggctgaggtgggtggatcacttgaggtcaggagttcgagaccagcctggccaacatggtgaaaccccatctctactaaaaatacaaaaattagcctggcatggtggcgcacacctgtaatcccagctattagggaggctaaggcaggagaattgcttgagcctgggaggcagaggttacagggaactgagatagcgccactgcactccagcctggatgacagagtgagactccatcttaaaaaaaagaaaaaacgaaaaaaaacctgcctgtttacagccccacgtgatgccacttgctggcttcagcctagagtggctgcaggacaagctgttactccatgggacagcttccatggggtcaccactgagggtttgatcactggatctcaggccagagtacctcctatctgtcaccaaactgtcccccagacagtgcacacactcaccccccggcagaacacactcaccccccgagatgatgcacataccccccggacagtacacgcactcaccctgcctagcagcgtgggtgtcaggtggtgatggataattagtggtttcagttattggaacaaaataaagccgaggtgacttgccatcctcagggacctcaccgtggtgggtgcatccctgtctctctggacgtggggcgcagataggcttctacccatgtgcagccccaccagtgatgactgagagagctacttcctcctccctttggggcttgatctgggtgctcagcatgctggcttgtccctgaattatgtattcaatgaaatccctggcaaaccaccagcaattcagctaaacatgactgctggaacaaaaataacctggcaattaatgttcctgagttattaggcaaacatatataattgctccttgtttaaaaacagacagctgaacatcttaggacaaaagtccatgctcagtcagcttttcttcctacttttctcccctttattttccctttgtaagagcattatgtcagaatcagcacccgaagccaacagccccagcctggtttggggctggactgggatgaggtgtccctggctcccccgacccctgttcacctgcagggctgtgggacgtggaagcagaggaggaaggtatttaagagagaatgctgagcagaaccacatggagcttgaccccacccatagggtggaggagctgtcatcccagaccctggcacatccccaccatagcactcagggactgcggtgttcccccttctcctgcccgctggccaggacacaaccaatgggcacctacaggactggcccatccaggtctggggcaagtgcactgccttctactagcactgtccagcccagggaaggtgggctctcctgccatccctgctgcagaggttggggggcacttctgcccagaagggacatggagacttgggctgggtctgggttgaaacatggcagttagaggtacaaaggctgaggctcatcagggacagagaccacctccccctaccccaggcagcacatccctgagacctggtgcagccctggggccagctgggtgtcagaccaggctgaatggggcaccctggaggtggtaaggcttccatagcagaccccaagggctctagggcatggcacagtccctggcaatgaccaaaagcatttccccagttctgctggcaagaagcttcaggggcaggcactgagtggggggcacacatgtgcacacaggtgtgaatgcctccaagggcatgaatggtgggtgctagcaccatgtacttttttgtttgaaatggagtttcgttctgtcgcccaggctagagtgcagtggcacgatctcagctccctgcaacctccgcctcccgggttcaagcaattctctgcctcaacctctcgagcagctgggattacaggcgcccgccaccacacccggctaattttttttttttttttttgagacggagtcttgctctgtcactcaggctggagtacagtagcatgatctcggctcactgcaaactctgcctcccgggttcacaccattgtcctgcctcagcctcccgagtagctgggactacaggcgcccgccaccacacctggctaattttttgtatttttagtagagacggggttttaccgtgttagccaggatggtctcgatctcttgacctcgtgatcctcccaccttggcctctcaaagtgctgggattacaggcgtgagccaccgggcccggcctaatttttgtatttttaatagagatggggtttcaccatcttggccaggctggtcttgaactcctgacctcatgatccacccacctcggcctcgcaaaatgctgggattacaggcatgagccaccgtacccagctgtgagcaccactttcactcccaattttatgaatgtctgttatttcacatttaatcaggagcaaatgttgttttatgaaattgatgtgcaatgatcaatatggaaattatttttaaacacttgtcgggctctcaccactgcaacttggtttcagactcagattgtgatggcaggacagctgagctctgctccttggagctgcctctccggcacaagtgctcagggggtcttcagccatcactttttttttttttttagagacagggcttctctgttccccaggttggagtgcaatggtgcagtcacagttcactgcagcctcaaactcctgggctcaaatgatcctgctgcctcagcctccccagtagttgggaatacaggcatgcaccaccacacctgactaatttttgtattttttttttgtagatatggggtcttactttcttgcccaagctggtctcaaaactcctagcctcaagtgatcctcccactttggcctcccaaactgctgggattacaggtgtcatccactgtgcctggcccagccatcgcttcttagaccctcaggtctaatggacattgcaggaactgaccccttccactcagtcactgctgtgtccttatttgttttcttctaatgtccaagctgggacttgaaagtcagttttctttcctcaagaccagggctcttaaagtttagatgtctctcctaattccaaaagaaatatttgtttgattaggctggatgtggtggctcacacctgtaatcctccgcctcggaggccgaggcgggtagatcatttgaggtcaggagttcaagaccagcttggccaacatggtgaaaccccatctctactaaaaatacaaaaaattagctgggtgtggtggcgggtgcctgtaatcccagctactcaggaggctgaggcgggagaatagcttgaacccgggaggcgggagttgcagtgagccgatgtcacgccactgcactctagcctgggtgacacagagagactccatctcaaaaaataaaaataaataaaaatggaaatatttgtttgattcataatgcaaaaaaactagtaaaacagtgaagttcccatccactcccaaccaacccgagaaattaactccaaaacacacagaatggagcagccctcagaggcccacatgctgtgccattcaatctgtatccttgagctcacgcttccaagagcccacgggtttgttgtgggtgttcccagggctggggacagatggacagaaggaggaacagccccccaccctccagcctgggctcccggcatggagcccaggctccatggtgcccctaagggcctggcagacccgtctcccgccattgaatggtgtggatgtgtgtccctgcctagcatcctcctgtttcccgtgcggtcccagctgcaggctcccgagagctcacctggagccacggtgctccttcctccagtgtgggtgcagcaggactgccggcttcctgccctctctgagactggcccttgttgccactgaggccagttttgtgtgtgaaaagagaaaaagacttggctcgctcgtttccatctgaagccatcagtgatgctttcctcttgcaggctcatcttggcagccaacagggatgaattctacagccgaccctccaagttagctgacttctgggggaacaacaacgagatcctcagtggtgagtcttcctgcgtgctcagcggtggctgcgccttgttgcttccctagcccctgcgtggcccgagtgaccctaactgagtggtgctgcttccaagtgtgatggcggggtgtagaggtggaactgatggggctcgtggtcggggccagccccagcaccgggcattgccagagctgcccacccagcactgtctgcgtggcttcctgtgccatgcgtctgcatgggggccccatcatgtgaaagcatcagttggttttatatggatccctcctttttgctgagggcatgtgggtggatttgtgtgatgtacagatccacactcagtcactttgtgaagcaacccagtcatatgagtgtgtgcatgcgtgtgtatgcgtgcgtgtgtgtgcctgtgtttgtgtttctgtttgtatatgagcacccttgcttcagggatggtggggctgagtttgggaagctggtggtgctgaagccccgtcacctgcaccatgcctgtgttgcattaggtgtacttatagggcagaagtaggggtgagaaccaggtcctccccaccaaagataccagcctcattgaagtcctgttggacaggaaccagttcctgcccatggggtggtgggagtctacctggaaggtgcgcatagatggctggtgaggccacgggttactctgcctgcgtaccaggcgccaagtgggcccgaggcatcctggcatgctccagggtgcccactcaggccagatgtgtgacctcgtgggcccatggaggctgtgtgtgccctgtgctgcctcccaggccgggagggcaggtgttgggattataggtgtgaacccaacacttaaggaggctgaggcaggaggattacttgagcccaggagttcaagaccagtctgggcaacatggtaaaaccctgtctctacaaaaaaaaatacaaaaattagccaggcgtggtggcatgtgcctgtggccccagctactcaggaggctgaggctagagaattgcctgagcccggaaagcagaggtttcagtgagctgagattgtgccactgcactccagcatgggtgacagagcgagaccctgtctcattcaatcagtcaatcaatcaatcaaataaaagctcagctgtggggttttgtgaggactcctgtgtaggcctgtggcctggcagtagtgtgagaatgctgctgaggctgggtggtcccggcaccgtgtgggaggaggacgggtgcatggagactgaggcagggtggtcctaggcctgctggtataggaggatgcagtgggtgcagggctggtcaggacgggtgggtgaaggcacaagactgatgtccttggaaggtggaaggttttcatagatgaagatgtggcggctcagagggttaccctcttctggttccttgactattgtgccctcctgggctccatcccaccctggcacccaggtctgtcagctgcctctgaactagtgccaaccccagcagctccagtcttgtggaattgttcacccctgtggtgttttgatggtggcagctggtgcatggatgtacacgggcttctgccaagtgtcggggtgaccatatcactaaggcccacatcctctcactctctggcgtcaccggattgtatgcaaaagtttaggacagtggttctccaggtgtggtccttgggcctgtagcaccagctttacttgagaacttgttagaaatgaaatcaccctgggccggtggctcacacctgtaatctcagcactttgggagtccaaggcaggaggatcccttgaggccaggagcttgagaccggcctgggcaacgtagtgagtccctgtctttacaaaaaaaaaaaaaaaaattagccagctgtggtggcatatgcctgttgtcccagttactcaggaggctgaggtgggaggatcgcctgagcctggaaggtagaagctgcagtgaaccgagactgagccactgcagttagcctaggcaacagagtgagaccctgtctgaaaaaaaagaaaagaaatgcaaatcaaaatcattaaattcataaaaatttggccatcacttctttttttttttttttttttttgagatggaattttgctcttgttgcccaggctggagtgcaatggtgccatctcagctcaccgcaacctccatctcccgggttcaagctgttctcctgcttcagccttcctaatagctgggattacaggcatgcaccaccacaccaggctaattttgtatttttagtagagatggggtttctccatgttggtcaggctggccttgaactcccgacctcaggtgatccgcccgccttgtcctcccaaagtgctgggattagaagcatgagccattgcacccagcggccattactttttcaagtagtttttctgtcttctctctcactctctccttctctccagttacacacatatattagttcacttgcccttgtcccacacctctgcgatgctctctgcgtacttttctcggtgcccctagatcttgaggttttccagcctggtgtctgggagccagccctactccctgccctgtgtgagcactggtggttcttgccccagtgtcatatagtctcctccctgagatgctgatcagacattctctgtgtagctccttcctctctggacttttgtgccactgtcttagttcgtttgtgttgctctaaaggaaaaagctgagtctgggtaatttttttctttttttttgagatagggtctcactctgttgcccaggctggagtgcagtggcacaatcctgtctcactgcagcctctaactcctggcctcaagtgatcctcccacctcagcctccctagtagctgggactacaagtgcacatcaccatgcccagctaatttttaaaaataatttgtagcgacaaagccttgctgtgttgcacaagctggtttcaaagtcctggcctgaagtgaccctcctttcttggcctccgaaagtgctgggattacagataataagccatggtgcccagccaaggctgggtaattttttttttttttttttttttgagacagagtcttgctctgtcgcttaggctggagtgcaatggtgcgaccttggctcactgcaacctccacctcccaggttcaagtgattctcctgcctcagcctcctgagtagctgggattacaggcacctgccaccacaccctgctaatttttgtatttttgtatttttttattattattctttaagttctagggtacatgtgcagaacgtgcaggtttgttacataggtatacatacatgtgccatgttggtttgctgcacccatcaactcatcatttacattgggtatttctcctaacgctatccttcccccagcccaatttttgtatttttagtagagatggggtttcaccaggttggctgggctggtctcaaactcctgacctcaagtgatccacaaggctgggtaatttataaagaaaagaggtttatttggcttagagttctacaggggacctgaagcacagtgtcagcatctgcttctgatgcaggcctcaggaagcttctactgatggtggaaggggaaggggaggtggtatgtgcagatcacacacggagggaggaagccagagagagggaggaggcgccacgctcttttaaacaaccagttctcaaaggaactaatagagctagaactcatcactgtgaggacaacaccaagccgttcatgaaggatctgccattaggtagatctgtctcccattagaccccacctccaacactggggatcagttttttggtttgtttgttttttttttttttttttgagacagagtttcactcttgttgcccaggctggagtgcaatggcacgatctcggctcaccacaagctccgcctccaaggttcaagcaattctcctgcctcagcctcctgagtagctgggattacaggcgcctgccaccatgcccagctaattttttgtgtttttagtagagacggggtttcaccatgttggtcaggctggtctcgaactcttgacctcaggcaatccacccgcctcagcctcccaaaatgctgagattagaggcgtgagccacctcacccagcccggggatcagattttaacatgaggtctgggggacaaacatccaaactatggcagccatgaactctggttgtcttagtttccccaaacactaagcccctcttctcagctcagggagtctgctgaattcggcctggtccccccactccctgggctgggtcctggagcctctctaatcatgggctcactttgtttcctgtctgtcatatccttttttgtaaaacccatttgatatggtttggctgtgtctccacccaaatctcatcttgaattatagttccccaaatccccacatgtcctgggagagacccagtgggaggtaattgaatcatggggcattacccccatgctgctattctcatgatagtgagttctcatgagatctgatagtgttttgtttttttttttttgagactgagtttcgctcttgttacccaggctggagtgcaatggtgcgatctcggctcactgcaacctccacctcccaggttcaagcaattctcctgcctcagcctcctgagtagctggaattacagccgcttgccaccacgcccagctaatttttgtatttttagtagagatggggtttcaccatgttggccaggctggtctcgaactcctgacctcaggtgatccgcctgcctcggccttccgaagtgctgacattacaggcatgagctgccgctcccagccaagatctgatggttttataaggggcttttcctgctttgcttggaacttctccttcctgccaccatgtgaagaaggacatgtttgcttccccttctgccatgattgtaagtttcctgaggcctccccagccatgctgaactatgagtcacatatctttcctttataaattacccagtctcgggtatgtccttgtagcagcatgagaatggactaataaatacaccattgtttcttgagttttatttatttatttattttttggttgttttatgcaggagggtaaatctggtccttgttgcttgggcaatttggaagttttgttcttgttttaattattgatttgtaagagttatttacccattctggatatgagtcctttgtgcctactcatttccttaatgatagcttatggtgagcagaattttttttttttcttttgagtgggtggagtcttactctgttgccaggctggagtacagtggtgcgatctcagctcactgcaacctccgcctcccaggttcaagtgattcttctgcctcagcctcctgagtagctgggactacaagcatgcaccaccatgcccagctaatttttgtatttttagtagagatggggtttcaccatgttggccaggatgggctcaatctcttgacctcttgatctgcctgccttggcctcccaaagtggtaggattacaggcgtgagccactgcgcccggccagaatatttcattttaacaaagtacagtttatcttatcttttatgagttgttctttttgtgccttatccaaaaagtctttgcctacccagaggaaaatatataacaatattttcctccatttgcttctagaagcctaatttttgtttttatgtttggtctatgatttatctcaaggttttgtacatggtgtgaggtaggggttgagatttactgcctccaacccccaaatctctctagttgttccagcatcatttattaaatggattatcttttgcctagttcattactatggcaacttggttgtacatcagttgaacatatatgtgtgggtctattcctgactctgttgtatcccattgatctatgtatctgtcttgatgccaacaccatgcagtctatgagtgctgctgctttttagtaagtcttgaaatcaggctgagcactgtggctcacacctgtaatcccagcactttgggagaccgaggtgggcagatcacctgaggttgggagttcaagaccagcctgaccaacatggagaaaccccgtctctactaaaaatacaaaattagctgggtgtggtggtccatgcctgtaatcccagctactcgggaggctgaggcaggagaatcacttgaacccgggaggcggaggttgcggtgagctgagatcacgccattgcactccagcctgggtaacaagagcgaaactctgtctcaaaaaaaaaaaaaaaaagaaaaaagaaatcaggcaatgtgggtctgccttctttttcgggactattttggccatcccagttcctttgcatatgcatagatatttcagccagtctgttaattgctataaaacgaaaagccccctgggattttgactgggcaggttttgaatctatgggtcatgtggggagaagtgtcaccttaacaatactgagttgtctaagaagtacccagtgaaacaaataataacaagaagaaacactgttgaggctgggcacggtggctcacgcctgtaattccagcactttggaaggccgaggcgggccgatcatgagatcaggagaccgagaccatcttggctaacacggtgaaaccctgtctctactaaaaaaatatgaaaaaattagctaggtgtggtggtgggcacctgtagtcccagctacttgggaggctgaggcaggagaatggcctgaacccgggaggcggagcttgcagtgaactgagatcacaccactgcactccagcctaggcgacagagcaagactctaaaaaacaaaaacaaacaaaaaaacactattgaatctttcagtgaatatgcatgtctctccttaaatcaggtcagctcaacttgagaccctcaacagtgccctggagttttcagtctttgtcactcatttttcattaaatattttcctggtggtttttttttttttttttttttttgagacggagtcttggtctgttgcccaggctagagtgcaatggcgccatctctgctcattgcaacctccacctcccgggttccagcaattctcctgtctcagcctcccgagtagctggaactacaggtgcctgccaccatgcccagctaatttttgtatttttagtagagatggggtttcatcatattggccaggctggtctcgaactcctgacctcgtgatccgcccgccttggcctcccaaagtgctgggattacaggcgtgagccactgcacccggcttttttttttttttttaatcacactaaggattttaaaaatgctgttataaatggtatatttaaatgctcactttccagttcttgctagcatttacttattagttctaatacatcggttttggtattccttttgggttttcttcatatatgatcctgctggttgcaaatacagttttgttgggttttttttttttttttgagacagagtttcgctgagagtgcaatggtgtgatctcggctcactgcaacctccacctcccgggttcaagcaattcccctgcctcagccccccgagtagctgggattataggctgcctcagcctcctaagtagttgggattacaggcatgcaccaccacgcctggctaattttgtatctttaatagaaatggtgtttctccatgttggtcaggctggtcttgaactcccaacctcaggtgatctgcccgcctcggcctcccaaagggctgggattacaggtgtgagtcaccgcacggggccacaaatacagttttatttctttatttttgatctttacatcttttctttttctgttataattaattattgttataaaaataatatcttagggccaggcacggtggctcacacctgtaatcccagcactttgggacgccaaggcggacggatcacctgaggttgggaattcgagaccagcctggccaacatggagaaactccgtttctactaaaaatacaaaattagccaggtgtgatggcacatgcctgtaattccagctactcaggaggctgaggcaggagaatcgcttgaacccaggagggagaggttgcagtgagccgagagcacaccattgcactccagcctgggcaacaagagcgaaactctgtctcaaaaagtaataataacaataataaataaaataacatcctagccagtgcagtggctcactcctgtaatcccagcactttgggaggctgagtcgggaggatcgcttgagcccaggagttcgagacaagcctgggcaacacagcaaaactttgtctgtacaaaaaaatgcaaaaatcagccgagtgtgatggtacctgcctgtggtcccagctacttgggctgaggtgggaggatcgcttgagcctgggaggtggaggttgcagtgaactgtgtgattgccactgaactccagcttgggtgacagagtgagactctgtctcaaaaaaataaaaaatgaaataaaataataaaaataacatcttaatgacagccttttttgccccaatctttgggtaaaatgaccccctggtctaagaaggagccctcctgtggctttcagagccctccaaccttgtggcattagcagtggcccatgccctgcagatttggcgggggtgaaggtcctggttgtgtgctgggctcctagtgaagggcctgccctttgggcctggtgcatcctgctgggtgaggacagccagcgtccctgcaccccattcatgcgattggagcctagtgctgcccctcagccttgacgctggcccaagtggaaggatgtgttctgcagggcatctgttgggataggtgtggttggtgtcatagttgtcctgcaggacagggatctcacttgcacgacccatgaaccccaggggctgcctggccttgaagagttccagccacgattccatagctggggctgctgggccaagccgcatgtcgaacgtcctcgaggagcttgaggcaggagctgggccgagtatgcgtctcccagggctgggaaccaggtgggggactggaatgggtggcatcaatggtggtaacactgtcatctgccacagggctggacatggaggaaggcaaggaaggaggcacatggctgggcatcagcacacgtggcaagctggcagcactcaccaactacctgcagccgcagctggactggcaggcccgagggcgaggtaaggcgagtggggtggggccaaggtgagacagggtggggtggggcaggcctaggtgagacaaggtggggccaagggactacaggactggccaatgtatggtggagtggggcgggccaaggtaggaagtgccaaggtgcttgtgcttgggagtgggatggggcagggctgaggtaccgtggggcagggccaggttacagagtgggcggtgacaaagcgtggcagggcagggcccaggtaagggtggggacaagaagggggaagctgggccccgtggcaggtgggtggcttccgtgggcatatcactgccgccactgaggtgtgctgcaggggtatgcggcagagacaggaagagtgaggaggggagcatcccatttcccacaccctggccctctggcgtcgcagccaggagcccactcccacctgacccacgcagcactgtttactcctctcagggcgcactctccccttgtcctcatgcatggcactcctgactgctgtgtcactgtcccctgcctggaatgtttgtagagtagatgccttccccgagacgacagctctgtggacacacattgtccccactgaaaggtgttgtttacttcatgctggatttccataggaagacatagtggggaaattttttttttaataaaatgagcagttttcagtgccgacctgagtggcagccaggctaatgaggtgtggctgactcttgcggcagtcatgacaggccagggctccagtgggacccctcatcttcctgcatcctccccagggggccccatatcagtgttcctgggagaagagcacatgcctgcagctgtggacacagcatctgtcccctgcctacaggtgaacttgtcacccactttctgaccactgacgtggacagcttgtcctacctgaagaaggtctctatggagggccatctgtacaatggcttcaacctcatagcagccgacctgaggtgggtctgccagagggggatggcggctctgcccagcactgcctcgggggcaggcctcaggctcatcaggaagtggggttccactgggggctgtggcagcctctccagggacgttgctcctcgtgacttggcaaacattctgaggactgagcctgtcacagatgtaccaactcgggtatttgggggtgaagcccaaggcttcctgtgatggcatgagggctgccggatccctggagaaagctgaggctgtgaagaacagtcacatagagtggctctggccgggtgtcctccctcccacgggcaggctgtgcagagcagccctccgcagccctggcttggagtgactgggatgctgtgctcccagggaagctcctgttggagatgaggccgcaggaactgcggaggttttggtgttttgcccttccgtgaagtgagcattcctccctcctgccctcctccccctccaaagccccagaacttggccaatgctgttagtccggggccttctgccaggacaggcaaacgggaagtggtcggcacattgtggcgggccctgaagctgcctccttccacaagggcaggtccatgggcctctctcctggctcccgagctccaggcctgctgttcgttgagcatcccttgtgtgtggcatgcccagccctgccccacatgggtctgcacacttgctatggaggctgggagagttgcagtgtcccctaggtggaaggccgagggctggtgcggggcacttgctgtccggagccgttcttcctgcccatgccttcgtgactccaggtggcagagcccctgtgctctctgcatgcccccatgctcaggaaccacttttcccggtcagtagttccatgtgggtctgattagtctcaggagagttcctctgcggccgtggcaccagcaggacttggcactcagcagctgtgtggaggtggggtgccaagggtgccatgccttgagcagatacacgggctcctgtggttgggggttgggggtttgggctcctcagagcctgtgcaactctcccggctccaaaggctgcagagtgagggtcagcctcctggacctagcctgaggatacaggcagtggccaggagagcataccacaggtcaggcaaaagctggtgccagggccgaggctggagggcgggggcatcggaggtcagtgagcagccctgctggtaggtgcagatgaggaagccaaggcctggaagggagagaggcttgtcatggccacagctatccctgggtgaggcctgccctccgcctggcctgtggtatagtgctggcagcatgggtgtccagttctgtaggtccttacacagaaagcccagaggagatttttgcctgcaaacagtctctgaaattatgaaccaagtatcttaggaaagttgccaaagaccatggtgaggaagaacgggagtggaatgtgaacatagacgggggggcccttgaagcctaccaggggtggggaaggtgggtcccacctgggggcagcacttcggggaggaaggcaccatgcctggctctttctctgcatctgttccatcttgaaggcccagggctccatgcccagcatctggcctgggagggcatctcacaggccacaaagagatcctcttcactttgcaaaaaaggcactccaagttctagaagacttactgtggtattgaggattggaatattttcagctggggagcattttgaactattttctttttaaaaaatgatttatttattttgtagagatggggtcttgctatgttgcccagtctggtttcaaactcctggcctcaagcagtcctccctccttagtctccagattagctgggactataggcatgagtcactatgcccagctctactgtcccttaactattttaaagtgtacacttaacacttgagagtaggaaaatgtggtctttggcgctttctttggaagcctcgatcaccctggggccacactggggccacctgtccagaaaccctcatagatgagctgtggtaaggggcctgatggagaggttggtgatgtggggatggggctcagccctgcagttgtccccatgggcagcctctgtgtgtccatgccatggggcattcggcatggcaggagggcattttagatcctgtgcctcctgggctggtgggccccgaggtgagctgggaacatacccgtgatgctggacaagagctggggcctccatgaccccgcctgccaggcacctgaggggctgggtcctgcaagctcctgacctggccgcagcgggctactgcgcacatcgctagcctccagaaacagggctgtgagatcaccgggcagtgtcggggaggacgccctatggctgtagtctgacattctctccccttggcctgcagcacagcaaagggagacgtcatttgctactatgggaaccgaggggagcctgatcctatcgttttgacgccaggtgagcctgccctggcagcctgatggggtgggggactgtttctatgcagaggtcacccttgtgctttttagagaccaggcacttgtcatattactcttctgagatgactttgtggccatttaagtgccttatggtctgtgggcaccttgccctgcacctggacacttcagagagccctggctccctgctcaccccctccccatgggcttttcctgctgagcaaggtgcgcccctgttctgggcttcccaccgcagccctgcagcccagccggccacccccagcctcacttcctgtgccgtcccagtgtgccctgtgcctgttccttctcagaacctctggagccatcaccacctggggttcttgcctggtctgctccctgacgcacaagtacacaccccactcaagccccacacagatgcacgcctcctgcacccagtccccagtctgatccccggtccccatcctcagggcctcgagcccctctgcgccaggtcacactccacggctgggcccttcctgccctggctctgcaccactgcccaggctgtgcctcctgctacatgcccttcctttccccctcctcgggtgctgcgatttcctggaagcttcctctgccagtgccccaacctggagagaatgtgtcacattgcccccctctgcagccatgttctgggagggaggtctgcatcttgtcccaggtctggtgccaggacaaagcagcactcctgggaaatggcatttcccctgggtgcacaaaactgtagggaccatagcctaggttccggggactgctggctcactcactcccacactcgctgcccacagacactcctcgctggtggcatcgtggaactctgtgccttaaacgcccgctctggtccctctactcaagctgctggctcacacagggtgttccggcgcctggggagtgtgtcagtgcccttagcgccacccacacccctctgtgagggggctccctcacacccctggctcctctgaagctccatgcccacgtcacacagactttcttttgcatttggcacaaatcaccaagtgaggttgcaggtcacaggtgcacaccttcccactgggtgtacacggtggaactgaagccccaggcgtccctggaggggcccgagggagatgataagcagtccccaggacagctgagtggccccatcccacctgcatcttagggggctggtggtgctgacgggctcatcatgagtcctgtggtccttgcctggcccacactggagctggcttccagcttcccacgtctgcccagtgatgtttcatccacagataggcccagcccccatttgctagggtggtgcccagacccgaacccctgggctagttgggatctccagaggaggcatctgcctggagggtggcttccagtgtgtcccacccactgcccccacgcctaccagctggtgccctctcctccacctggggcttatccttccggccaccctctgtgaccctggtcttcccctccctaccttggatacaactgtgggcagcccacctgagctcccaagagctgggcagtggcacagacacagagactaccagcgaggcagggatgtggccccagaaggtcctgagcttgcaaaggattgttctggctgtctcagccagctcttgctgttccacctgccccagaacctccgcatcagttgagggtcgtggggttggaatgtgtggcgaagtaggtctgtggcagtggagttgggccatgctgagcctgtgactgcccaggagagaattggaaactaaaaggtgcaaaagcagtcagagactccctaccaccccctcactgtgaacattggcccagcggcctctggggcagtcgctgtaaccatccacgtggcatcctcggttctcagaggctgagacctccgtggctggagatgcttattttctgctcagttgttgttctgtagaacttatttctgtctacatcctgcctcatccctgagcctgccccacctggtccacattgcctttttttttttgataaagttttattgagatatgactgactagcggcacagttcacccatttaaagtgtatcattcagtaggtttcgtttcattcacagagttgagcaactgtcatcactacctaattccaggacatttcttgatccccaaagaaagccatacctgtcagcagccactccccattccccgtctcttcagcgcctgcaacctttaatctgctttctgtctctggatttgcctattctggacactttgtataaagggaatcctataatatgtagtttaggggactgacttttttcacttagtgttgtcgtctaaaaactcaccagtggcgaggcacggtggctgacgcctgtaatcctagcactttaggaggccaaggcgggcagatcacgaggtcaggagatcgagaccatcctggctaacacggtgagaccccatctctactaaaaatacaaaaaattagccgggcgtgttggcaggtgcctatagtcccagctacttgggaggctgaggcgggagaatggcgtgaacacaggaggcggagcttgcagtgagctgagatcgcgccactgtactccagcctgggcgacagagtgagattgcatctcaaaaaaaaaaaaaacaaagaaaaactcaccagcatggctaaatgatagaaaggagagttttatttgccatatcagtttgcagacccggaagagagagtctctagcatggactgaggtgctctctttgaagaggggaagggcagtttgagttttatgcctcccaaggtccatatcacacaatagagtcatacatattcagcaggtttggggaaaagccatacatatttatgaggggacccgagaacatatgcaatagataaacatacatgtaacatacatcccatgttcactttggggcagggttttagcattaaaatgaggtagaatctggatctttccatcagaaggtgagctctaggacacagttggagtgcagcctctatgaactgctgaaactggcttatggtctgtagttgcttatcagaaaagagtgtttgaaggctggttctctgtccagtcagggttgtggtggtctgggctgtcaagagttaggagggtctgataacgtgtgtgatctctactgttgtgagggagtttatcaagactgtggtttttcttgtagctgtaggaatttagggagttgctgagacagctgccctgaaccctcgagccagttggtactttttgtttcttccctttatccattaatggacacttgagttttttccaccttttggctgttggaaacagtgctgctcacagtgtgacctcacagcatttgtgtggtcatatgtttttatggctctcatgtgaatacgtaggaatggagttgttaagtcgtatggtaaccctgtttaaccttttgaggaacatccaaactgtttgccaaagcagccgcagcattatacattcccaccagcagtgtatgcgggttgcagcttctctgaatcctcaccaaaacttgctatgttctgtgtttttgatgatagccacgatagtgggtgtgaagttgtgtggactcgtggtttggtttgcgtttctctgatggctatgatgttgagcagctattctcatgctcgttggccatttgtatgtcttctttggagaaatggttattcagactgggttgtctttttgagttataggagtgacttatacattcattctagctacaagtctcttatttaaagcacaaagcttaaaatttttaagtcctatgtctctctctttttttttcttttgttgctcatgcttttggtttcttatctaagaaaccattgcctaatctaaggtcatgaagctttccccaatactttcttcttagagttttatagcttttgctctttcacttaggtctttggtttgacttaagttaactatttttttttttttgagacagggtctggctctgtcacccaggctggagtgcagtggtgcagtcatggcccactgcactgtcaacctcctgggcttaagagatcctcccagccgggcgcggtggctcacgcctgtaatcccagcactttgggaggccaaggcgggtggatcacaaggtcaggagatcgagaccatcctggctaaaccggtgaaaccccgtctctactaaaaatacaaaaaattatccaggcgtggtggcgggtgcctgtagtcccagctacgtgggaggctgagacaggagaatggcgtgaacccgggaggtggagcttgcagtgagccgagattgcgccaccgcactccagcctgggcgacagagtaagactccgtctcaaaaaaaaaaaaaaaaaaaagagatcctccctcccaagtagctgggactgcagatgtgtgccaccatgttcagctaacttttatgttttgtagagataaggcctcactattttgctattttgccgaggctggtcttgaactcctgggctccagtgatcctcctgccccagcctcccgatgtgctgggattataggagtgagccacctctcttgacctgagttaacttttgtgtatggtgtcaggtagagtccaactcccttctttgcccatgactatgcagttcaatggtcttccatgttgttcatgatggaaaaagcactgtgacacctggggctggcggcttggctctgggggccccagcagagccaggctgtctccctgggaaatgcctcggccaagatattctcctggaagtctgacagggagagggtggtgtcttggtctccctggtgcatcatttggggtgcttggctcccatcaagcccacccctgctgccctggcctctagagaagagcctctgaggtgaggtgcttctccacctcaagtccctgcccttcactttctgtgacatgagaaacccttttcctgttggccatgccttctgccaacactctgggagcttgttcagagtctgtgcagagccccccggctctcctaacctggggcctggctggtacgcagaggtgggccatgctctgctgaggcccagcctacacctgtgcccactgtgtggcgctgttgggggttccccaaacagggacatgattgtggtgggtgcctcctggcctctggtggctaattctcccactcttgaacttctcaggtggccccccaacctggcgtgaggtgaagaggttccctcttggctgtcccctttgcctgtgagatctcaggttgctcatttcttattcatccatccatcgaggctgctgggcatctgtgccttgtggtctcctgtgggtgcccgcttccgcctactgctgagttctcctctccttgccatgccatcaggtcaggaatgagcatggggaaggagctggagcatggagcggcttggcctcagtctggcctgatttcatggtccccagctgtaccccgtgttaggtgggtggcaggtggcaatttgccctgacatggcacagcagggcctctgcatggcccgctgattgctcctcacaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggtgagccccagtgtcccgccaccagggcagagggaaaggcaggccctgctgccccgggaggcccatggaagtggccaggctgggtccccagctgcagggaagctgatggatatcctgtcctccctgcctgtccccttgagccagctgaggtttccaacaccagggacttttgatgacagaagatgggcccaggcccaggcccaggcccaggggaggctcagtgcacccagaggcttgatgcagccacgtggggcccagagcagatggatgctcccctctgcatgccgagagcttgtgggaagttccagaagattctagacactcagcaaacccaggcggaagagacacatcatggaaatgagtggctagggtcagcacgctcagggttgatgggcttcccgcaagcggtctgtccccagcgaccctgggctgagtgctgggcagggacttgcagttccgggaactgcctgggtgtaggagctcccacccacttccttgcccgtaggcctcaaggcccctcaggggccaggcactggggtcttcgttgccccagccgggggtcctggtgcttgccatgccagcctttctcccactgggcgagatgccccacccatccctcgctccccacccaggtcagaccactgccctgcccaggtgatccagcgtccactcccaccctgtccagcttgcccccttcagagaagcacccatggaccatctcccactcctccccctggggcccctttctgccccctgcctaccctccttctcctctgggcctctgataggcggcctcgtccttcagcctcagcatcgctgcctcactggaagagccccacctgggcatgcccagcagcccctcccagctgtaagtccacacagcccccatcaatgtgccatctggggcaggccgaggaccggccctggctgccctcactgatggctggagccccgatgctagctacaatggctggcttgagtggacttctgtcacagaggcaaatgcccacagggcacctcttggggcaggcagggagcttgtatgtgccatctggggccaaagctccacgattgagtcataagttaagggtagatggagattttccgccttgagcagaaacgtggaggaaacacgcctggtgtgtgactcacgcctgtaatcccagcactttgggaagccgaggtgggcggatcacctgaggtcaggaggtcaaaaccaacttggtcaacatggtgaaactctgtctctactaaaaacacaaaattagatggctgggtggtgcacgcctgtaatcccagctgacggctggagccccgatgctagctacaatggctggcttgagtggacttctgtcaggagaattgcttgaactcgggaggtggaagttgcagtgagccaagatcgtaccattgcgctctagtctgggcgacaagagtgaaactcctcctcaaaaaaagaaaataagagaaaagagaagagaagaggaaaaagaaaagaagaaaagaaacaacccttgcagttccccggccactccccagagccagttaggccaccaggtgggctggggctagacccggctgcgggcgggccacagagggactaatggccaccacttctctccatcctgcaggcagctgccagacccggccatcgaggaccagggtggggagtacgtgcagcccatgctgagcaagtacgcggctgtgtgcgtgcgctgccctggctacggcaccaggtattgcagcaccgtgggtgcgccacctcctatcccatgtcccacctcccacgctagagggccggcaaagaagccaagtgcccatagccagagccaggcttcttcctcgcctgagtggattccagagcttctgccctgtccagacgcagctgcagggtgagcagataccacaggctcccggggccccacaggctgggcttaaggagccagtacacagccacacagggccaggatggcttcagggctgcctgcacattggtggatccctgcgggcaaacgccccggcaccatggcactaggcctgcaggctgtacccttgggtggtggctgctggccagcctttcctgcctggggctggctggcccattggcaggtgcagggtgtcatttccttcagcccctcctctgtcataggctcatcttcctgtgtgtgaggggaaggcaagtgccaactccactccctggcaggccgcatagccgctgggtcccaccccacggggtgcactgcgtatgtgtctgccctgggaaccagcctgtgctggggctgttgggggatccagggccaccctccgtctgcaaagcccacggcagagagggttggaggagaggagagtgtgctgaatgtttgcttcaggtgggctggcatggcctgggcagtggaagagagggcacaggagggaagccttccagacagaggaggcctgggccccaagtggtcaacagcttgacctcttggaagaaccaagcatggctgtgtctgggaacctgggcctccaaaggggaagtgtgtggtcagcccgcaggctgccctatgccttggctcatgctacacggggagagcagggcagggtggggtggttcccagtgaaggtggcaggactcagcaagtgtgggcctgtggagccagccaagagctcacacgccactgatggcccctcatcatccccaagactgaggctgctgctctctgtgacttggcacagcctccaggcatggggttcctaactctacctgcctgcattcttgccctatttgtggctgtgacaggcagggcagggctgagggacaccaggtgaacgagggcccctgctctctttcagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcg

SEQ ID NO: 1026 - DNA, 8711 bp, Homo sapiens
tcagtggcttcgcacatcaaaaatttatttcttgctcatattacatgtgcatcgcggtcggcagaggggctctgctcatcacaggctatcaaggatgacagcagacccctcccttctgccgcagttacacttacaggtggactcaaggttgaatgtcaaaggcagaaagttacaacctgggaatacaggataatgcctttgtaccccccaggtagggaaagatttcttaagtgagaaacagcatcccatacagcacaactgggcactgcctactcaacagccaaggcttggccatccccactcctcagtatgggccccagaacccagggcctgggggactctgcacacaggcatgtggagaccacagaagcctgcccaatatagcgctgccaggaacagcaaagacaaaaccagagaagcctatcgcgggcaccgctgtgggcagaactatgtcccttcaatatttttatgttcaagtcctaacccctagtacttacatttgaagacagggtctttaaagaggtaattcagggttaaatgaggtcatgagggtgggccctgatccaatagactagtgagcttatgagagattaggacacagacacagacagggacacggcaagaagatggctatctgcaggccaaggagcgaggcctcaggagaaaccaaccctgcccacaccttgatctcaggcttctagctccagaatcatgaggaaatgtctgttgtttaagtcccctagcctgcggtcctttgtcaggcagccccagcagacaaacaggtatgttgccctgggatggatgcaggcccctcccatcctcccatcctcagcagcaccaaccagccccacgctgggtggctgcttgtacttctccatactgagcaccccagcccataggatgatcagctgctgccgtcctatggaactcaggtgtggctctgtggcttcctttggccacagaaatggaagtggggtgacacacattacttgtggcctgctgtggcctttcccctgcctcagtgagcatggagaaatatgtccaggtaggctgtcgtcagcacaggtctgacaggccccagccacggtggcccacaggtgcaagcaagaaataagcagtgccaactgtagccgctgcgctgttggagatctttgttactgcagcacaatctggctcatgctgactgatcctgcagggtaacagctttatttgccttgctcctttattgctggatctttgggcttttccagttctgctgttcaaaaaacagtgacacccatgaggtgggtgttagagggcccagaccccagccaaggcactgcatgggcatcattctcattcaacccttctaaccaccccatgaggaaaaactctggtcacagctcaaaaaggtcaggtaaggaccctcagctcatgcggggaggggaggaggcaaggccaacctccagtccctgctctaaacccccatgtagtggtaccgaaccatgaccacccctggcaagagccttcatgcacctagcaagtagtcacagcatgcatgtgcctagaattgttacgtggtcaaattatattattgtgtattcccaccaacagtatgagaaggtccacttctccatacctccacaactctgggcatctaaaacttttaaaatcctggaatcataggcaaaaaaaaaaaaaaaaaaaaattcacccatattttcctctagtactttcataattgtaacattgaaatctttaatctggaatatgtactggcataaagagtgaggcacatacatggctttactattttccagagggccaactgcttttactgaataatccattttactcgttaattggaaacacctctagcctgtactaaatttccatatttatttggcccgtttcaaagtcctctattctctgctcatctgtccacatctaagtgctttaactattgtggctttataaaatattccaatatcccataggaccttatccttagtacttcctattttaaagttttccttgcagacaggtactttaaataccatctcacagcacccatcatgtcctatcttcaggaaataaaatctctgggtatttccaagggaagtgaaggactgacaccatgattagaaagcagagccagcaccatggcccgtccctgagcatgtccagcaaaccctgccaggctctgcagctcctgagcaccctgccttcgggtctgccagtgtgtgggggccagaagagaaaaacaacccagggggaatgcctccttcccccagcaggaaagcagcttggtcatcatctgtctgaaagcaggtgctgcagcagctggcaacaaagccactctgaaaggagctgtgtgcactgcctgtctggaaggccatgccagagtccatcgttgcctccaccctacctgtgcaggaaacctggacatcaccacttcaaggccctaccttcctttctgggcagagcccaaccacaataaacaggacgcgttttaattaaaaaccaggtcacctggactctcccaaggactctcaagcctgcctaggtggatgctgcatgactggccctcagacacacggcagaccataactcacacacccccaggagctgcctgggtcccaagggcacaaaagccccaaagccccaataggacagggttcaaaagagaaggcagcaatcccaggctggagtatccacttcaggtccactaaagggagatggggaaggtggcctgtccagaagcctgtgggacagggtaaaggtcagctgggtgactaggctgtccatcctagagagcaactctgggttctactgccagacccacaggtgagccaggccacagtgcactggaggtaggcatcagggagcagtctgacccaacccacaaaaggggggatggggcctgagtcatcggacggagggcagctgtgacctggcacagaagcatggggctgggccaggacatccagggacttctcacatctgaccagaatcaagactgaaaatgggtttcttctgccagctcacttgctttgctaccagggctatacctgctttctaaaaatagcttcccacctatttccaaggtttccagttgttttacctacaaggtatctgtgccctgaaataactcacacataaaaccatctgaacccagagccttttctagtgatagttaccataaaataatcccaacaatttatatttttctaaataaggtttttgttttttgttgtttttttttttttgggatggagtttcactcttgttgtccaggctggagtgcaatggcgtgatctcggctcaccacaccctctgcctcctgggttcaagcaattcttctgcctcagcctcccaagtagctgagattacaggcatgcaccaccacacttggctaattttgtatttttaggagagatggatttctccatgctggtcaggctggtcttgaactcctgacctcaggtgatccacccaccttggcctcccagagtgctgggattacaggtgtgagacactgctcccggccagtttctgaataagtttaatcagatgcttgctaattagtttttcctaaaatagttggctgtatttccaattcacatttctgctttttcttcctactttccaggaaggtgttgttttgttgttttcacaattgtaaacctgaaagggacttgaacttcttgtccaagcaccagagtgggcacacactgcacacactgggcggctgtacctgcctatcctgtggtaaacttggctccaggagcttccaagctcagcttccactagaaaacccctccttgtgtggaacaggtctttcttcattccattcctctgggcctggggcctcacagctctggactgctgcctggtcctcacttcacctacagctctcggaagtcagttctctacctgcagagccacccaccccctactcagccccacccagcttctttgatcagacccttggaccctcaaagcccctgccagaaaccacagctgcaatgctgacctggaatgctcatggccaggcctctgctcctgacagaatgggaaacaaagacttgctggtaggcagccactgcaccacctcagccagtaatccaacacgtgtttaatgagcaccaattgtgtaccaggccacagagctgactaagacagagcccctgtgctgagggtcacagtctgccaggagggagatccaagtcatttacacactagggcttaagtgctgaatccgcaatgcatgcgagtgcggagtgagcaggggatggcagcacagcagcagggaagaggagcctgcttcagaacaccaggcacgattagagctacagtgttaacacacaaagggcgaatgcctgcagctgagcctggcaaggggcttgcatcccaccttcctgcatccaaaccttccagctgcccagaactgctggtaatcccacaggaaacatcattctttgccaagatgctatcccactcatcccccagaatcaaagtggccacttcctccaggcagccttcctcacattccagctgggacagaagtcacagggagcagagagggtggggctagggggacagacacagaaaccccatacaggaacgaggtcccaacagggcagacgtggcagacccagttcagtcccagccagtgtggaagacaccaaggggggtgttttatgggggtggaggtgacaaagatgatgcaactatctgctgagagttgatctacaaaacgaccccctcgtgggagcaggcctgggtgagacggcactcccagaagacgggcagggatgcagcagagagccagcagcagggaaagggcacagggcggaggtcaagctctgctggagttgggggagctggttctgctcagcgcagagtccaaaacaagcgcatcttgcccagctatggggtctgaagtcatctggggacaccactctgctctgactggggactatggggcgctcaagccacacaggccacttcatcatgaggggcagcattgttcccacctgggctgtgttcagaacccaggagaaagtggtggctctcctggggtctccggggcctccaccacctcctgtggggtacctaaggacacctcctggtctccctctgtctccaaaacctcctcctctgttttctggggttttggacctcctggatgagctgggtctggtctctgggcaggaggattagctgactccgacagtctagggacaggtgtgggggctgcctcctctggctgggaagaggctggttccacaggaccaggcttggagctacatgtagaactgggcaggactgggggctccttgggcccaggggtgctctccttggtcagctgctgctcgaacagagcacttctagatacagagttggacccagacacagcaggggtggccatggcggctggtaaagacctgggggcagtacccatgtcgagtgccaggccctctaagaacctagctaagtattgcctcaccacaggcagctgaggggccactggcagctggctggaggccaggggcaggggacaggtaaccacagcatggtactcagcaaaactgttcgggtcttgaacaacttccttgagatcctggcagaagagctcgtaatcgtcaggcaggggcaggtccccatcaaggtagggggctgcccaggcctgggctcggcctgttaggcgcctgaggatctcgcagacacggctgatgttgtcctgatagtgctcaaagtggaaggacatgtaatcgcccagctgggccaagaagcggtccagtagccacggggagccatcaaaggtgcctgggtctgagcctggtacccagcagaagtccaccctgtggggtcgggagctgggcatgtgcccagctaggggacccctttctgcaggtttaccgccacaagtgccactagctgtgctcttctgctccatggtcgttcgcacacacacggtgtccccacagcagggccgctcaatccagggatccacaaggggggtgtatgccaccccaggagacgccttgtccatctgctgccatggatgtgcgttggcataattggcggctgcccagatgggaatgcgagggccctgctgacggcaccggccacgaggcatgctgggagcacaggggagaagagaggagagccagcactggtgggtggtgggggtgtggacagatgtggcttgcacgacacaacaggacagggatggctgaacagggcgtggcagacccgcactggtccaggcaagtgctgaggatcagggagctgacagctgcagcctcaggagagctgagaagagctgagagactgtcagtcgcaggccatcatccgaggcaatctgtccaaagacaaggtggggaagagcaggaactaggcctaaccatcacccactggactggtgggaagaggctacaagcgggcaaccctctggtacccaactaggagctttgaatggaaggaggggcccagggggctggcctgggaggtctgaggtgggcaaatgctgcctatgacattgcaagggcaaggcagaatgacagatgctgtcaatttcagaagaaaaggggccagatcagaactgtcaggaatttcaggatagcaatagtagtaacctttcactgagtgccccatttgtgccacctcccccacaggaggttggtactagcattgtctttgaggcacacagtggtgaagtaacttgtctgcagccacacactaacccataagtggtggaagcagcaaaaactggctggagagaccagaggcttaactactatacagcacgcgattataaactacatttgtctgctgagtaggctctagccgccccaaaaactctgaacaacgcacagaccgcgtcgtcattaggctcttttacatcccagcaccaggcacacagcaggtcctacctgcttccccgacagagcagtgagcctgctattctctgctccctcctgaccccacatgctttccaaattcacctctcacaactgagtgccacctgcaggcaatgccacccccacccacaaacaccacctttccacagtccccatcccagccacagcagagcatcccagcccccaccattgtaaaatcctggaaccccacttgctgtctgctcccgccactccagtcacttgtgcccagggtctggggagtcccagtctgatggctggacccgcccctccttctccacgcagcagtcacctaggaggctccagagccagtagccagttctattccagtgcaaggagccctcctgtagggctcttacactctgcagcctaactctatctagccccctccccagtctctctgcaaacggaggcccactcacgacctccaggaaactctctgcttcaccccacacacaaacgccaccggctcactgggagcacaaggcctgcacacaccttcatcccacatctcctatctgctggccatcccccctcagggtgagttcctccaggtacctcccagggtggcctgcagcactagaacctgccagggccactggccctacctccaccacccaaacactctggaatccctcaggtctgacccccctctggggggggggtcttcacctgaaagcccagcccatgaccctggcttcccaccttactgcaggattatactaaggcctggacgtgagtcgagtccagtccagtccctcactgagctctaaaaaagcagtgaccccgatccagggcccagctcccaccaccagccaaggttaggtatccaggttgcccacaatgaccacaccccatgcccgggagccacagtgtgctacccagatctctgccttcccttcttcccagtcccctaccctgcccactcacctgcgcacctgtgtcccctgcagtctgggagaaggcttccctgcaccagccagccaggcctgctttgggcctgagccttcctaaccctgggccgcactctcaccattttgagaaccttagccctcccacgcctatcagtctgttggtccccctacttttctccccacactgcctggcatagaagactttcggcccttctagactggacagcactatcctaaaggggcaggtaccacggcgcatgtgtgtttgcccccacaaggccaaaggcagcacctggaacgctggagccgttctctgctctggggagacccaggagccccaagaacaaaacctgcccaaagccttaaagcaagctgagtgcagacgactgcaccgcccgccccccagcaaccgccatgcaggaaatacgagctcacaaggcccacggcaacaagaagcccacccacctgaggctacgcgaatcgcccgcgaagagggtcctgggatccgtagccacagaccgtgggacgggcctccctctgagggcgagagtccaggcgccacctagaaagtggagaacgagatcggccgccgtgaggccaggcaaggagcgggcgcggcttcccgagactgcgagaacggcccaaatgtctccaggtgcccccacaaacccccggcgcggaccgagaaactgaggcccgcagaccgaaggcactgcgacccaggctggggctccgagtgcccctctgcggatcagaagtcgggaaaagacgcaggggcgcagctccaggcccgcgtgcacggagttcaagccggccgcccgggctcccgcctccacactgaccctcttgccggagtcgggaacgcctgctc

SEQ ID NO: 1027 - DNA, 7346 bp, Homo sapiens
ttgttttcaactttttattttgaagtaattatagattcacaggaggttgcataggaggttgtctagggaggtcctgggtacccttgccccagcctcccccaatgttaacaccttatacactacagcacagcatcaggacgcagaaattgacattggtacagtctacagaacatactcagtttccccagttacatctgtactcctttgtgtacctaactctacacaattttaacttcatgtatagccctgtgtaaccaccagtcaggctgacagatggttttcaacaccacaggactccctcgtatgaaccaccccctcaccatccctaacctaaacccctggtaacctttaatctgttttccatctctataattacattatttcaccaatgttacataaatggaatcctgctacatgtatgttttcaagattggctgtttttgctctgaagaatttccttgagtttcatctgagttgctgtgtgtacagcagttactgaaaatggcactatatcacatacagtacggatacatattgttttgtatttcaacaataatatgctatatataacagtctatgccagataataatgtaaaatacttattattaatatggggttttatccaaaacatttatttttatttttaaaacatttatttagagatggggtcttgctctgttgcccaggctggagtgcagtggcacgatcatagctgactgcaacctcaaactcctatcctcaagtgattcttctgcctcagcctcccaagtagctgagattacaggtgtgagccaccacacttagcacctgtccaaaaagtttgaaagatattgctcttattacagtatttgttttcttcataccaccaccataaaataccaaactgcttcagaaattaccaccattttatttttatttattttgagacaggatattgctctgtcacccaggttgaagtgcagtggggcacaatcatggctcactgcagcctcaaactcctgggctcaaacaatcctcctatctcagcctccgaagtagctggaactacaaatgcacgccaccatgcatagctcatttattttttgtagagatggggtcttgttacgttgcccaggctggtctcgaactcctgggctcaagcaatcctcccacctcagcctcccaaagtgctgggataacagccgtgagccaccacatccagccaccgttttaaattcctatttattgatgtttaatgtctgtcttttacccaaactacaacagaaactctttgaagacaacttgtctgtttcaaaactgtggtcttataagcctcaaaccctgtccaacatgtggacactcagatgttgtgaagcaattgacatagaaacaaatgcaggaacatcctgtccagagagattatctgttgatgtggaacttgagtagtgaaggaggaggcaaaacatgatagtcacactacagaggcaggacttaatgcttcctaacagagcatgcagccgcacaatgcataccttgctaaacaagcaggtggcagggagcgtggctgcactgaggggaagcccctcatggactggggtgctggctggcatgccctggcttttgctgcactctccagctctgccccaggaacctgaaggcagctgctgcaatcccaggcatcacatgcaggctgcaaactcattttattattttatctttgagacaagagtctcactctgtcgcccaggctggagtacagtggcacgatctcagctcactgcaacctctgcctctggggttcaagcaattctcctgtctcagcttcccgagtagctgggatcacaggcacgtgccaccatgcccagttaatttttgtatttttaatagagatggggggtttcaaccatgttggccaggctggtctcaaactccagacctcaagtgatccacccaccttggcctcccaaagtgctgggattacagcagactgcaaattcagatgccccgtccctgtgtttaagagtaagaaaaaccttgtagatctctagcagtcttcctctcttccctcactgggtggaaatgctcattattaaaccagccacagccatgctggaggcaccctggttgccttagacacatcagtactcccctgatgatgggggaacgctggctcctctttagatgctcctgctcttgggatcccgtgagcacaacccccacccccacccccactgttcacagacacaggggctcttagggagcacaggagaaaacacactcaagcagggaaatactgttctttaatggacacccttctaacgtgatagattattctgccccaaagaacaaattaaaagatattcaacttgctgcctgtgtccaggaagagagcagggagggtgctgggcacagacccagcctagccctcagcatcacacaacagggccaccataggatgagaaaccattctattagtaataaacagacctcttcaagaaatagtgtttttggtggttcatacattttaaaacacttaacaagagaataagcatacaaatttctaatactgtccaggtacaacactgttacacacaaaatctaacaagtgtgaacttaattttcagcttctatttgaaatcagatgaaatagcttttgatacattaaccaccaggggaaattttgagggaaggagtgcttaattccatatgtcttggacttggatttcttcagctgagtccacaaaccctctttatgcaaggttgtgtgttctgtagctgtgtgcatttcttaaaaaccagagtctccaggggccgacctgggagcctaagaagtgaagcctgctggtgcagaggggccagcaagccctacctgctcggcacacctgcctgcatgtgcagtggaactgagcgagtggagcagagtgtgagcactcacaatgctcaccaaacctgggacgtggcaggcagtttcccaaggactaggaaagacattcacagtggcacaactgtttagctacctcattatgacccacctgtgtgtccacacaggtcagggctacccttcagtttacctgagaagcctagacctcaggaccgccatctcctatgctaccatgcccagcctgacctggctgctcacaagtacctgccataatgcttggcctcctggaagctctaaagcggtgcaattgtcctgcagaacatcgcagtgtcagggtatcctgcatgcaggtgaggggtgggcaagtagggctagcaatgtcctgctccatgttcctgtgagcaagagctcacagggacccaccagactgtgtaggctggtcacagtccccagggctgtgcaacagcaacttgaaacagactgaggaagctgcacaggccaatggcagggatgcttgtcactcgtccttctcctgtggcagagggagatgccagtctggaggggggctctgcctcggggcccacaccaggatgtgcttccgtgcagcccggactcgtgcccgctcgctctcacagagggattgctgtgcaaatgagactctagtcactccccaggctctgagcaccctcaagacccctgtacctcccccctctcatcaccctctgaaacacagatggacaggcagggcctatggtacacaccactctgcagcacagctgcttccacctactataccttggcgattcttccatattagcgcacagagatggagatcattttttttctcacaagctactgtgaaaaactactgaataggtcataataatttgaggaatttttaaatatcttctcctggacctcagggctcaatggctctggttgacctcgtgagtctggggcatattcacctgctgagagtgagcctgggggtgctgggtggagaggagagaagagtctgagagagcagctgtggggagctgcagggaggagtgtgttagggagaagggaggaagacggggaagaaatacatgtcctgggtatcctggaagggtgggaagagtccagaggacagaccacccgcctgagtggtgccacaagtgccacttaacccatcagcttctcttggctactgtctcccaatacagacacaagtcagtgtatcacaacatgggtgacctttgctgtcagcccttggtaggtatcaggtgctatgtgagcctctttacacagataacttaatctgtctacatgtctgtctttgttcaagctctattgcctcaaataaaatattttgatcgtgtttaaaaagctatcagaaatgtagtacagaatattaaagattcccaaatgtccattcccaatgcggcagttaacagcttccctgatatctttttttggtccacattttagagctaacatgtttccctaaagataggataatcttttgctggctagtctacttcctgctttcttttcactaaacaatacactgtaggcacttttccatacccagggagatgaccgaccattcttttcaaaggctatctggtatttcactttgtggaaaaagctatttggtcaaatgtctattagtgaaatttaggttgttttcagcttttgcagtatcaaaaacataattagcattctaacttttaactgtacactgttatccaattacttccctgggataaagttccagaagtaaaacttaaggtcaaaaggtatgtatctgacatttacataatcagaacacctgacacccccaccaacactgcacaactacccagaattcttcaaacctctatcaacaccactttctgctgttactgtcatttagacttatatacctgacacctggccatttgattttttctttttttttcttgagagggagtcttactctgttgcccaggctggagtgcagtgacacgatctcggctcattgcaacctccgcctcccaggttcaaacaattctcctatctcagcctcccgagtagctgagattacaggtgtttgccaccatgcgtggctaattttcgtatttttagtagagatggggtttcgccatgttgccaggctggtctcaaactcctgacctcaggtgatctgcccacctcggcctcccaaagtgctaggattacaggcatgagccaccatgcccaggcttttctccttttttattatttttataaagatggagtctcaccatgttgcccatggctggtctcaagctcctgggctcaagcgatccccttgcctcggcctcccaaagtgccgagattacaggtgcccaccaccatgcccagctggctttcttttttaatgaattgcttctttgtgtcctttggccatttttccattctgaaataatccctatatttcttattgatatatatataacagctctttatacacacacacgcacatatatatacattaaagttatcaatctcttgctatataagctgtcagctttcttactttttttgactttcacatattatggaatagtcatcattttcttttatacagcagtctggtttccacatcagttcatctctttcagatcactgtatacacttaataatgttgaagtgttgatcagtcccattgattctcattccttggcactccccatgagcctcgcacctttcggctggcttctctccatctcctctcccacaaggggtccaccgtagcactgtattctacactacagtgtgggtgccaggagggcagagactcttcttatcactcgtgcatccccaagagcacccaatgtggtacatatttgctggacgaaaaaacaactagaaccacctccttaccggtctctctgctcctgtaatatattctctacaccctagcaaacagattgaacttcttttaccctctctcttttttttcccccctgagacaggtctccctctgttatccaggctggtgtgcagtggtgtgaccatagctcactgcagctttgaactcctgggcttaggcgatcctcccgcctcaccctcccaagtagctgggaccacaggtgcacgccaccacactttgctaacagactgatcttttaaagatataaatcgaattatgcctcccagcacactttagactaaactctaaactccgtatcaaaaggcccgccaggtccctggtataccgctctccaaccatccacctaccctctgcttcaggaacccaggccttatctgtttctcagcggtgtctaccggggctggatgaaggctggctcctggtcactcaggactcagcaacatcacctcctgcgtaggccagctgatgaccctaacaccggacggctgccctcttccctctctaaaccactctacaccccctcctcgctggtctcctcctttgtctttcacgccctctgaaagtcctgttgatatgctaatttacacaatctctcaaaagaaaggaagcgtgaggaggatagggaccccgtcagtccccggctaggtcgcggggcatggggcgtggaggggtggggaaagctgggccccgcaaggcgctccgaagcgccgccccgctccctcccggcgcacctgggcctcggcgttccggcgctcctcccagtcgcggcagctggccaggtcgcgctgccactgttcgcaggccggccgctcgccgtggacgtagtagtggtgtaggaagtgcctggcgctgcggcagagcttccactcggcgcggtaggcctcgcaggggcgcggcggctgcggcgagaggcggcgcctgagcggggcccggcggccgcgccctacgccccgagccagtcccgttccctccctccggaagaccccggtggttcccggctccgacccagcacactcacctgccagccgctgccgtccgccatgtctgggcgaccggcgcgccaagcccgcccctcagtccgccagccaatgaaaaatgaagaaaacggcacctcgtgatcgactgacagaagaactaatgagcaccgacacattcaatcacgtcttcgcccccttcttcgagaagcgccgacaaacaggacgagcaaccaatagcaaccgagggcggctgcggcgcgcgcggagggccggggtcgcagggtaaatccggggcgagacctggcgcgaagcctacgcgaccaccgcgacgacagcgccattcaccccgggccaggcgggcatcctgggccgcgcagctaccttacgtcagccgcctctcaaatcacacggctctggccagttcttttcagcagctttatgagattttctcaaatctcaacaatccggtatattttcaaaagtacatactgagcatcaaggtggtgcagcgaacctcccagatctgcagctccagcagtcttgcttgagcgtccactcaggatggaggtgaactcgcaaagtaactgagattggttgggcatgacatat

SEQ ID NO: 1028 - DNA, 5083 bp, Homo sapiens
cagggaaatactgttctttaatggacacccttctaacgtgatagattattctgccccaaagaacaaattaaaagatattcaacttgctgcctgtgtccaggaagagagcagggagggtgctgggcacagacccagcctagccctcagcatcacacaacagggccaccataggatgagaaaccattctattagtaataaacagacctcttcaagaaatagtgtttttggtggttcatacattttaaaacacttaacaagagaataagcatacaaatttctaatactgtccaggtacaacactgttacacacaaaatctaacaagtgtgaacttaattttcagcttctatttgaaatcagatgaaatagcttttgatacattaaccaccaggggaaattttgagggaaggagtgcttaattccatatgtcttggacttggatttcttcagctgagtccacaaaccctctttatgcaaggttgtgtgttctgtagctgtgtgcatttcttaaaaaccagagtctccaggggccgacctgggagcctaagaagtgaagcctgctggtgcagaggggccagcaagccctacctgctcggcacacctgcctgcatgtgcagtggaactgagcgagtggagcagagtgtgagcactcacaatgctcaccaaacctgggacgtggcaggcagtttcccaaggactaggaaagacattcacagtggcacaactgtttagctacctcattatgacccacctgtgtgtccacacaggtcagggctacccttcagtttacctgagaagcctagacctcaggaccgccatctcctatgctaccatgcccagcctgacctggctgctcacaagtacctgccataatgcttggcctcctggaagctctaaagcggtgcaattgtcctgcagaacatcgcagtgtcagggtatcctgcatgcaggtgaggggtgggcaagtagggctagcaatgtcctgctccatgttcctgtgagcaagagctcacagggacccaccagactgtgtaggctggtcacagtccccagggctgtgcaacagcaacttgaaacagactgaggaagctgcacaggccaatggcagggatgcttgtcactcgtccttctcctgtggcagagggagatgccagtctggaggggggctctgcctcggggcccacaccaggatgtgcttccgtgcagcccggactcgtgcccgctcgctctcacagagggattgctgtgcaaatgagactctagtcactccccaggctctgagcaccctcaagacccctgtacctcccccctctcatcaccctctgaaacacagatggacaggcagggcctatggtacacaccactctgcagcacagctgcttccacctactataccttggcgattcttccatattagcgcacagagatggagatcattttttttctcacaagctactgtgaaaaactactgaataggtcataataatttgaggaatttttaaatatcttctcctggacctcagggctcaatggctctggttgacctcgtgagtctggggcatattcacctgctgagagtgagcctgggggtgctgggtggagaggagagaagagtctgagagagcagctgtggggagctgcagggaggagtgtgttagggagaagggaggaagacggggaagaaatacatgtcctgggtatcctggaagggtgggaagagtccagaggacagaccacccgcctgagtggtgccacaagtgccacttaacccatcagcttctcttggctactgtctcccaatacagacacaagtcagtgtatcacaacatgggtgacctttgctgtcagcccttggtaggtatcaggtgctatgtgagcctctttacacagataacttaatctgtctacatgtctgtctttgttcaagctctattgcctcaaataaaatattttgatcgtgtttaaaaagctatcagaaatgtagtacagaatattaaagattcccaaatgtccattcccaatgcggcagttaacagcttccctgatatctttttttggtccacattttagagctaacatgtttccctaaagataggataatcttttgctggctagtctacttcctgctttcttttcactaaacaatacactgtaggcacttttccatacccagggagatgaccgaccattcttttcaaaggctatctggtatttcactttgtggaaaaagctatttggtcaaatgtctattagtgaaatttaggttgttttcagcttttgcagtatcaaaaacataattagcattctaacttttaactgtacactgttatccaattacttccctgggataaagttccagaagtaaaacttaaggtcaaaaggtatgtatctgacatttacataatcagaacacctgacacccccaccaacactgcacaactacccagaattcttcaaacctctatcaacaccactttctgctgttactgtcatttagacttatatacctgacacctggccatttgattttttctttttttttcttgagagggagtcttactctgttgcccaggctggagtgcagtgacacgatctcggctcattgcaacctccgcctcccaggttcaaacaattctcctatctcagcctcccgagtagctgagattacaggtgtttgccaccatgcgtggctaattttcgtatttttagtagagatggggtttcgccatgttgccaggctggtctcaaactcctgacctcaggtgatctgcccacctcggcctcccaaagtgctaggattacaggcatgagccaccatgcccaggcttttctccttttttattatttttataaagatggagtctcaccatgttgcccatggctggtctcaagctcctgggctcaagcgatccccttgcctcggcctcccaaagtgccgagattacaggtgcccaccaccatgcccagctggctttcttttttaatgaattgcttctttgtgtcctttggccatttttccattctgaaataatccctatatttcttattgatatatatataacagctctttatacacacacacgcacatatatatacattaaagttatcaatctcttgctatataagctgtcagctttcttactttttttgactttcacatattatggaatagtcatcattttcttttatacagcagtctggtttccacatcagttcatctctttcagatcactgtatacacttaataatgttgaagtgttgatcagtcccattgattctcattccttggcactccccatgagcctcgcacctttcggctggcttctctccatctcctctcccacaaggggtccaccgtagcactgtattctacactacagtgtgggtgccaggagggcagagactcttcttatcactcgtgcatccccaagagcacccaatgtggtacatatttgctggacgaaaaaacaactagaaccacctccttaccggtctctctgctcctgtaatatattctctacaccctagcaaacagattgaacttcttttaccctctctcttttttttcccccctgagacaggtctccctctgttatccaggctggtgtgcagtggtgtgaccatagctcactgcagctttgaactcctgggcttaggcgatcctcccgcctcaccctcccaagtagctgggaccacaggtgcacgccaccacactttgctaacagactgatcttttaaagatataaatcgaattatgcctcccagcacactttagactaaactctaaactccgtatcaaaaggcccgccaggtccctggtataccgctctccaaccatccacctaccctctgcttcaggaacccaggccttatctgtttctcagcggtgtctaccggggctggatgaaggctggctcctggtcactcaggactcagcaacatcacctcctgcgtaggccagctgatgaccctaacaccggacggctgccctcttccctctctaaaccactctacaccccctcctcgctggtctcctcctttgtctttcacgccctctgaaagtcctgttgatatgctaatttacacaatctctcaaaagaaaggaagcgtgaggaggatagggaccccgtcagtccccggctaggtcgcggggcatggggcgtggaggggtggggaaagctgggccccgcaaggcgctccgaagcgccgccccgctccctcccggcgcacctgggcctcggcgttccggcgctcctcccagtcgcggcagctggccaggtcgcgctgccactgttcgcaggccggccgctcgccgtggacgtagtagtggtgtaggaagtgcctggcgctgcggcagagcttccactcggcgcggtaggcctcgcaggggcgcggcggctgcggcgagaggcggcgcctgagcggggcccggcggccgcgccctacgccccgagccagtcccgttccctccctccggaagaccccggtggttcccggctccgacccagcacactcacctgccagccgctgccgtccgccatgtctgggcgaccggcgcgccaagcccgcccctcagtccgccagccaatgaaaaatgaagaaaacggcacctcgtgatcgactgacagaagaactaatgagcaccgacacattcaatcacgtcttcgcccccttcttcgagaagcgccgacaaacaggacgagcaaccaatagcaaccgagggcggctgcggcgcgcgcggagggccggggtcgcagggtaaatccggggcgagacctggcgcgaagcctacgcgaccaccgcgacgacagcgccattcaccccgggccaggcgggcatcctgggccgcgcagctaccttacgtcagccgcctctcaaatcacacggctctggccagttcttttcagcagctttatgagattttctcaaatctcaacaatccggtatattttcaaaagtacatactgagcatcaaggtggtgcagcgaacctcccagatctgcagctccagcagtcttgcttgagcgtccactcaggatggaggtgaactcgcaaagtaactgagattggttgggcatgacatat

SEQ ID NO: 1029 - DNA, 40722 bp, Homo sapiens
gtgatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgtgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccaaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattcttcatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcgggtatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaacctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttcttgttctttgttatttgtatttttatttttttgagatggagtttcgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcagatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaaggcagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcggagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtcccca

SEQ ID NO: 1030 - DNA, 40722 bp, Homo sapiens; identical to SEQ ID NO: 1029

SEQ ID NO: 1031 - DNA, 40720 bp, Homo sapiens
gatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgtgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccaaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattcttcatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcgggtatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaacctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttcttgttctttgttatttgtatttttatttttttgagatggagtttcgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcagatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaaggcagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcggagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtcccca

SEQ ID NO: 1032 - DNA, 2314 bp, Homo sapiens
ggagagagttcaaaccatttactaagcagattcttagccttcccactcccgccctctctcaagctccggtgcccacaagccttgcctggggagatgctggagtgagaccgggaggtccaggccaagtcactggtccctgggctcgggccctgccgatggagtaaagaccagctgtacacatcttccggtgggggccctgggctctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcgacccccagtctgcaccacccagtccactcccacatccccgactgagccgggtggtctcttccactcgagccagctccacttccctgaccaaggtttgcagaagccccccaccccgtcaccgccgtagaggccctcgtaggggggctctccagaaagcccgccccggggtccaagccccacccaggccctttctcgcactctcactctccagccccgctctgagtcccagcactgtctctctcatcccatggcaaacagagaggccaggcaggcgtgtggaggtcaggcccagggccccagcctcaccccccatgccactcactgcctctctggagcctgagtctctggcaaaaagcggtggcacaggggctttccccctgcctggcgacccccactctcccaagccgcaggggcttcccagacctctcaatcttcacaggggctgctcctcttcctgcggtactgcccgcaccccatccttgggggcccagttcaggtgacaccacttcaggaagttcccagtgacccagcacactgggtgtagcacccaggggcagtggtggccccaggcctagcagcctgctctggccttcagacaggagagac

SEQ ID NO: 1033 - DNA, 2314 bp, Homo sapiens; identical to SEQ ID NO: 1032
